United States Patent 9,205,144 (IDENTIFICATION OF CONSERVED PEPTIDE BLOCKS IN HOMOLOGOUS POLYPEPTIDES) - sequence listing, part 14

SEQ ID NO: 506187 - protein, 10 aa, Influenza virus
NAIDTGDGCF

SEQ ID NO: 506188 - protein, 10 aa, Influenza virus
NAIDTGKGCF

SEQ ID NO: 506189 - protein, 10 aa, Influenza virus
NAIDTGNGCF

SEQ ID NO: 506190 - protein, 10 aa, Influenza virus
NAIGDCPKYI

SEQ ID NO: 506191 - protein, 10 aa, Influenza virus
NAINEGNGCF

SEQ ID NO: 506192 - protein, 10 aa, Influenza virus
NAIRFGEGEQ

SEQ ID NO: 506193 - protein, 10 aa, Influenza virus
NAIRFGESEQ

SEQ ID NO: 506194 - protein, 10 aa, Influenza virus
NAIRIGEDAH

SEQ ID NO: 506195 - protein, 10 aa, Influenza virus
NAIRIGEEAH

SEQ ID NO: 506196 - protein, 10 aa, Influenza virus
NAIRIGEGAH

SEQ ID NO: 506197 - protein, 10 aa, Influenza virus
NAIRIGENAH

SEQ ID NO: 506198 - protein, 10 aa, Influenza virus
NAISTTFPYT

SEQ ID NO: 506199 - protein, 10 aa, Influenza virus
NAITRSGQNH

SEQ ID NO: 506200 - protein, 10 aa, Influenza virus
NAKDEGNGCF

SEQ ID NO: 506201 - protein, 10 aa, Influenza virus
NAKDLGNGCF

SEQ ID NO: 506202 - protein, 10 aa, Influenza virus
NAKEIGNGCF

SEQ ID NO: 506203 - protein, 10 aa, Influenza virus
NAKELGNGCF

SEQ ID NO: 506204 - protein, 10 aa, Influenza virus
NAKEMGNGCF

SEQ ID NO: 506205 - protein, 10 aa, Influenza virus
NAKETGNGCF

SEQ ID NO: 506206 - protein, 10 aa, Influenza virus
NAKEVGNGCF

SEQ ID NO: 506207 - protein, 10 aa, Influenza virus
NAKEWGNGCF

SEQ ID NO: 506208 - protein, 10 aa, Influenza virus
NAKLLVLIEN

SEQ ID NO: 506209 - protein, 10 aa, Influenza virus
NAKLLVLLEN

SEQ ID NO: 506210 - protein, 10 aa, Influenza virus
NALDTGDGCF

SEQ ID NO: 506211 - protein, 10 aa, Influenza virus
NALGDCPKYI

SEQ ID NO: 506212 - protein, 10 aa, Influenza virus
NALGECPKYI

SEQ ID NO: 506213 - protein, 10 aa, Influenza virus
NALGNCPKYI

SEQ ID NO: 506214 - protein, 10 aa, Influenza virus
NALIDDRSKP

SEQ ID NO: 506215 - protein, 10 aa, Influenza virus
NALLKHRFEI

SEQ ID NO: 506216 - protein, 10 aa, Influenza virus
NALNGNGDPN

SEQ ID NO: 506217 - protein, 10 aa, Influenza virus
NALSGNGDPN

SEQ ID NO: 506218 - protein, 10 aa, Influenza virus
NALSIAPIMF

SEQ ID NO: 506219 - protein, 10 aa, Influenza virus
NALTDDKSKP

SEQ ID NO: 506220 - protein, 10 aa, Influenza virus
NALTDDRSKP

SEQ ID NO: 506221 - protein, 10 aa, Influenza virus
NALTDERSKP

SEQ ID NO: 506222 - protein, 10 aa, Influenza virus
NALTDNRSKP

SEQ ID NO: 506223 - protein, 10 aa, Influenza virus
NALTGGQSFY

SEQ ID NO: 506224 - protein, 10 aa, Influenza virus
NALYGTQSLS

SEQ ID NO: 506225 - protein, 10 aa, Influenza virus
NAMDAGNGCF

SEQ ID NO: 506226 - protein, 10 aa, Influenza virus
NANDLGNGCF

SEQ ID NO: 506227 - protein, 10 aa, Influenza virus
NANTLSSVNT

SEQ ID NO: 506228 - protein, 10 aa, Influenza virus
NANTLSSVTT

SEQ ID NO: 506229 - protein, 10 aa, Influenza virus
NANTLTSVTT

SEQ ID NO: 506230 - protein, 10 aa, Influenza virus
NAPHKLCFPG

SEQ ID NO: 506231 - protein, 10 aa, Influenza virus
NAPHKLCYPG

SEQ ID NO: 506232 - protein, 10 aa, Influenza virus
NAPNKFCYPG

SEQ ID NO: 506233 - protein, 10 aa, Influenza virus
NAPNKLCFPG

SEQ ID NO: 506234 - protein, 10 aa, Influenza virus
NAPNKLCYPG

SEQ ID NO: 506235 - protein, 10 aa, Influenza virus
NAPSGIEYNG

SEQ ID NO: 506236 - protein, 10 aa, Influenza virus
NAPSGVEYNG

SEQ ID NO: 506237 - protein, 10 aa, Influenza virus
NAQAFYKILK

SEQ ID NO: 506238 - protein, 10 aa, Influenza virus
NAQEIGNGCF

SEQ ID NO: 506239 - protein, 10 aa, Influenza virus
NAQGEGIAAD

SEQ ID NO: 506240 - protein, 10 aa, Influenza virus
NAQGEGTAAD

SEQ ID NO: 506241 - protein, 10 aa, Influenza virus
NAQGIGQAAD

SEQ ID NO: 506242 - protein, 10 aa, Influenza virus
NAQGQGTAAD

SEQ ID NO: 506243 - protein, 10 aa, Influenza virus
NAQGTGQAAD

SEQ ID NO: 506244 - protein, 10 aa, Influenza virus
NAQGTGQVAD

SEQ ID NO: 506245 - protein, 10 aa, Influenza virus
NAQHIEECSC

SEQ ID NO: 506246 - protein, 10 aa, Influenza virus
NAQHVEECSC

SEQ ID NO: 506247 - protein, 10 aa, Influenza virus
NAQLLVLLEN

SEQ ID NO: 506248 - protein, 10 aa, Influenza virus
NAQLLVWLEN

SEQ ID NO: 506249 - protein, 10 aa, Influenza virus
NARELGNGCF

SEQ ID NO: 506250 - protein, 10 aa, Influenza virus
NARLLVLLEN

SEQ ID NO: 506251 - protein, 10 aa, Influenza virus
NASCAAMDDF

SEQ ID NO: 506252 - protein, 10 aa, Influenza virus
NASCAAMDEF

SEQ ID NO: 506253 - protein, 10 aa, Influenza virus
NASCAAMEDF

SEQ ID NO: 506254 - protein, 10 aa, Influenza virus
NASRHHMGEC

SEQ ID NO: 506255 - protein, 10 aa, Influenza virus
NASRHYMGEC

SEQ ID NO: 506256 - protein, 10 aa, Influenza virus
NASRYYMGEC

SEQ ID NO: 506257 - protein, 10 aa, Influenza virus
NASTGAQSFY

SEQ ID NO: 506258 - protein, 10 aa, Influenza virus
NASTGGQAFY

SEQ ID NO: 506259 - protein, 10 aa, Influenza virus
NASTGGQSFY

SEQ ID NO: 506260 - protein, 10 aa, Influenza virus
NASWFNSFLA

SEQ ID NO: 506261 - protein, 10 aa, Influenza virus
NASWFNSFLI

SEQ ID NO: 506262 - protein, 10 aa, Influenza virus
NASWFNSFLK

SEQ ID NO: 506263 - protein, 10 aa, Influenza virus
NASWFNSFLT

SEQ ID NO: 506264 - protein, 10 aa, Influenza virus
NASWFNSFLV

SEQ ID NO: 506265 - protein, 10 aa, Influenza virus
NATASFIYDG

SEQ ID NO: 506266 - protein, 10 aa, Influenza virus
NATASFIYEG

SEQ ID NO: 506267 - protein, 10 aa, Influenza virus
NATASFIYGG

SEQ ID NO: 506268 - protein, 10 aa, Influenza virus
NATASFIYNE

SEQ ID NO: 506269 - protein, 10 aa, Influenza virus
NATASFIYNG

SEQ ID NO: 506270 - protein, 10 aa, Influenza virus
NATASFVYDG

SEQ ID NO: 506271 - protein, 10 aa, Influenza virus
NATASLIYDG

SEQ ID NO: 506272 - protein, 10 aa, Influenza virus
NATATVYYDR

SEQ ID NO: 506273 - protein, 10 aa, Influenza virus
NATATVYYER

SEQ ID NO: 506274 - protein, 10 aa, Influenza virus
NATATVYYNG

SEQ ID NO: 506275 - protein, 10 aa, Influenza virus
NATATVYYNK

SEQ ID NO: 506276 - protein, 10 aa, Influenza virus
NATATVYYNR

SEQ ID NO: 506277 - protein, 10 aa, Influenza virus
NATDTVDTLT

SEQ ID NO: 506278 - protein, 10 aa, Influenza virus
NATETVEITG

SEQ ID NO: 506279 - protein, 10 aa, Influenza virus
NAVDEGNGCF

SEQ ID NO: 506280 - protein, 10 aa, Influenza virus
NAVDTGDGCF

SEQ ID NO: 506281 - protein, 10 aa, Influenza virus
NAVDTGNGCF

SEQ ID NO: 506282 - protein, 10 aa, Influenza virus
NAVRFGESEQ

SEQ ID NO: 506283 - protein, 10 aa, Influenza virus
NAVRIGEDAH

SEQ ID NO: 506284 - protein, 10 aa, Influenza virus
NAYDRICIGY

SEQ ID NO: 506285 - protein, 10 aa, Influenza virus
NAYQAKFESV

SEQ ID NO: 506286 - protein, 10 aa, Influenza virus
NAYQAQFESV

SEQ ID NO: 506287 - protein, 10 aa, Influenza virus
NAYQARFESV

SEQ ID NO: 506288 - protein, 10 aa, Influenza virus
NCDTKCQTPL

SEQ ID NO: 506289 - protein, 10 aa, Influenza virus
NCETKCQSPL

SEQ ID NO: 506290 - protein, 10 aa, Influenza virus
NCETKCQTPL

SEQ ID NO: 506291 - protein, 10 aa, Influenza virus
NCETQCQTPL

SEQ ID NO: 506292 - protein, 10 aa, Influenza virus
NCIESIRNGT

SEQ ID NO: 506293 - protein, 10 aa, Influenza virus
NCIKPCFWVE

SEQ ID NO: 506294 - protein, 10 aa, Influenza virus
NCINRCFYVE

SEQ ID NO: 506295 - protein, 10 aa, Influenza virus
NCIRPCFWVE

SEQ ID NO: 506296 - protein, 10 aa, Influenza virus
NCKDPNNERG

SEQ ID NO: 506297 - protein, 10 aa, Influenza virus
NCLVPCFWVE

SEQ ID NO: 506298 - protein, 10 aa, Influenza virus
NCLYASPQLE

SEQ ID NO: 506299 - protein, 10 aa, Influenza virus
NCMERIRNNT

SEQ ID NO: 506300 - protein, 10 aa, Influenza virus
NCMESIRDNT

SEQ ID NO: 506301 - protein, 10 aa, Influenza virus
NCMESIRNNT

SEQ ID NO: 506302 - protein, 10 aa, Influenza virus
NCMRPCFWVE

SEQ ID NO: 506303 - protein, 10 aa, Influenza virus
NCPKYIKSGQ

SEQ ID NO: 506304 - protein, 10 aa, Influenza virus
NCPKYVKQGS

SEQ ID NO: 506305 - protein, 10 aa, Influenza virus
NCRDPNNERG

SEQ ID NO: 506306 - protein, 10 aa, Influenza virus
NCRNPNNEKG

SEQ ID NO: 506307 - protein, 10 aa, Influenza virus
NCRNPNNERG

SEQ ID NO: 506308 - protein, 10 aa, Influenza virus
NCSIAGWLLG

SEQ ID NO: 506309 - protein, 10 aa, Influenza virus
NCTIPCFWVE

SEQ ID NO: 506310 - protein, 10 aa, Influenza virus
NCTVPCFWVE

SEQ ID NO: 506311 - protein, 10 aa, Influenza virus
NCWSFALAQG

SEQ ID NO: 506312 - protein, 10 aa, Influenza virus
NCYQFALGQG

SEQ ID NO: 506313 - protein, 10 aa, Influenza virus
NCYWVMTDGP

SEQ ID NO: 506314 - protein, 10 aa, Influenza virus
NDATYQRTRA

SEQ ID NO: 506315 - protein, 10 aa, Influenza virus
NDAYAVIHYG

SEQ ID NO: 506316 - protein, 10 aa, Influenza virus
NDDIDQSLII

SEQ ID NO: 506317 - protein, 10 aa, Influenza virus
NDDSSSNSNC

SEQ ID NO: 506318 - protein, 10 aa, Influenza virus
NDDSSSSSNC

SEQ ID NO: 506319 - protein, 10 aa, Influenza virus
NDDVDQSLII

SEQ ID NO: 506320 - protein, 10 aa, Influenza virus
NDDVDQSLVI

SEQ ID NO: 506321 - protein, 10 aa, Influenza virus
NDDVSWASNS

SEQ ID NO: 506322 - protein, 10 aa, Influenza virus
NDDVSWTSNS

SEQ ID NO: 506323 - protein, 10 aa, Influenza virus
NDEGTGIAAD

SEQ ID NO: 506324 - protein, 10 aa, Influenza virus
NDERGNPGVK

SEQ ID NO: 506325 - protein, 10 aa, Influenza virus
NDEVDQSLII

SEQ ID NO: 506326 - protein, 10 aa, Influenza virus
NDEVSWTSNS

SEQ ID NO: 506327 - protein, 10 aa, Influenza virus
NDFFKRLNWL

SEQ ID NO: 506328 - protein, 10 aa, Influenza virus
NDFFNRLNWL

SEQ ID NO: 506329 - protein, 10 aa, Influenza virus
NDFFRRLNWL

SEQ ID NO: 506330 - protein, 10 aa, Influenza virus
NDGKVECVCR

SEQ ID NO: 506331 - protein, 10 aa, Influenza virus
NDKHSNGTAK

SEQ ID NO: 506332 - protein, 10 aa, Influenza virus
NDKHSNGTIK

SEQ ID NO: 506333 - protein, 10 aa, Influenza virus
NDKHSNGTMK

SEQ ID NO: 506334 - protein, 10 aa, Influenza virus
NDKHSNGTVK

SEQ ID NO: 506335 - protein, 10 aa, Influenza virus
NDKHSNNTVK

SEQ ID NO: 506336 - protein, 10 aa, Influenza virus
NDKHSNNTVR

SEQ ID NO: 506337 - protein, 10 aa, Influenza virus
NDKPFQNVNK

SEQ ID NO: 506338 - protein, 10 aa, Influenza virus
NDKPFQNVNR

SEQ ID NO: 506339 - protein, 10 aa, Influenza virus
NDKTLDLHDA

SEQ ID NO: 506340 - protein, 10 aa, Influenza virus
NDKTLDMHDA

SEQ ID NO: 506341 - protein, 10 aa, Influenza virus
NDKTLNMHDA

SEQ ID NO: 506342 - protein, 10 aa, Influenza virus
NDKYHQIEKE

SEQ ID NO: 506343 - protein, 10 aa, Influenza virus
NDLGNGCFEF

SEQ ID NO: 506344 - protein, 10 aa, Influenza virus
NDLGPATAQM

SEQ ID NO: 506345 - protein, 10 aa, Influenza virus
NDLYGTQPLS

SEQ ID NO: 506346 - protein, 10 aa, Influenza virus
NDLYGTQSLS

SEQ ID NO: 506347 - protein, 10 aa, Influenza virus
NDNASAVVWY

SEQ ID NO: 506348 - protein, 10 aa, Influenza virus
NDNATATVYY

SEQ ID NO: 506349 - protein, 10 aa, Influenza virus
NDNVSWTSNS

SEQ ID NO: 506350 - protein, 10 aa, Influenza virus
NDNWSGYSGS

SEQ ID NO: 506351 - protein, 10 aa, Influenza virus
NDPSGYAQTD

SEQ ID NO: 506352 - protein, 10 aa, Influenza virus
NDPWVLLNAS

SEQ ID NO: 506353 - protein, 10 aa, Influenza virus
NDPYPGNNNK

SEQ ID NO: 506354 - protein, 10 aa, Influenza virus
NDPYPGNNNN

SEQ ID NO: 506355 - protein, 10 aa, Influenza virus
NDPYPGNSNN

SEQ ID NO: 506356 - protein, 10 aa, Influenza virus
NDPYPGSNNN

SEQ ID NO: 506357 - protein, 10 aa, Influenza virus
NDQGAGYAAD

SEQ ID NO: 506358 - protein, 10 aa, Influenza virus
NDQGSGYAAD

SEQ ID NO: 506359 - protein, 10 aa, Influenza virus
NDQIEDLWAY

SEQ ID NO: 506360 - protein, 10 aa, Influenza virus
NDQITDIWAY

SEQ ID NO: 506361 - protein, 10 aa, Influenza virus
NDRHSNGTIK

SEQ ID NO: 506362 - protein, 10 aa, Influenza virus
NDRHSNGTVK

SEQ ID NO: 506363 - protein, 10 aa, Influenza virus
NDRNFWRGDN

SEQ ID NO: 506364 - protein, 10 aa, Influenza virus
NDRNFWRGEN

SEQ ID NO: 506365 - protein, 10 aa, Influenza virus
NDRSPFRALV

SEQ ID NO: 506366 - protein, 10 aa, Influenza virus
NDRSPHRTLM

SEQ ID NO: 506367 - protein, 10 aa, Influenza virus
NDRTLDLHDA

SEQ ID NO: 506368 - protein, 10 aa, Influenza virus
NDSCMDTIRN

SEQ ID NO: 506369 - protein, 10 aa, Influenza virus
NDSCMEAIRN

SEQ ID NO: 506370 - protein, 10 aa, Influenza virus
NDSCMETIRN

SEQ ID NO: 506371 - protein, 10 aa, Influenza virus
NDTDVVNFLS

SEQ ID NO: 506372 - protein, 10 aa, Influenza virus
NDTDVVNFVS

SEQ ID NO: 506373 - protein, 10 aa, Influenza virus
NDTDVVNYVS

SEQ ID NO: 506374 - protein, 10 aa, Influenza virus
NDTINYYNET

SEQ ID NO: 506375 - protein, 10 aa, Influenza virus
NDTITFSFNG

SEQ ID NO: 506376 - protein, 10 aa, Influenza virus
NDTTYQRTRA

SEQ ID NO: 506377 - protein, 10 aa, Influenza virus
NDTVIFSFNG

SEQ ID NO: 506378 - protein, 10 aa, Influenza virus
NDTVNFSFNG

SEQ ID NO: 506379 - protein, 10 aa, Influenza virus
NDTVTFIFNG

SEQ ID NO: 506380 - protein, 10 aa, Influenza virus
NDTVTFNFNG

SEQ ID NO: 506381 - protein, 10 aa, Influenza virus
NDTVTFSFNG

SEQ ID NO: 506382 - protein, 10 aa, Influenza virus
NDTVTFTFNG

SEQ ID NO: 506383 - protein, 10 aa, Influenza virus
NDTVTGSFNG

SEQ ID NO: 506384 - protein, 10 aa, Influenza virus
NDVWLGRTIS

SEQ ID NO: 506385 - protein, 10 aa, Influenza virus
NDVWLGRTVS

SEQ ID NO: 506386 - protein, 10 aa, Influenza virus
NDVWLGRTVT

SEQ ID NO: 506387 - protein, 10 aa, Influenza virus
NDVWMGRTIS

SEQ ID NO: 506388 - protein, 10 aa, Influenza virus
NDWSGYSGSF

SEQ ID NO: 506389 - protein, 10 aa, Influenza virus
NDYEELKHLL

SEQ ID NO: 506390 - protein, 10 aa, Influenza virus
NDYEELKHLM

SEQ ID NO: 506391 - protein, 10 aa, Influenza virus
NEAINNRFQI

SEQ ID NO: 506392 - protein, 10 aa, Influenza virus
NECIEKIRNG

SEQ ID NO: 506393 - protein, 10 aa, Influenza virus
NECIEKVRNG

SEQ ID NO: 506394 - protein, 10 aa, Influenza virus
NECIERVRNG

SEQ ID NO: 506395 - protein, 10 aa, Influenza virus
NECMETIKNG

SEQ ID NO: 506396 - protein, 10 aa, Influenza virus
NECRFYALSQ

SEQ ID NO: 506397 - protein, 10 aa, Influenza virus
NECRTFFLTQ

SEQ ID NO: 506398 - protein, 10 aa, Influenza virus
NECYNPCFYV

SEQ ID NO: 506399 - protein, 10 aa, Influenza virus
NEDGDIIFLW

SEQ ID NO: 506400 - protein, 10 aa, Influenza virus
NEDGNIIFLW

SEQ ID NO: 506401 - protein, 10 aa, Influenza virus
NEDGSSSSNC

SEQ ID NO: 506402 - protein, 10 aa, Influenza virus
NEDSSSNSNC

SEQ ID NO: 506403 - protein, 10 aa, Influenza virus
NEDSSSSSNC

SEQ ID NO: 506404 - protein, 10 aa, Influenza virus
NEEALRQIIR

SEQ ID NO: 506405 - protein, 10 aa, Influenza virus
NEEALRQILR

SEQ ID NO: 506406 - protein, 10 aa, Influenza virus
NEEALRQKIM

SEQ ID NO: 506407 - protein, 10 aa, Influenza virus
NEEGDIIFLW

SEQ ID NO: 506408 - protein, 10 aa, Influenza virus
NEEGTGIAAD

SEQ ID NO: 506409 - protein, 10 aa, Influenza virus
NEEGTGVAAD

SEQ ID NO: 506410 - protein, 10 aa, Influenza virus
NEEPLRQILR

SEQ ID NO: 506411 - protein, 10 aa, Influenza virus
NEERGNPGVK

SEQ ID NO: 506412 - protein, 10 aa, Influenza virus
NEERGSPGVK

SEQ ID NO: 506413 - protein, 10 aa, Influenza virus
NEESLRQIIR

SEQ ID NO: 506414 - protein, 10 aa, Influenza virus
NEESLRQILR

SEQ ID NO: 506415 - protein, 10 aa, Influenza virus
NEFNEIEQQI

SEQ ID NO: 506416 - protein, 10 aa, Influenza virus
NEFNEVEQQI

SEQ ID NO: 506417 - protein, 10 aa, Influenza virus
NEFNKACELT

SEQ ID NO: 506418 - protein, 10 aa, Influenza virus
NEFSEIEQQI

SEQ ID NO: 506419 - protein, 10 aa, Influenza virus
NEFTEIEQQI

SEQ ID NO: 506420 - protein, 10 aa, Influenza virus
NEFTEVEKQI

SEQ ID NO: 506421 - protein, 10 aa, Influenza virus
NEFTEVEQQI

SEQ ID NO: 506422 - protein, 10 aa, Influenza virus
NEGALRQKIM

SEQ ID NO: 506423 - protein, 10 aa, Influenza virus
NEGHIEECSC

SEQ ID NO: 506424 - protein, 10 aa, Influenza virus
NEGIMNTSKP

SEQ ID NO: 506425 - protein, 10 aa, Influenza virus
NEGKVECICR

SEQ ID NO: 506426 - protein, 10 aa, Influenza virus
NEGKVECVCR

SEQ ID NO: 506427 - protein, 10 aa, Influenza virus
NEGNGCFELL

SEQ ID NO: 506428 - protein, 10 aa, Influenza virus
NEGSYFFGDN

SEQ ID NO: 506429 - protein, 10 aa, Influenza virus
NEGSYFFGDS

SEQ ID NO: 506430 - protein, 10 aa, Influenza virus
NEGVINTSKP

SEQ ID NO: 506431 - protein, 10 aa, Influenza virus
NEGVMNTSKP

SEQ ID NO: 506432 - protein, 10 aa, Influenza virus
NEHSNGTIHD

SEQ ID NO: 506433 - protein, 10 aa, Influenza virus
NEHSNGTTHD

SEQ ID NO: 506434 - protein, 10 aa, Influenza virus
NEIEHQIGNV

SEQ ID NO: 506435 - protein, 10 aa, Influenza virus
NEIEQQIGNV

SEQ ID NO: 506436 - protein, 10 aa, Influenza virus
NEIEYQIGNV

SEQ ID NO: 506437 - protein, 10 aa, Influenza virus
NEIKGVELSS

SEQ ID NO: 506438 - protein, 10 aa, Influenza virus
NEIKGVKLSN

SEQ ID NO: 506439 - protein, 10 aa, Influenza virus
NEIKGVKLSS

SEQ ID NO: 506440 - protein, 10 aa, Influenza virus
NEIRASVGRM

SEQ ID NO: 506441 - protein, 10 aa, Influenza virus
NEITTKINNI

SEQ ID NO: 506442 - protein, 10 aa, Influenza virus
NEKFHQIEKE

SEQ ID NO: 506443 - protein, 10 aa, Influenza virus
NEKGNPGVKG

SEQ ID NO: 506444 - protein, 10 aa, Influenza virus
NEKGNQGVKG

SEQ ID NO: 506445 - protein, 10 aa, Influenza virus
NEKKAKLANV

SEQ ID NO: 506446 - protein, 10 aa, Influenza virus
NEKPFQNVNK

SEQ ID NO: 506447 - protein, 10 aa, Influenza virus
NEKTLDLHDS

SEQ ID NO: 506448 - protein, 10 aa, Influenza virus
NEKYHQIEKE

SEQ ID NO: 506449 - protein, 10 aa, Influenza virus
NELGIPFHLG

SEQ ID NO: 506450 - protein, 10 aa, Influenza virus
NELGNGCFEF

SEQ ID NO: 506451 - protein, 10 aa, Influenza virus
NELGVPFHLA

SEQ ID NO: 506452 - protein, 10 aa, Influenza virus
NELGVPFHLG

SEQ ID NO: 506453 - protein, 10 aa, Influenza virus
NELGVPFHMG

SEQ ID NO: 506454 - protein, 10 aa, Influenza virus
NELGVPFYLG

SEQ ID NO: 506455 - protein, 10 aa, Influenza virus
NELGVSFHLG

SEQ ID NO: 506456 - protein, 10 aa, Influenza virus
NELYGTQSLS

SEQ ID NO: 506457 - protein, 10 aa, Influenza virus
NEMTLDFHDS

SEQ ID NO: 506458 - protein, 10 aa, Influenza virus
NENATATVYY

SEQ ID NO: 506459 - protein, 10 aa, Influenza virus
NENGDIIFLW

SEQ ID NO: 506460 - protein, 10 aa, Influenza virus
NENPAHKSQL

SEQ ID NO: 506461 - protein, 10 aa, Influenza virus
NENPVHKSQL

SEQ ID NO: 506462 - protein, 10 aa, Influenza virus
NENQNPRIFL

SEQ ID NO: 506463 - protein, 10 aa, Influenza virus
NENQNPRMFL

SEQ ID NO: 506464 - protein, 10 aa, Influenza virus
NENQNPRVFL

SEQ ID NO: 506465 - protein, 10 aa, Influenza virus
NEPGSGDWPD

SEQ ID NO: 506466 - protein, 10 aa, Influenza virus
NEPGSGNWPD

SEQ ID NO: 506467 - protein, 10 aa, Influenza virus
NEPNGYAQTD

SEQ ID NO: 506468 - protein, 10 aa, Influenza virus
NEPSGYAQTD

SEQ ID NO: 506469 - protein, 10 aa, Influenza virus
NEPTGYAQTD

SEQ ID NO: 506470 - protein, 10 aa, Influenza virus
NEPYPGNNNN

SEQ ID NO: 506471 - protein, 10 aa, Influenza virus
NEQAAEAMEV

SEQ ID NO: 506472 - protein, 10 aa, Influenza virus
NEQGMGMAAD

SEQ ID NO: 506473 - protein, 10 aa, Influenza virus
NEQGSGFAAD

SEQ ID NO: 506474 - protein, 10 aa, Influenza virus
NEQGSGYAAD

SEQ ID NO: 506475 - protein, 10 aa, Influenza virus
NEQGSGYAAN

SEQ ID NO: 506476 - protein, 10 aa, Influenza virus
NEQGTGIAAD

SEQ ID NO: 506477 - protein, 10 aa, Influenza virus
NEQGTGIAAE

SEQ ID NO: 506478 - protein, 10 aa, Influenza virus
NEQGVGIAAD

SEQ ID NO: 506479 - protein, 10 aa, Influenza virus
NEQGVGMAAD

SEQ ID NO: 506480 - protein, 10 aa, Influenza virus
NEQGYGYAAD

SEQ ID NO: 506481 - protein, 10 aa, Influenza virus
NEQTDLYKVA

SEQ ID NO: 506482 - protein, 10 aa, Influenza virus
NERGLFGAIA

SEQ ID NO: 506483 - protein, 10 aa, Influenza virus
NERGNPGVKG

SEQ ID NO: 506484 - protein, 10 aa, Influenza virus
NERGNQGVKG

SEQ ID NO: 506485 - protein, 10 aa, Influenza virus
NERGTQGVKG

SEQ ID NO: 506486 - protein, 10 aa, Influenza virus
NERGYPGVKG

SEQ ID NO: 506487 - protein, 10 aa, Influenza virus
NERTIWTSGS

SEQ ID NO: 506488 - protein, 10 aa, Influenza virus
NERTLDFHDF

SEQ ID NO: 506489 - protein, 10 aa, Influenza virus
NERTLDFHDL

SEQ ID NO: 506490 - protein, 10 aa, Influenza virus
NERTLDFHDS

SEQ ID NO: 506491 - protein, 10 aa, Influenza virus
NERTLDLHDA

SEQ ID NO: 506492 - protein, 10 aa, Influenza virus
NERTLDLHDS

SEQ ID NO: 506493 - protein, 10 aa, Influenza virus
NERTLDMHDA

SEQ ID NO: 506494 - protein, 10 aa, Influenza virus
NERTLDMHDV

SEQ ID NO: 506495 - protein, 10 aa, Influenza virus
NERTLDQHDA

SEQ ID NO: 506496 - protein, 10 aa, Influenza virus
NERTLDYHDF

SEQ ID NO: 506497 - protein, 10 aa, Influenza virus
NERTLDYHDS

SEQ ID NO: 506498 - protein, 10 aa, Influenza virus
NERTLGFHDS

SEQ ID NO: 506499 - protein, 10 aa, Influenza virus
NERTLYFHDS

SEQ ID NO: 506500 - protein, 10 aa, Influenza virus
NESADMSIGI

SEQ ID NO: 506501 - protein, 10 aa, Influenza virus
NESADMSIGV

SEQ ID NO: 506502 - protein, 10 aa, Influenza virus
NESGRLIDFL

SEQ ID NO: 506503 - protein, 10 aa, Influenza virus
NESGRLMDFL

SEQ ID NO: 506504 - protein, 10 aa, Influenza virus
NETFVNMTNV

SEQ ID NO: 506505 - protein, 10 aa, Influenza virus
NETFVNVTHV

SEQ ID NO: 506506 - protein, 10 aa, Influenza virus
NETFVNVTNV

SEQ ID NO: 506507 - protein, 10 aa, Influenza virus
NETIIETGYV

SEQ ID NO: 506508 - protein, 10 aa, Influenza virus
NETILETGYI

SEQ ID NO: 506509 - protein, 10 aa, Influenza virus
NETILETGYV

SEQ ID NO: 506510 - protein, 10 aa, Influenza virus
NETIVETGYV

SEQ ID NO: 506511 - protein, 10 aa, Influenza virus
NEVEQQIGNV

SEQ ID NO: 506512 - protein, 10 aa, Influenza virus
NEVGAKILTS

SEQ ID NO: 506513 - protein, 10 aa, Influenza virus
NEVGARIITS

SEQ ID NO: 506514 - protein, 10 aa, Influenza virus
NEVGARILTS

SEQ ID NO: 506515 - protein, 10 aa, Influenza virus
NEVKLEENTT

SEQ ID NO: 506516 - protein, 10 aa, Influenza virus
NEWSGYSGSF

SEQ ID NO: 506517 - protein, 10 aa, Influenza virus
NFDSNGNFIA

SEQ ID NO: 506518 - protein, 10 aa, Influenza virus
NFEGWIVGNP

SEQ ID NO: 506519 - protein, 10 aa, Influenza virus
NFEKEGYSLV

SEQ ID NO: 506520 - protein, 10 aa, Influenza virus
NFESNGNFIA

SEQ ID NO: 506521 - protein, 10 aa, Influenza virus
NFESNGNFIT

SEQ ID NO: 506522 - protein, 10 aa, Influenza virus
NFESNGNLIA

SEQ ID NO: 506523 - protein, 10 aa, Influenza virus
NFESTGNLIA

SEQ ID NO: 506524 - protein, 10 aa, Influenza virus
NFESTGNLVA

SEQ ID NO: 506525 - protein, 10 aa, Influenza virus
NFFHKCNDSC

SEQ ID NO: 506526 - protein, 10 aa, Influenza virus
NFHYEECSCY

SEQ ID NO: 506527 - protein, 10 aa, Influenza virus
NFIAPENAYK

SEQ ID NO: 506528 - protein, 10 aa, Influenza virus
NFIAPEYAFK

SEQ ID NO: 506529 - protein, 10 aa, Influenza virus
NFIAPEYAYI

SEQ ID NO: 506530 - protein, 10 aa, Influenza virus
NFIAPEYAYK

SEQ ID NO: 506531 - protein, 10 aa, Influenza virus
NFIAPEYAYR

SEQ ID NO: 506532 - protein, 10 aa, Influenza virus
NFITPEYAYK

SEQ ID NO: 506533 - protein, 10 aa, Influenza virus
NFKPNIGPRP

SEQ ID NO: 506534 - protein, 10 aa, Influenza virus
NFLSMEFSLT

SEQ ID NO: 506535 - protein, 10 aa, Influenza virus
NFPQTANTYR

SEQ ID NO: 506536 - protein, 10 aa, Influenza virus
NFPQTTNTYR

SEQ ID NO: 506537 - protein, 10 aa, Influenza virus
NFPRTTNTYR

SEQ ID NO: 506538 - protein, 10 aa, Influenza virus
NFQPNIGPRP

SEQ ID NO: 506539 - protein, 10 aa, Influenza virus
NFSFNGAFIA

SEQ ID NO: 506540 - protein, 10 aa, Influenza virus
NFSMELPSFG

SEQ ID NO: 506541 - protein, 10 aa, Influenza virus
NFVIEKMNTQ

SEQ ID NO: 506542 - protein, 10 aa, Influenza virus
NFVNRANQRL

SEQ ID NO: 506543 - protein, 10 aa, Influenza virus
NFVPVIGARP

SEQ ID NO: 506544 - protein, 10 aa, Influenza virus
NFVPVMGARP

SEQ ID NO: 506545 - protein, 10 aa, Influenza virus
NFVPVVGARP

SEQ ID NO: 506546 - protein, 10 aa, Influenza virus
NFVPVVRARP

SEQ ID NO: 506547 - protein, 10 aa, Influenza virus
NFVRQCFNPM

SEQ ID NO: 506548 - protein, 10 aa, Influenza virus
NFVSMEFSLT

SEQ ID NO: 506549 - protein, 10 aa, Influenza virus
NFWRGDNGRR

SEQ ID NO: 506550 - protein, 10 aa, Influenza virus
NFWRGENGRK

SEQ ID NO: 506551 - protein, 10 aa, Influenza virus
NFWRGENGRR

SEQ ID NO: 506552 - protein, 10 aa, Influenza virus
NFYYEECSCY

SEQ ID NO: 506553 - protein, 10 aa, Influenza virus
NGAFIAPDRA

SEQ ID NO: 506554 - protein, 10 aa, Influenza virus
NGAFIAPDRV

SEQ ID NO: 506555 - protein, 10 aa, Influenza virus
NGAFIAPNRA

SEQ ID NO: 506556 - protein, 10 aa, Influenza virus
NGAFVAPDRV

SEQ ID NO: 506557 - protein, 10 aa, Influenza virus
NGAKVNTLTE

SEQ ID NO: 506558 - protein, 10 aa, Influenza virus
NGALGSPGCD

SEQ ID NO: 506559 - protein, 10 aa, Influenza virus
NGAVAVLKYK

SEQ ID NO: 506560 - protein, 10 aa, Influenza virus
NGAVAVLKYN

SEQ ID NO: 506561 - protein, 10 aa, Influenza virus
NGAWIGRTKS

SEQ ID NO: 506562 - protein, 10 aa, Influenza virus
NGCFDILHKC

SEQ ID NO: 506563 - protein, 10 aa, Influenza virus
NGCFEFWHKC

SEQ ID NO: 506564 - protein, 10 aa, Influenza virus
NGCFEFYHKC

SEQ ID NO: 506565 - protein, 10 aa, Influenza virus
NGCFEFYHRC

SEQ ID NO: 506566 - protein, 10 aa, Influenza virus
NGCFEIFHKC

SEQ ID NO: 506567 - protein, 10 aa, Influenza virus
NGCFEIFHQC

SEQ ID NO: 506568 - protein, 10 aa, Influenza virus
NGCFEIFHRC

SEQ ID NO: 506569 - protein, 10 aa, Influenza virus
NGCFELLHKC

SEQ ID NO: 506570 - protein, 10 aa, Influenza virus
NGCFELYHKC

SEQ ID NO: 506571 - protein, 10 aa, Influenza virus
NGCFKIYHKC

SEQ ID NO: 506572 - protein, 10 aa, Influenza virus
NGCFPFYHKC

SEQ ID NO: 506573 - protein, 10 aa, Influenza virus
NGCFTFYHKC

SEQ ID NO: 506574 - protein, 10 aa, Influenza virus
NGCFTIYHKC

SEQ ID NO: 506575 - protein, 10 aa, Influenza virus
NGCIEGKLSQ

SEQ ID NO: 506576 - protein, 10 aa, Influenza virus
NGCIESKLSQ

SEQ ID NO: 506577 - protein, 10 aa, Influenza virus
NGCLKIYHKC

SEQ ID NO: 506578 - protein, 10 aa, Influenza virus
NGDDVWMGRT

SEQ ID NO: 506579 - protein, 10 aa, Influenza virus
NGDGCFEILH

SEQ ID NO: 506580 - protein, 10 aa, Influenza virus
NGDIIFLWGI

SEQ ID NO: 506581 - protein, 10 aa, Influenza virus
NGDPNNMDKA

SEQ ID NO: 506582 - protein, 10 aa, Influenza virus
NGDPNNMDRA

SEQ ID NO: 506583 - protein, 10 aa, Influenza virus
NGDPSNMDRA

SEQ ID NO: 506584 - protein, 10 aa, Influenza virus
NGDYARLYIW

SEQ ID NO: 506585 - protein, 10 aa, Influenza virus
NGDYTRLYIW

SEQ ID NO: 506586 - protein, 10 aa, Influenza virus
NGEALRQILR

SEQ ID NO: 506587 - protein, 10 aa, Influenza virus
NGELRHLFSG

SEQ ID NO: 506588 - protein, 10 aa, Influenza virus
NGEPGVKGFG

SEQ ID NO: 506589 - protein, 10 aa, Influenza virus
NGEQILIIWG

SEQ ID NO: 506590 - protein, 10 aa, Influenza virus
NGFCFTVMTD

SEQ ID NO: 506591 - protein, 10 aa, Influenza virus
NGFEMLKIPN

SEQ ID NO: 506592 - protein, 10 aa, Influenza virus
NGFLDVWTYN

SEQ ID NO: 506593 - protein, 10 aa, Influenza virus
NGGFLAPRYG

SEQ ID NO: 506594 - protein, 10 aa, Influenza virus
NGGHIEECSC

SEQ ID NO: 506595 - protein, 10 aa, Influenza virus
NGGLGVKGFG

SEQ ID NO: 506596 - protein, 10 aa, Influenza virus
NGGLIAPDRV

SEQ ID NO: 506597 - protein, 10 aa, Influenza virus
NGGLIAPNRV

SEQ ID NO: 506598 - protein, 10 aa, Influenza virus
NGGLIAPRYG

SEQ ID NO: 506599 - protein, 10 aa, Influenza virus
NGGLIAPSRV

SEQ ID NO: 506600 - protein, 10 aa, Influenza virus
NGGLLAPKYG

SEQ ID NO: 506601 - protein, 10 aa, Influenza virus
NGGLLAPRYG

SEQ ID NO: 506602 - protein, 10 aa, Influenza virus
NGGLVAPSRV

SEQ ID NO: 506603 - protein, 10 aa, Influenza virus
NGGPGVKGFG

SEQ ID NO: 506604 - protein, 10 aa, Influenza virus
NGGRIAPSRV

SEQ ID NO: 506605 - protein, 10 aa, Influenza virus
NGICPVAFTD

SEQ ID NO: 506606 - protein, 10 aa, Influenza virus
NGICPVVFTD

SEQ ID NO: 506607 - protein, 10 aa, Influenza virus
NGICTVVMTD

SEQ ID NO: 506608 - protein, 10 aa, Influenza virus
NGICYPGILE

SEQ ID NO: 506609 - protein, 10 aa, Influenza virus
NGICYPGSLD

SEQ ID NO: 506610 - protein, 10 aa, Influenza virus
NGICYPGTLE

SEQ ID NO: 506611 - protein, 10 aa, Influenza virus
NGICYPGTLG

SEQ ID NO: 506612 - protein, 10 aa, Influenza virus
NGIITDTFKS

SEQ ID NO: 506613 - protein, 10 aa, Influenza virus
NGIITDTLKS

SEQ ID NO: 506614 - protein, 10 aa, Influenza virus
NGIKVDTLTE

SEQ ID NO: 506615 - protein, 10 aa, Influenza virus
NGIPPLELGD

SEQ ID NO: 506616 - protein, 10 aa, Influenza virus
NGIRIGSKGD

SEQ ID NO: 506617 - protein, 10 aa, Influenza virus
NGIRIGSKGH

SEQ ID NO: 506618 - protein, 10 aa, Influenza virus
NGIRIGSRGE

SEQ ID NO: 506619 - protein, 10 aa, Influenza virus
NGIRIGSRGH

SEQ ID NO: 506620 - protein, 10 aa, Influenza virus
NGIRVGSRGH

SEQ ID NO: 506621 - protein, 10 aa, Influenza virus
NGISPIHLGD

SEQ ID NO: 506622 - protein, 10 aa, Influenza virus
NGISPVHLGD

SEQ ID NO: 506623 - protein, 10 aa, Influenza virus
NGKAPISLGD

SEQ ID NO: 506624 - protein, 10 aa, Influenza virus
NGKEPISLGD

SEQ ID NO: 506625 - protein, 10 aa, Influenza virus
NGKFEFIAED

SEQ ID NO: 506626 - protein, 10 aa, Influenza virus
NGKFEFIAEE

SEQ ID NO: 506627 - protein, 10 aa, Influenza virus
NGKFEFIVEK

SEQ ID NO: 506628 - protein, 10 aa, Influenza virus
NGKGRYGVKG

SEQ ID NO: 506629 - protein, 10 aa, Influenza virus
NGKLCKLNGI

SEQ ID NO: 506630 - protein, 10 aa, Influenza virus
NGKLCRLRGI

SEQ ID NO: 506631 - protein, 10 aa, Influenza virus
NGKLCRLSGI

SEQ ID NO: 506632 - protein, 10 aa, Influenza virus
NGKLEFIAEE

SEQ ID NO: 506633 - protein, 10 aa, Influenza virus
NGKLNRLIEK

SEQ ID NO: 506634 - protein, 10 aa, Influenza virus
NGKLNRLIER

SEQ ID NO: 506635 - protein, 10 aa, Influenza virus
NGKPFQNVNR

SEQ ID NO: 506636 - protein, 10 aa, Influenza virus
NGKQPISLGD

SEQ ID NO: 506637 - protein, 10 aa, Influenza virus
NGKSGACKRA

SEQ ID NO: 506638 - protein, 10 aa, Influenza virus
NGKSLGIQSD

SEQ ID NO: 506639 - protein, 10 aa, Influenza virus
NGKSSACKRA

SEQ ID NO: 506640 - protein, 10 aa, Influenza virus
NGKVECICRD

SEQ ID NO: 506641 - protein, 10 aa, Influenza virus
NGKWREQLSQ

SEQ ID NO: 506642 - protein, 10 aa, Influenza virus
NGKYPVIKGD

SEQ ID NO: 506643 - protein, 10 aa, Influenza virus
NGNCRFNVCI

SEQ ID NO: 506644 - protein, 10 aa, Influenza virus
NGNDVWMGRT

SEQ ID NO: 506645 - protein, 10 aa, Influenza virus
NGNFIAPENA

SEQ ID NO: 506646 - protein, 10 aa, Influenza virus
NGNFIAPEYA

SEQ ID NO: 506647 - protein, 10 aa, Influenza virus
NGNFITPEYA

SEQ ID NO: 506648 - protein, 10 aa, Influenza virus
NGNGCFELYH

SEQ ID NO: 506649 - protein, 10 aa, Influenza virus
NGNGDPNNMD

SEQ ID NO: 506650 - protein, 10 aa, Influenza virus
NGNGDPSNMD

SEQ ID NO: 506651 - protein, 10 aa, Influenza virus
NGNHAVHYCI

SEQ ID NO: 506652 - protein, 10 aa, Influenza virus
NGNIRCQICI

SEQ ID NO: 506653 - protein, 10 aa, Influenza virus
NGNIRCTFCI

SEQ ID NO: 506654 - protein, 10 aa, Influenza virus
NGNLIAPEFG

SEQ ID NO: 506655 - protein, 10 aa, Influenza virus
NGNLIAPEYG

SEQ ID NO: 506656 - protein, 10 aa, Influenza virus
NGNLIAPRGY

SEQ ID NO: 506657 - protein, 10 aa, Influenza virus
NGNLIAPWYA

SEQ ID NO: 506658 - protein, 10 aa, Influenza virus
NGNLRCQICI

SEQ ID NO: 506659 - protein, 10 aa, Influenza virus
NGNLRCTICI

SEQ ID NO: 506660 - protein, 10 aa, Influenza virus
NGNLVAPRGY

SEQ ID NO: 506661 - protein, 10 aa, Influenza virus
NGNLVAPWYA

SEQ ID NO: 506662 - protein, 10 aa, Influenza virus
NGNMQCTICI

SEQ ID NO: 506663 - protein, 10 aa, Influenza virus
NGNMRCTICI

SEQ ID NO: 506664 - protein, 10 aa, Influenza virus
NGNMRGTNWI

SEQ ID NO: 506665 - protein, 10 aa, Influenza virus
NGNVRCQICI

SEQ ID NO: 506666 - protein, 10 aa, Influenza virus
NGNVRCTFCI

SEQ ID NO: 506667 - protein, 10 aa, Influenza virus
NGNYARLYIW

SEQ ID NO: 506668 - protein, 10 aa, Influenza virus
NGNYDSIRGE

SEQ ID NO: 506669 - protein, 10 aa, Influenza virus
NGNYGPINVT

SEQ ID NO: 506670 - protein, 10 aa, Influenza virus
NGPDSVLVNT

SEQ ID NO: 506671 - protein, 10 aa, Influenza virus
NGPESVLINT

SEQ ID NO: 506672 - protein, 10 aa, Influenza virus
NGPESVLVNT

SEQ ID NO: 506673 - protein, 10 aa, Influenza virus
NGQAGRIDFH

SEQ ID NO: 506674 - protein, 10 aa, Influenza virus
NGQAGRMTFY

SEQ ID NO: 506675 - protein, 10 aa, Influenza virus
NGQFGRIDFH

SEQ ID NO: 506676 - protein, 10 aa, Influenza virus
NGQFGRINFH

SEQ ID NO: 506677 - protein, 10 aa, Influenza virus
NGQGSGYAAD

SEQ ID NO: 506678 - protein, 10 aa, Influenza virus
NGQKSWMKIY

SEQ ID NO: 506679 - protein, 10 aa, Influenza virus
NGQKSWTKIY

SEQ ID NO: 506680 - protein, 10 aa, Influenza virus
NGQRGRIDFH

SEQ ID NO: 506681 - protein, 10 aa, Influenza virus
NGQRSWMKIY

SEQ ID NO: 506682 - protein, 10 aa, Influenza virus
NGQSGRIDFH

SEQ ID NO: 506683 - protein, 10 aa, Influenza virus
NGQSGRIDFY

SEQ ID NO: 506684 - protein, 10 aa, Influenza virus
NGQSGRIEFH

SEQ ID NO: 506685 - protein, 10 aa, Influenza virus
NGQSGRINFH

SEQ ID NO: 506686 - protein, 10 aa, Influenza virus
NGQSGRIVFH

SEQ ID NO: 506687 - protein, 10 aa, Influenza virus
NGQTGRIDFH

SEQ ID NO: 506688 - protein, 10 aa, Influenza virus
NGREWSYIVE

SEQ ID NO: 506689 - protein, 10 aa, Influenza virus
NGRFEFIAEE

SEQ ID NO: 506690 - protein, 10 aa, Influenza virus
NGRLTTTIKT

SEQ ID NO: 506691 - protein, 10 aa, Influenza virus
NGRSSFFRNV

SEQ ID NO: 506692 - protein, 10 aa, Influenza virus
NGRTLDLHDA

SEQ ID NO: 506693 - protein, 10 aa, Influenza virus
NGRTLDMHDA

SEQ ID NO: 506694 - protein, 10 aa, Influenza virus
NGRTLGLHDA

SEQ ID NO: 506695 - protein, 10 aa, Influenza virus
NGSCAVVMTD

SEQ ID NO: 506696 - protein, 10 aa, Influenza virus
NGSCFTIMTD

SEQ ID NO: 506697 - protein, 10 aa, Influenza virus
NGSCFTLMTD

SEQ ID NO: 506698 - protein, 10 aa, Influenza virus
NGSCFTVLTD

SEQ ID NO: 506699 - protein, 10 aa, Influenza virus
NGSCFTVMTD

SEQ ID NO: 506700 - protein, 10 aa, Influenza virus
NGSCRCMFCI

SEQ ID NO: 506701 - protein, 10 aa, Influenza virus
NGSCRCTICI

SEQ ID NO: 506702 - protein, 10 aa, Influenza virus
NGSCRFNVCI

SEQ ID NO: 506703 - protein, 10 aa, Influenza virus
NGSCTVVMTD

SEQ ID NO: 506704 - protein, 10 aa, Influenza virus
NGSIPNDKPF

SEQ ID NO: 506705 - protein, 10 aa, Influenza virus
NGSIPNEKPF

SEQ ID NO: 506706 - protein, 10 aa, Influenza virus
NGSIPNGKPF

SEQ ID NO: 506707 - protein, 10 aa, Influenza virus
NGSIPNNKPF

SEQ ID NO: 506708 - protein, 10 aa, Influenza virus
NGSISNDKPF

SEQ ID NO: 506709 - protein, 10 aa, Influenza virus
NGSLQCKICI

SEQ ID NO: 506710 - protein, 10 aa, Influenza virus
NGSLQCRICI

SEQ ID NO: 506711 - protein, 10 aa, Influenza virus
NGSLQCRVCI

SEQ ID NO: 506712 - protein, 10 aa, Influenza virus
NGSLQCTICI

SEQ ID NO: 506713 - protein, 10 aa, Influenza virus
NGSLRCRICI

SEQ ID NO: 506714 - protein, 10 aa, Influenza virus
NGSMQCKICI

SEQ ID NO: 506715 - protein, 10 aa, Influenza virus
NGSMQCNVCI

SEQ ID NO: 506716 - protein, 10 aa, Influenza virus
NGSMQCRICI

SEQ ID NO: 506717 - protein, 10 aa, Influenza virus
NGSMQCRVCI

SEQ ID NO: 506718 - protein, 10 aa, Influenza virus
NGSYRCMFCI

SEQ ID NO: 506719 - protein, 10 aa, Influenza virus
NGTAKHIEEC

SEQ ID NO: 506720 - protein, 10 aa, Influenza virus
NGTCAVVMTD

SEQ ID NO: 506721 - protein, 10 aa, Influenza virus
NGTCTVIMTD

SEQ ID NO: 506722 - protein, 10 aa, Influenza virus
NGTCTVVMTD

SEQ ID NO: 506723 - protein, 10 aa, Influenza virus
NGTCVVIMTD

SEQ ID NO: 506724 - protein, 10 aa, Influenza virus
NGTCVVVMTD

SEQ ID NO: 506725 - protein, 10 aa, Influenza virus
NGTIHDRAAF

SEQ ID NO: 506726 - protein, 10 aa, Influenza virus
NGTIHDRSPF

SEQ ID NO: 506727 - protein, 10 aa, Influenza virus
NGTIHDRSPY

SEQ ID NO: 506728 - protein, 10 aa, Influenza virus
NGTIHDRSQF

SEQ ID NO: 506729 - protein, 10 aa, Influenza virus
NGTIHDRSQY

SEQ ID NO: 506730 - protein, 10 aa, Influenza virus
NGTIHDRTAF

SEQ ID NO: 506731 - protein, 10 aa, Influenza virus
NGTIHDRTTF

SEQ ID NO: 506732 - protein, 10 aa, Influenza virus
NGTIIKTLTN

SEQ ID NO: 506733 - protein, 10 aa, Influenza virus
NGTIKDRSPY

SEQ ID NO: 506734 - protein, 10 aa, Influenza virus
NGTINDRSPF

SEQ ID NO: 506735 - protein, 10 aa, Influenza virus
NGTIVKTLTD

SEQ ID NO: 506736 - protein, 10 aa, Influenza virus
NGTIVKTLTN

SEQ ID NO: 506737 - protein, 10 aa, Influenza virus
NGTIVKTLTS

SEQ ID NO: 506738 - protein, 10 aa, Influenza virus
NGTKINTLTE

SEQ ID NO: 506739 - protein, 10 aa, Influenza virus
NGTKVDTLTE

SEQ ID NO: 506740 - protein, 10 aa, Influenza virus
NGTKVDTLTG

SEQ ID NO: 506741 - protein, 10 aa, Influenza virus
NGTKVNTLTE

SEQ ID NO: 506742 - protein, 10 aa, Influenza virus
NGTMHDRSPF

SEQ ID NO: 506743 - protein, 10 aa, Influenza virus
NGTMKDRSPY

SEQ ID NO: 506744 - protein, 10 aa, Influenza virus
NGTMVKTLAD

SEQ ID NO: 506745 - protein, 10 aa, Influenza virus
NGTMVKTLTD

SEQ ID NO: 506746 - protein, 10 aa, Influenza virus
NGTMVKTLTG

SEQ ID NO: 506747 - protein, 10 aa, Influenza virus
NGTRVNTLTE

SEQ ID NO: 506748 - protein, 10 aa, Influenza virus
NGTSKIKMKW

SEQ ID NO: 506749 - protein, 10 aa, Influenza virus
NGTSKVKMKW

SEQ ID NO: 506750 - protein, 10 aa, Influenza virus
NGTSVKTLTD

SEQ ID NO: 506751 - protein, 10 aa, Influenza virus
NGTTGNPIIC

SEQ ID NO: 506752 - protein, 10 aa, Influenza virus
NGTTHDRTAF

SEQ ID NO: 506753 - protein, 10 aa, Influenza virus
NGTVKDRSPF

SEQ ID NO: 506754 - protein, 10 aa, Influenza virus
NGTVKDRSPY

SEQ ID NO: 506755 - protein, 10 aa, Influenza virus
NGTVVKTLTD

SEQ ID NO: 506756 - protein, 10 aa, Influenza virus
NGTWAVVMTD

SEQ ID NO: 506757 - protein, 10 aa, Influenza virus
NGTYDHKDFE

SEQ ID NO: 506758 - protein, 10 aa, Influenza virus
NGTYDHKDYE

SEQ ID NO: 506759 - protein, 10 aa, Influenza virus
NGTYDHKEFE

SEQ ID NO: 506760 - protein, 10 aa, Influenza virus
NGTYDHKEYE

SEQ ID NO: 506761 - protein, 10 aa, Influenza virus
NGTYDHNIYR

SEQ ID NO: 506762 - protein, 10 aa, Influenza virus
NGTYDYIKYE

SEQ ID NO: 506763 - protein, 10 aa, Influenza virus
NGTYDYPKYE

SEQ ID NO: 506764 - protein, 10 aa, Influenza virus
NGTYDYPKYQ

SEQ ID NO: 506765 - protein, 10 aa, Influenza virus
NGTYDYPKYS

SEQ ID NO: 506766 - protein, 10 aa, Influenza virus
NGTYDYSKYE

SEQ ID NO: 506767 - protein, 10 aa, Influenza virus
NGTYKYPKYQ

SEQ ID NO: 506768 - protein, 10 aa, Influenza virus
NGTYNHEDYK

SEQ ID NO: 506769 - protein, 10 aa, Influenza virus
NGTYNHEDYR

SEQ ID NO: 506770 - protein, 10 aa, Influenza virus
NGTYNHKDYE

SEQ ID NO: 506771 - protein, 10 aa, Influenza virus
NGTYNHKEYE

SEQ ID NO: 506772 - protein, 10 aa, Influenza virus
NGTYNRKEYE

SEQ ID NO: 506773 - protein, 10 aa, Influenza virus
NGTYNYPKYE

SEQ ID NO: 506774 - protein, 10 aa, Influenza virus
NGTYNYPKYH

SEQ ID NO: 506775 - protein, 10 aa, Influenza virus
NGTYNYPKYQ

SEQ ID NO: 506776 - protein, 10 aa, Influenza virus
NGTYNYPKYS

SEQ ID NO: 506777 - protein, 10 aa, Influenza virus
NGTYYYPKYE

SEQ ID NO: 506778 - protein, 10 aa, Influenza virus
NGVCPVVFTD

SEQ ID NO: 506779 - protein, 10 aa, Influenza virus
NGVILEENTT

SEQ ID NO: 506780 - protein, 10 aa, Influenza virus
NGVITDTLKS

SEQ ID NO: 506781 - protein, 10 aa, Influenza virus
NGVKGFAYLD

SEQ ID NO: 506782 - protein, 10 aa, Influenza virus
NGVKGFSYLD

SEQ ID NO: 506783 - protein, 10 aa, Influenza virus
NGVKGFSYLN

SEQ ID NO: 506784 - protein, 10 aa, Influenza virus
NGVKLEENST

SEQ ID NO: 506785 - protein, 10 aa, Influenza virus
NGVKLEENTS

SEQ ID NO: 506786 - protein, 10 aa, Influenza virus
NGVKLEENTT

SEQ ID NO: 506787 - protein, 10 aa, Influenza virus
NGVKVDGSSS

SEQ ID NO: 506788 - protein, 10 aa, Influenza virus
NGVPVTSSID

SEQ ID NO: 506789 - protein, 10 aa, Influenza virus
NGVPVTSSVD

SEQ ID NO: 506790 - protein, 10 aa, Influenza virus
NGVQDIIDND

SEQ ID NO: 506791 - protein, 10 aa, Influenza virus
NGVQDIIDNN

SEQ ID NO: 506792 - protein, 10 aa, Influenza virus
NGVRIGSKGD

SEQ ID NO: 506793 - protein, 10 aa, Influenza virus
NGVRLEENTT

SEQ ID NO: 506794 - protein, 10 aa, Influenza virus
NGVSPIHLGD

SEQ ID NO: 506795 - protein, 10 aa, Influenza virus
NGVSPVHLGD

SEQ ID NO: 506796 - protein, 10 aa, Influenza virus
NGVTNKVNSI

SEQ ID NO: 506797 - protein, 10 aa, Influenza virus
NGVWIGRTKN

SEQ ID NO: 506798 - protein, 10 aa, Influenza virus
NGVWIGRTKS

SEQ ID NO: 506799 - protein, 10 aa, Influenza virus
NGVWMGRTKS

SEQ ID NO: 506800 - protein, 10 aa, Influenza virus
NGWEGLIDGW

SEQ ID NO: 506801 - protein, 10 aa, Influenza virus
NGWEGLINGW

SEQ ID NO: 506802 - protein, 10 aa, Influenza virus
NGWEGLVDGW

SEQ ID NO: 506803 - protein, 10 aa, Influenza virus
NGWEGMIDGW

SEQ ID NO: 506804 - protein, 10 aa, Influenza virus
NGWEGMMDGW

SEQ ID NO: 506805 - protein, 10 aa, Influenza virus
NGWEGMVDGW

SEQ ID NO: 506806 - protein, 10 aa, Influenza virus
NGWEGMVNGW

SEQ ID NO: 506807 - protein, 10 aa, Influenza virus
NGWQGLIDGW

SEQ ID NO: 506808 - protein, 10 aa, Influenza virus
NGWVSTDKDS

SEQ ID NO: 506809 - protein, 10 aa, Influenza virus
NGWVSTDKNS

SEQ ID NO: 506810 - protein, 10 aa, Influenza virus
NGWVTADKDS

SEQ ID NO: 506811 - protein, 10 aa, Influenza virus
NGWYGFQHQN

SEQ ID NO: 506812 - protein, 10 aa, Influenza virus
NGWYGFQHRN

SEQ ID NO: 506813 - protein, 10 aa, Influenza virus
NGWYGFRHQN

SEQ ID NO: 506814 - protein, 10 aa, Influenza virus
NGYIEGKLSQ

SEQ ID NO: 506815 - protein, 10 aa, Influenza virus
NGYKDVILWF

SEQ ID NO: 506816 - protein, 10 aa, Influenza virus
NHEDYKEESQ

SEQ ID NO: 506817 - protein, 10 aa, Influenza virus
NHEDYREESQ

SEQ ID NO: 506818 - protein, 10 aa, Influenza virus
NHEGEGIPLY

SEQ ID NO: 506819 - protein, 10 aa, Influenza virus
NHGICAVATT

SEQ ID NO: 506820 - protein, 10 aa, Influenza virus
NHGSLVLSLW

SEQ ID NO: 506821 - protein, 10 aa, Influenza virus
NHGVKGWAFD

SEQ ID NO: 506822 - protein, 10 aa, Influenza virus
NHKDYEEEAK

SEQ ID NO: 506823 - protein, 10 aa, Influenza virus
NHKEYEEEAK

SEQ ID NO: 506824 - protein, 10 aa, Influenza virus
NHLIGKTNQQ

SEQ ID NO: 506825 - protein, 10 aa, Influenza virus
NHQFELIDNE

SEQ ID NO: 506826 - protein, 10 aa, Influenza virus
NHSMSDIEAM

SEQ ID NO: 506827 - protein, 10 aa, Influenza virus
NHSNGTIHDR

SEQ ID NO: 506828 - protein, 10 aa, Influenza virus
NHTDELCPSP

SEQ ID NO: 506829 - protein, 10 aa, Influenza virus
NHTEYRQEAL

SEQ ID NO: 506830 - protein, 10 aa, Influenza virus
NHTGTYCSLN

SEQ ID NO: 506831 - protein, 10 aa, Influenza virus
NHTTINNITN

SEQ ID NO: 506832 - protein, 10 aa, Influenza virus
NHVEVVSAKE

SEQ ID NO: 506833 - protein, 10 aa, Influenza virus
NICEKLEQSG

SEQ ID NO: 506834 - protein, 10 aa, Influenza virus
NICKPYIGKC

SEQ ID NO: 506835 - protein, 10 aa, Influenza virus
NIDKNALGDC

SEQ ID NO: 506836 - protein, 10 aa, Influenza virus
NIDKNALGEC

SEQ ID NO: 506837 - protein, 10 aa, Influenza virus
NIDRFLRVRD

SEQ ID NO: 506838 - protein, 10 aa, Influenza virus
NIDRNAIGDC

SEQ ID NO: 506839 - protein, 10 aa, Influenza virus
NIDRNALGDC

SEQ ID NO: 506840 - protein, 10 aa, Influenza virus
NIDSRAVGKC

SEQ ID NO: 506841 - protein, 10 aa, Influenza virus
NIDSWAVGRC

SEQ ID NO: 506842 - protein, 10 aa, Influenza virus
NIECVCRDNW

SEQ ID NO: 506843 - protein, 10 aa, Influenza virus
NIEKNALGDC

SEQ ID NO: 506844 - protein, 10 aa, Influenza virus
NIERNALGDC

SEQ ID NO: 506845 - protein, 10 aa, Influenza virus
NIERNALGNC

SEQ ID NO: 506846 - protein, 10 aa, Influenza virus
NIESNGNLIA

SEQ ID NO: 506847 - protein, 10 aa, Influenza virus
NIFNMERIKE

SEQ ID NO: 506848 - protein, 10 aa, Influenza virus
NIGLNVSLHL

SEQ ID NO: 506849 - protein, 10 aa, Influenza virus
NIGPRALVRG

SEQ ID NO: 506850 - protein, 10 aa, Influenza virus
NIGPRPFVRG

SEQ ID NO: 506851 - protein, 10 aa, Influenza virus
NIGPRPLIRG

SEQ ID NO: 506852 - protein, 10 aa, Influenza virus
NIGPRPLVMG

SEQ ID NO: 506853 - protein, 10 aa, Influenza virus
NIGPRPLVRE

SEQ ID NO: 506854 - protein, 10 aa, Influenza virus
NIGPRPLVRG

SEQ ID NO: 506855 - protein, 10 aa, Influenza virus
NIGSRPRVRN

SEQ ID NO: 506856 - protein, 10 aa, Influenza virus
NIHPLAIGEC

SEQ ID NO: 506857 - protein, 10 aa, Influenza virus
NIHPLTIGEC

SEQ ID NO: 506858 - protein, 10 aa, Influenza virus
NIHPLTIGKC

SEQ ID NO: 506859 - protein, 10 aa, Influenza virus
NIIDKMNGNY

SEQ ID NO: 506860 - protein, 10 aa, Influenza virus
NIIEKMNGNY

SEQ ID NO: 506861 - protein, 10 aa, Influenza virus
NIIFLWGIHH

SEQ ID NO: 506862 - protein, 10 aa, Influenza virus
NIIFSHNGGL

SEQ ID NO: 506863 - protein, 10 aa, Influenza virus
NIKSLKLATG

SEQ ID NO: 506864 - protein, 10 aa, Influenza virus
NILEKTHNGK

SEQ ID NO: 506865 - protein, 10 aa, Influenza virus
NILEKTHNGR

SEQ ID NO: 506866 - protein, 10 aa, Influenza virus
NILITQESEC

SEQ ID NO: 506867 - protein, 10 aa, Influenza virus
NILKGKFQTA

SEQ ID NO: 506868 - protein, 10 aa, Influenza virus
NILLSPEEVS

SEQ ID NO: 506869 - protein, 10 aa, Influenza virus
NILRSQESEC

SEQ ID NO: 506870 - protein, 10 aa, Influenza virus
NILRTQDSEC

SEQ ID NO: 506871 - protein, 10 aa, Influenza virus
NILRTQESEC

SEQ ID NO: 506872 - protein, 10 aa, Influenza virus
NILRTQESSC

SEQ ID NO: 506873 - protein, 10 aa, Influenza virus
NILSIAPIMF

SEQ ID NO: 506874 - protein, 10 aa, Influenza virus
NILSMAPIMF

SEQ ID NO: 506875 - protein, 10 aa, Influenza virus
NIMASQGTKR

SEQ ID NO: 506876 - protein, 10 aa, Influenza virus
NIMRTQESEC

SEQ ID NO: 506877 - protein, 10 aa, Influenza virus
NINFMPYISF

SEQ ID NO: 506878 - protein, 10 aa, Influenza virus
NINIREWSYL

SEQ ID NO: 506879 - protein, 10 aa, Influenza virus
NINPVKLSSG

SEQ ID NO: 506880 - protein, 10 aa, Influenza virus
NINPVTLSSG

SEQ ID NO: 506881 - protein, 10 aa, Influenza virus
NINRITYGAC

SEQ ID NO: 506882 - protein, 10 aa, Influenza virus
NINSVKLSSG

SEQ ID NO: 506883 - protein, 10 aa, Influenza virus
NIPGKQAKGL

SEQ ID NO: 506884 - protein, 10 aa, Influenza virus
NIPQIESRGL

SEQ ID NO: 506885 - protein, 10 aa, Influenza virus
NIPSIQSRGL

SEQ ID NO: 506886 - protein, 10 aa, Influenza virus
NIPSVQSRGL

SEQ ID NO: 506887 - protein, 10 aa, Influenza virus
NIPVTQTMEL

SEQ ID NO: 506888 - protein, 10 aa, Influenza virus
NIPVTQVEEL

SEQ ID NO: 506889 - protein, 10 aa, Influenza virus
NIQFTAVGKE

SEQ ID NO: 506890 - protein, 10 aa, Influenza virus
NIQFTSVGKE

SEQ ID NO: 506891 - protein, 10 aa, Influenza virus
NIREWSYLIE

SEQ ID NO: 506892 - protein, 10 aa, Influenza virus
NIRIGSKGDV

SEQ ID NO: 506893 - protein, 10 aa, Influenza virus
NIRNLHIPEA

SEQ ID NO: 506894 - protein, 10 aa, Influenza virus
NIRNLHIPEV

SEQ ID NO: 506895 - protein, 10 aa, Influenza virus
NIRNNTYDHS

SEQ ID NO: 506896 - protein, 10 aa, Influenza virus
NITAASLNDD

SEQ ID NO: 506897 - protein, 10 aa, Influenza virus
NITEIVYLNH

SEQ ID NO: 506898 - protein, 10 aa, Influenza virus
NITEIVYLNN

SEQ ID NO: 506899 - protein, 10 aa, Influenza virus
NITEIVYLNS

SEQ ID NO: 506900 - protein, 10 aa, Influenza virus
NITFLHNGGL

SEQ ID NO: 506901 - protein, 10 aa, Influenza virus
NITFSHNGGL

SEQ ID NO: 506902 - protein, 10 aa, Influenza virus
NITFSHNGGR

SEQ ID NO: 506903 - protein, 10 aa, Influenza virus
NITKIVYLNS

SEQ ID NO: 506904 - protein, 10 aa, Influenza virus
NITNVQNNYT

SEQ ID NO: 506905 - protein, 10 aa, Influenza virus
NITVTHAKDI

SEQ ID NO: 506906 - protein, 10 aa, Influenza virus
NITVTHAQDI

SEQ ID NO: 506907 - protein, 10 aa, Influenza virus
NITVTHSVEL

SEQ ID NO: 506908 - protein, 10 aa, Influenza virus
NITVTHSVNL

SEQ ID NO: 506909 - protein, 10 aa, Influenza virus
NITVTSSVEL

SEQ ID NO: 506910 - protein, 10 aa, Influenza virus
NIVDKMNREF

SEQ ID NO: 506911 - protein, 10 aa, Influenza virus
NIVRRAAVSA

SEQ ID NO: 506912 - protein, 10 aa, Influenza virus
NIVRRAIVSA

SEQ ID NO: 506913 - protein, 10 aa, Influenza virus
NIVRRATVSA

SEQ ID NO: 506914 - protein, 10 aa, Influenza virus
NIWAYNAELL

SEQ ID NO: 506915 - protein, 10 aa, Influenza virus
NIWITREPYV

SEQ ID NO: 506916 - protein, 10 aa, Influenza virus
NIWSYNAQLL

SEQ ID NO: 506917 - protein, 10 aa, Influenza virus
NIYKILSIYS

SEQ ID NO: 506918 - protein, 10 aa, Influenza virus
NIYRDEAINN

SEQ ID NO: 506919 - protein, 10 aa, Influenza virus
NKACELTDSI

SEQ ID NO: 506920 - protein, 10 aa, Influenza virus
NKACELTDSS

SEQ ID NO: 506921 - protein, 10 aa, Influenza virus
NKACELTDST

SEQ ID NO: 506922 - protein, 10 aa, Influenza virus
NKACELTDSV

SEQ ID NO: 506923 - protein, 10 aa, Influenza virus
NKACELTGSS

SEQ ID NO: 506924 - protein, 10 aa, Influenza virus
NKADHRIYWI

SEQ ID NO: 506925 - protein, 10 aa, Influenza virus
NKCIERVRNG

SEQ ID NO: 506926 - protein, 10 aa, Influenza virus
NKCIESIRNG

SEQ ID NO: 506927 - protein, 10 aa, Influenza virus
NKCMETIKNG

SEQ ID NO: 506928 - protein, 10 aa, Influenza virus
NKCYQFALGQ

SEQ ID NO: 506929 - protein, 10 aa, Influenza virus
NKDGDIIFLW

SEQ ID NO: 506930 - protein, 10 aa, Influenza virus
NKFAAICTHL

SEQ ID NO: 506931 - protein, 10 aa, Influenza virus
NKFAAICTHM

SEQ ID NO: 506932 - protein, 10 aa, Influenza virus
NKFASICTHL

SEQ ID NO: 506933 - protein, 10 aa, Influenza virus
NKHSNDTIHD

SEQ ID NO: 506934 - protein, 10 aa, Influenza virus
NKHSNDTVHD

SEQ ID NO: 506935 - protein, 10 aa, Influenza virus
NKHSNGTIHD

SEQ ID NO: 506936 - protein, 10 aa, Influenza virus
NKHSNGTKHD

SEQ ID NO: 506937 - protein, 10 aa, Influenza virus
NKHSNGTTHD

SEQ ID NO: 506938 - protein, 10 aa, Influenza virus
NKHSNSTTHD

SEQ ID NO: 506939 - protein, 10 aa, Influenza virus
NKHWSGYSGS

SEQ ID NO: 506940 - protein, 10 aa, Influenza virus
NKIEFEPFQS

SEQ ID NO: 506941 - protein, 10 aa, Influenza virus
NKIEGRVQDL

SEQ ID NO: 506942 - protein, 10 aa, Influenza virus
NKINNIVDKM

SEQ ID NO: 506943 - protein, 10 aa, Influenza virus
NKINSIIDKM

SEQ ID NO: 506944 - protein, 10 aa, Influenza virus
NKITNKVNNI

SEQ ID NO: 506945 - protein, 10 aa, Influenza virus
NKKIDDGFLD

SEQ ID NO: 506946 - protein, 10 aa, Influenza virus
NKKMEDGFLD

SEQ ID NO: 506947 - protein, 10 aa, Influenza virus
NKKMEDGFLN

SEQ ID NO: 506948 - protein, 10 aa, Influenza virus
NKKVDDGFID

SEQ ID NO: 506949 - protein, 10 aa, Influenza virus
NKKVDDGFLD

SEQ ID NO: 506950 - protein, 10 aa, Influenza virus
NKKVDDGLLD

SEQ ID NO: 506951 - protein, 10 aa, Influenza virus
NKKYGPALSI

SEQ ID NO: 506952 - protein, 10 aa, Influenza virus
NKLAAICTHL

SEQ ID NO: 506953 - protein, 10 aa, Influenza virus
NKLEFEPFQS

SEQ ID NO: 506954 - protein, 10 aa, Influenza virus
NKLFERVRRQ

SEQ ID NO: 506955 - protein, 10 aa, Influenza virus
NKLITVGSSK

SEQ ID NO: 506956 - protein, 10 aa, Influenza virus
NKLNNVIDKM

SEQ ID NO: 506957 - protein, 10 aa, Influenza virus
NKLYEKVRRQ

SEQ ID NO: 506958 - protein, 10 aa, Influenza virus
NKLYERVKRQ

SEQ ID NO: 506959 - protein, 10 aa, Influenza virus
NKLYERVRKQ

SEQ ID NO: 506960 - protein, 10 aa, Influenza virus
NKLYERVRRQ

SEQ ID NO: 506961 - protein, 10 aa, Influenza virus
NKLYGAGNKL

SEQ ID NO: 506962 - protein, 10 aa, Influenza virus
NKLYGTGNKL

SEQ ID NO: 506963 - protein, 10 aa, Influenza virus
NKLYVNKNPY

SEQ ID NO: 506964 - protein, 10 aa, Influenza virus
NKMARLGKGY

SEQ ID NO: 506965 - protein, 10 aa, Influenza virus
NKMARLGRGY

SEQ ID NO: 506966 - protein, 10 aa, Influenza virus
NKMEFEPFQS

SEQ ID NO: 506967 - protein, 10 aa, Influenza virus
NKNATATVYY

SEQ ID NO: 506968 - protein, 10 aa, Influenza virus
NKNEIKGVKL

SEQ ID NO: 506969 - protein, 10 aa, Influenza virus
NKNPYTLVST

SEQ ID NO: 506970 - protein, 10 aa, Influenza virus
NKNWSGYSGA

SEQ ID NO: 506971 - protein, 10 aa, Influenza virus
NKNWSGYSGS

SEQ ID NO: 506972 - protein, 10 aa, Influenza virus
NKQASYKIFK

SEQ ID NO: 506973 - protein, 10 aa, Influenza virus
NKQFELIDNE

SEQ ID NO: 506974 - protein, 10 aa, Influenza virus
NKRYGPALSI

SEQ ID NO: 506975 - protein, 10 aa, Influenza virus
NKSLCKIEGW

SEQ ID NO: 506976 - protein, 10 aa, Influenza virus
NKSLCKVEEW

SEQ ID NO: 506977 - protein, 10 aa, Influenza virus
NKSLCKVEGW

SEQ ID NO: 506978 - protein, 10 aa, Influenza virus
NKSLCNVEGW

SEQ ID NO: 506979 - protein, 10 aa, Influenza virus
NKSLCSVEGW

SEQ ID NO: 506980 - protein, 10 aa, Influenza virus
NKTFQNIDKN

SEQ ID NO: 506981 - protein, 10 aa, Influenza virus
NKTFQNIDRN

SEQ ID NO: 506982 - protein, 10 aa, Influenza virus
NKTFQNIEKN

SEQ ID NO: 506983 - protein, 10 aa, Influenza virus
NKTFQNIERN

SEQ ID NO: 506984 - protein, 10 aa, Influenza virus
NKTFQNISPV

SEQ ID NO: 506985 - protein, 10 aa, Influenza virus
NKTFQNVSPI

SEQ ID NO: 506986 - protein, 10 aa, Influenza virus
NKTFQNVSPL

SEQ ID NO: 506987 - protein, 10 aa, Influenza virus
NKTFQNVSPV

SEQ ID NO: 506988 - protein, 10 aa, Influenza virus
NKTGTFEFTS

SEQ ID NO: 506989 - protein, 10 aa, Influenza virus
NKTKKMTITF

SEQ ID NO: 506990 - protein, 10 aa, Influenza virus
NKTVINNITT

SEQ ID NO: 506991 - protein, 10 aa, Influenza virus
NKVARLGKGY

SEQ ID NO: 506992 - protein, 10 aa, Influenza virus
NKVCTKGKKA

SEQ ID NO: 506993 - protein, 10 aa, Influenza virus
NKVEFEPFQS

SEQ ID NO: 506994 - protein, 10 aa, Influenza virus
NKVKEIGNGC

SEQ ID NO: 506995 - protein, 10 aa, Influenza virus
NKVNNIVDKM

SEQ ID NO: 506996 - protein, 10 aa, Influenza virus
NKVNSIIDKM

SEQ ID NO: 506997 - protein, 10 aa, Influenza virus
NKVNSIIEKM

SEQ ID NO: 506998 - protein, 10 aa, Influenza virus
NKVNSIINKM

SEQ ID NO: 506999 - protein, 10 aa, Influenza virus
NKVNSVIEKM

SEQ ID NO: 507000 - protein, 10 aa, Influenza virus
NKVNSVVEKM

SEQ ID NO: 507001 - protein, 10 aa, Influenza virus
NKVNTVIEKM

SEQ ID NO: 507002 - protein, 10 aa, Influenza virus
NKVRMQLRDN

SEQ ID NO: 507003 - protein, 10 aa, Influenza virus
NKWGDILDGV

SEQ ID NO: 507004 - protein, 10 aa, Influenza virus
NKWGNVLDGV

SEQ ID NO: 507005 - protein, 10 aa, Influenza virus
NKWSGYSGSF

SEQ ID NO: 507006 - protein, 10 aa, Influenza virus
NKYLEEHPNA

SEQ ID NO: 507007 - protein, 10 aa, Influenza virus
NKYLEEHPSA

SEQ ID NO: 507008 - protein, 10 aa, Influenza virus
NKYLEEHPST

SEQ ID NO: 507009 - protein, 10 aa, Influenza virus
NKYVNNTTII

SEQ ID NO: 507010 - protein, 10 aa, Influenza virus
NLAFNAVIHG

SEQ ID NO: 507011 - protein, 10 aa, Influenza virus
NLCRFLETRT

SEQ ID NO: 507012 - protein, 10 aa, Influenza virus
NLDKKMEDGF

SEQ ID NO: 507013 - protein, 10 aa, Influenza virus
NLDLNMGQPF

SEQ ID NO: 507014 - protein, 10 aa, Influenza virus
NLDYQIGYVC

SEQ ID NO: 507015 - protein, 10 aa, Influenza virus
NLEELRFVFS

SEQ ID NO: 507016 - protein, 10 aa, Influenza virus
NLEKRLENLN

SEQ ID NO: 507017 - protein, 10 aa, Influenza virus
NLEKRLGNLN

SEQ ID NO: 507018 - protein, 10 aa, Influenza virus
NLERRLENLN

SEQ ID NO: 507019 - protein, 10 aa, Influenza virus
NLERRLENLS

SEQ ID NO: 507020 - protein, 10 aa, Influenza virus
NLFDEVKRRL

SEQ ID NO: 507021 - protein, 10 aa, Influenza virus
NLFDEVRRRL

SEQ ID NO: 507022 - protein, 10 aa, Influenza virus
NLFEKFFPSS

SEQ ID NO: 507023 - protein, 10 aa, Influenza virus
NLGIVECVCR

SEQ ID NO: 507024 - protein, 10 aa, Influenza virus
NLGKVECVCR

SEQ ID NO: 507025 - protein, 10 aa, Influenza virus
NLGLNIGLHL

SEQ ID NO: 507026 - protein, 10 aa, Influenza virus
NLGLNVGLHL

SEQ ID NO: 507027 - protein, 10 aa, Influenza virus
NLGQVECVCR

SEQ ID NO: 507028 - protein, 10 aa, Influenza virus
NLHAYISFRN

SEQ ID NO: 507029 - protein, 10 aa, Influenza virus
NLHIPEAGLK

SEQ ID NO: 507030 - protein, 10 aa, Influenza virus
NLHIPEVCLK

SEQ ID NO: 507031 - protein, 10 aa, Influenza virus
NLIAPEFGYL

SEQ ID NO: 507032 - protein, 10 aa, Influenza virus
NLIAPEYGFK

SEQ ID NO: 507033 - protein, 10 aa, Influenza virus
NLIAPEYGFR

SEQ ID NO: 507034 - protein, 10 aa, Influenza virus
NLIAPEYGHL

SEQ ID NO: 507035 - protein, 10 aa, Influenza virus
NLIAPEYGYL

SEQ ID NO: 507036 - protein, 10 aa, Influenza virus
NLIAPRGHYK

SEQ ID NO: 507037 - protein, 10 aa, Influenza virus
NLIAPRGHYR

SEQ ID NO: 507038 - protein, 10 aa, Influenza virus
NLIAPRGYFK

SEQ ID NO: 507039 - protein, 10 aa, Influenza virus
NLIAPRGYFR

SEQ ID NO: 507040 - protein, 10 aa, Influenza virus
NLIAPRGYYK

SEQ ID NO: 507041 - protein, 10 aa, Influenza virus
NLIAPWYAFR

SEQ ID NO: 507042 - protein, 10 aa, Influenza virus
NLIAPWYAYK

SEQ ID NO: 507043 - protein, 10 aa, Influenza virus
NLIAPWYAYR

SEQ ID NO: 507044 - protein, 10 aa, Influenza virus
NLIFNTVIHE

SEQ ID NO: 507045 - protein, 10 aa, Influenza virus
NLIFNTVIHG

SEQ ID NO: 507046 - protein, 10 aa, Influenza virus
NLIGKTSWSY

SEQ ID NO: 507047 - protein, 10 aa, Influenza virus
NLIIGISNVG

SEQ ID NO: 507048 - protein, 10 aa, Influenza virus
NLKLATGLRN

SEQ ID NO: 507049 - protein, 10 aa, Influenza virus
NLLENLQAYQ

SEQ ID NO: 507050 - protein, 10 aa, Influenza virus
NLLHKCNDSC

SEQ ID NO: 507051 - protein, 10 aa, Influenza virus
NLLIGISNIG

SEQ ID NO: 507052 - protein, 10 aa, Influenza virus
NLLIGISNMS

SEQ ID NO: 507053 - protein, 10 aa, Influenza virus
NLLIGISNVG

SEQ ID NO: 507054 - protein, 10 aa, Influenza virus
NLLIGISNVV

SEQ ID NO: 507055 - protein, 10 aa, Influenza virus
NLLIGVSNVG

SEQ ID NO: 507056 - protein, 10 aa, Influenza virus
NLNDATYQRT

SEQ ID NO: 507057 - protein, 10 aa, Influenza virus
NLNDTTYQRT

SEQ ID NO: 507058 - protein, 10 aa, Influenza virus
NLNKKIDDGF

SEQ ID NO: 507059 - protein, 10 aa, Influenza virus
NLNKKMEDGF

SEQ ID NO: 507060 - protein, 10 aa, Influenza virus
NLNKKMEDGL

SEQ ID NO: 507061 - protein, 10 aa, Influenza virus
NLNKKVDDGF

SEQ ID NO: 507062 - protein, 10 aa, Influenza virus
NLNKKVDDGL

SEQ ID NO: 507063 - protein, 10 aa, Influenza virus
NLNKKVEDGF

SEQ ID NO: 507064 - protein, 10 aa, Influenza virus
NLNRKMEDGF

SEQ ID NO: 507065 - protein, 10 aa, Influenza virus
NLNRKVDDGF

SEQ ID NO: 507066 - protein, 10 aa, Influenza virus
NLNWSGYSGS

SEQ ID NO: 507067 - protein, 10 aa, Influenza virus
NLPFQNINSR

SEQ ID NO: 507068 - protein, 10 aa, Influenza virus
NLPFQNVNSR

SEQ ID NO: 507069 - protein, 10 aa, Influenza virus
NLQAYQKRMG

SEQ ID NO: 507070 - protein, 10 aa, Influenza virus
NLQTYQKRMG

SEQ ID NO: 507071 - protein, 10 aa, Influenza virus
NLSGYSGSFI

SEQ ID NO: 507072 - protein, 10 aa, Influenza virus
NLSKRMEDGF

SEQ ID NO: 507073 - protein, 10 aa, Influenza virus
NLSPRTVGQC

SEQ ID NO: 507074 - protein, 10 aa, Influenza virus
NLTKGLCTIN

SEQ ID NO: 507075 - protein, 10 aa, Influenza virus
NLTKINNGDY

SEQ ID NO: 507076 - protein, 10 aa, Influenza virus
NLTKRLCTIN

SEQ ID NO: 507077 - protein, 10 aa, Influenza virus
NLTKTNNGDY

SEQ ID NO: 507078 - protein, 10 aa, Influenza virus
NLTKVNNGDY

SEQ ID NO: 507079 - protein, 10 aa, Influenza virus
NLTKVNNGNY

SEQ ID NO: 507080 - protein, 10 aa, Influenza virus
NLTKVNSGDY

SEQ ID NO: 507081 - protein, 10 aa, Influenza virus
NLTRELCTIN

SEQ ID NO: 507082 - protein, 10 aa, Influenza virus
NLTRGLCKIN

SEQ ID NO: 507083 - protein, 10 aa, Influenza virus
NLTRGLCTIN

SEQ ID NO: 507084 - protein, 10 aa, Influenza virus
NLVAPEYGFK

SEQ ID NO: 507085 - protein, 10 aa, Influenza virus
NLVAPRGHYK

SEQ ID NO: 507086 - protein, 10 aa, Influenza virus
NLVAPRGYFK

SEQ ID NO: 507087 - protein, 10 aa, Influenza virus
NLVAPWYAYK

SEQ ID NO: 507088 - protein, 10 aa, Influenza virus
NLVAPWYAYR

SEQ ID NO: 507089 - protein, 10 aa, Influenza virus
NLVFNTVIHE

SEQ ID NO: 507090 - protein, 10 aa, Influenza virus
NLVFNTVIHG

SEQ ID NO: 507091 - protein, 10 aa, Influenza virus
NLVVPEYGFK

SEQ ID NO: 507092 - protein, 10 aa, Influenza virus
NLWAYNAELL

SEQ ID NO: 507093 - protein, 10 aa, Influenza virus
NLYASKNPYT

SEQ ID NO: 507094 - protein, 10 aa, Influenza virus
NLYDKVRFQL

SEQ ID NO: 507095 - protein, 10 aa, Influenza virus
NLYDKVRHQL

SEQ ID NO: 507096 - protein, 10 aa, Influenza virus
NLYDKVRLQL

SEQ ID NO: 507097 - protein, 10 aa, Influenza virus
NLYDKVRMQL

SEQ ID NO: 507098 - protein, 10 aa, Influenza virus
NLYDRVRKQL

SEQ ID NO: 507099 - protein, 10 aa, Influenza virus
NLYDRVRLQL

SEQ ID NO: 507100 - protein, 10 aa, Influenza virus
NLYDRVRMQL

SEQ ID NO: 507101 - protein, 10 aa, Influenza virus
NLYEKVRLQL

SEQ ID NO: 507102 - protein, 10 aa, Influenza virus
NLYEKVRMQL

SEQ ID NO: 507103 - protein, 10 aa, Influenza virus
NLYERVRKQL

SEQ ID NO: 507104 - protein, 10 aa, Influenza virus
NLYGFIIKGR

SEQ ID NO: 507105 - protein, 10 aa, Influenza virus
NLYGFIVKGR

SEQ ID NO: 507106 - protein, 10 aa, Influenza virus
NLYNIRNLHI

SEQ ID NO: 507107 - protein, 10 aa, Influenza virus
NLYNKVRLQL

SEQ ID NO: 507108 - protein, 10 aa, Influenza virus
NLYNKVRMQL

SEQ ID NO: 507109 - protein, 10 aa, Influenza virus
NLYVNKNPYT

SEQ ID NO: 507110 - protein, 10 aa, Influenza virus
NMARAVKLYK

SEQ ID NO: 507111 - protein, 10 aa, Influenza virus
NMDKAVKLYK

SEQ ID NO: 507112 - protein, 10 aa, Influenza virus
NMDKAVKLYR

SEQ ID NO: 507113 - protein, 10 aa, Influenza virus
NMDRAVKLYK

SEQ ID NO: 507114 - protein, 10 aa, Influenza virus
NMDRAVKLYR

SEQ ID NO: 507115 - protein, 10 aa, Influenza virus
NMERIKELRD

SEQ ID NO: 507116 - protein, 10 aa, Influenza virus
NMERIKELRY

SEQ ID NO: 507117 - protein, 10 aa, Influenza virus
NMGIYQILAI

SEQ ID NO: 507118 - protein, 10 aa, Influenza virus
NMGKVECVCR

SEQ ID NO: 507119 - protein, 10 aa, Influenza virus
NMGVYQILAI

SEQ ID NO: 507120 - protein, 10 aa, Influenza virus
NMGVYQVLAI

SEQ ID NO: 507121 - protein, 10 aa, Influenza virus
NMHDANVRNL

SEQ ID NO: 507122 - protein, 10 aa, Influenza virus
NMIADRVDDA

SEQ ID NO: 507123 - protein, 10 aa, Influenza virus
NMINDKIDDQ

SEQ ID NO: 507124 - protein, 10 aa, Influenza virus
NMINDKINDQ

SEQ ID NO: 507125 - protein, 10 aa, Influenza virus
NMINNDLGPA

SEQ ID NO: 507126 - protein, 10 aa, Influenza virus
NMINSKIDDQ

SEQ ID NO: 507127 - protein, 10 aa, Influenza virus
NMINSKIEDQ

SEQ ID NO: 507128 - protein, 10 aa, Influenza virus
NMINSKINDQ

SEQ ID NO: 507129 - protein, 10 aa, Influenza virus
NMINSQIDDQ

SEQ ID NO: 507130 - protein, 10 aa, Influenza virus
NMISDKIDDQ

SEQ ID NO: 507131 - protein, 10 aa, Influenza virus
NMLADRIDDA

SEQ ID NO: 507132 - protein, 10 aa, Influenza virus
NMLADRVDDA

SEQ ID NO: 507133 - protein, 10 aa, Influenza virus
NMLADWVDDA

SEQ ID NO: 507134 - protein, 10 aa, Influenza virus
NMLSTVLGVS

SEQ ID NO: 507135 - protein, 10 aa, Influenza virus
NMQNKLNNVI

SEQ ID NO: 507136 - protein, 10 aa, Influenza virus
NMQNRLNNVI

SEQ ID NO: 507137 - protein, 10 aa, Influenza virus
NMRCTISLVK

SEQ ID NO: 507138 - protein, 10 aa, Influenza virus
NMSKKKSYIN

SEQ ID NO: 507139 - protein, 10 aa, Influenza virus
NMSKRKSYIN

SEQ ID NO: 507140 - protein, 10 aa, Influenza virus
NMSLNISLYS

SEQ ID NO: 507141 - protein, 10 aa, Influenza virus
NNADHRIYWI

SEQ ID NO: 507142 - protein, 10 aa, Influenza virus
NNAIDEGDGC

SEQ ID NO: 507143 - protein, 10 aa, Influenza virus
NNAKDEGNGC

SEQ ID NO: 507144 - protein, 10 aa, Influenza virus
NNAKEIGNGC

SEQ ID NO: 507145 - protein, 10 aa, Influenza virus
NNAKELGNGC

SEQ ID NO: 507146 - protein, 10 aa, Influenza virus
NNAKEVGNGC

SEQ ID NO: 507147 - protein, 10 aa, Influenza virus
NNAQEIGNGC

SEQ ID NO: 507148 - protein, 10 aa, Influenza virus
NNAREIGNGC

SEQ ID NO: 507149 - protein, 10 aa, Influenza virus
NNASAIVWYN

SEQ ID NO: 507150 - protein, 10 aa, Influenza virus
NNASAVIWYK

SEQ ID NO: 507151 - protein, 10 aa, Influenza virus
NNASAVIWYN

SEQ ID NO: 507152 - protein, 10 aa, Influenza virus
NNASAVVWYN

SEQ ID NO: 507153 - protein, 10 aa, Influenza virus
NNASTVIWYN

SEQ ID NO: 507154 - protein, 10 aa, Influenza virus
NNATATVYYD

SEQ ID NO: 507155 - protein, 10 aa, Influenza virus
NNATATVYYN

SEQ ID NO: 507156 - protein, 10 aa, Influenza virus
NNATDTVDTL

SEQ ID NO: 507157 - protein, 10 aa, Influenza virus
NNCIESIRNG

SEQ ID NO: 507158 - protein, 10 aa, Influenza virus
NNCMESIRNN

SEQ ID NO: 507159 - protein, 10 aa, Influenza virus
NNDLGPATAQ

SEQ ID NO: 507160 - protein, 10 aa, Influenza virus
NNDNATATVY

SEQ ID NO: 507161 - protein, 10 aa, Influenza virus
NNDWSGYSGS

SEQ ID NO: 507162 - protein, 10 aa, Influenza virus
NNECMETIKN

SEQ ID NO: 507163 - protein, 10 aa, Influenza virus
NNEDGDIIFL

SEQ ID NO: 507164 - protein, 10 aa, Influenza virus
NNEDGNIIFL

SEQ ID NO: 507165 - protein, 10 aa, Influenza virus
NNEEGDIIFL

SEQ ID NO: 507166 - protein, 10 aa, Influenza virus
NNEGSYFFGD

SEQ ID NO: 507167 - protein, 10 aa, Influenza virus
NNEKGNPGVK

SEQ ID NO: 507168 - protein, 10 aa, Influenza virus
NNEKGNQGVK

SEQ ID NO: 507169 - protein, 10 aa, Influenza virus
NNENATATVY

SEQ ID NO: 507170 - protein, 10 aa, Influenza virus
NNENGDIIFL

SEQ ID NO: 507171 - protein, 10 aa, Influenza virus
NNEPGSGNWP

SEQ ID NO: 507172 - protein, 10 aa, Influenza virus
NNEPSGYAQT

SEQ ID NO: 507173 - protein, 10 aa, Influenza virus
NNEQGSGYAA

SEQ ID NO: 507174 - protein, 10 aa, Influenza virus
NNERGNHGVK

SEQ ID NO: 507175 - protein, 10 aa, Influenza virus
NNERGNPGVK

SEQ ID NO: 507176 - protein, 10 aa, Influenza virus
NNERGNQGVK

SEQ ID NO: 507177 - protein, 10 aa, Influenza virus
NNERGTQGVK

SEQ ID NO: 507178 - protein, 10 aa, Influenza virus
NNETIIETGY

SEQ ID NO: 507179 - protein, 10 aa, Influenza virus
NNETILETGY

SEQ ID NO: 507180 - protein, 10 aa, Influenza virus
NNETILETRY

SEQ ID NO: 507181 - protein, 10 aa, Influenza virus
NNETIVETGY

SEQ ID NO: 507182 - protein, 10 aa, Influenza virus
NNFVPVIGAR

SEQ ID NO: 507183 - protein, 10 aa, Influenza virus
NNFVPVMGAR

SEQ ID NO: 507184 - protein, 10 aa, Influenza virus
NNFVPVVGAR

SEQ ID NO: 507185 - protein, 10 aa, Influenza virus
NNFVPVVRAR

SEQ ID NO: 507186 - protein, 10 aa, Influenza virus
NNGDYARLYI

SEQ ID NO: 507187 - protein, 10 aa, Influenza virus
NNGDYTRLYI

SEQ ID NO: 507188 - protein, 10 aa, Influenza virus
NNGELRHLFS

SEQ ID NO: 507189 - protein, 10 aa, Influenza virus
NNGKFEFIAE

SEQ ID NO: 507190 - protein, 10 aa, Influenza virus
NNGKFEFIVE

SEQ ID NO: 507191 - protein, 10 aa, Influenza virus
NNGKGRYGVK

SEQ ID NO: 507192 - protein, 10 aa, Influenza virus
NNGKLEFIAE

SEQ ID NO: 507193 - protein, 10 aa, Influenza virus
NNGKVECICR

SEQ ID NO: 507194 - protein, 10 aa, Influenza virus
NNGNYARLYI

SEQ ID NO: 507195 - protein, 10 aa, Influenza virus
NNGRFEFIAE

SEQ ID NO: 507196 - protein, 10 aa, Influenza virus
NNGSCRCTIC

SEQ ID NO: 507197 - protein, 10 aa, Influenza virus
NNGVKGFAYL

SEQ ID NO: 507198 - protein, 10 aa, Influenza virus
NNGVKGFSYL

SEQ ID NO: 507199 - protein, 10 aa, Influenza virus
NNIDRAVKLY

SEQ ID NO: 507200 - protein, 10 aa, Influenza virus
NNIIDKMNGN

SEQ ID NO: 507201 - protein, 10 aa, Influenza virus
NNIIEKMNGN

SEQ ID NO: 507202 - protein, 10 aa, Influenza virus
NNILRTQESE

SEQ ID NO: 507203 - protein, 10 aa, Influenza virus
NNIRIGSKGD

SEQ ID NO: 507204 - protein, 10 aa, Influenza virus
NNIVDKMNRE

SEQ ID NO: 507205 - protein, 10 aa, Influenza virus
NNKDGDIIFL

SEQ ID NO: 507206 - protein, 10 aa, Influenza virus
NNKHSNGTIH

SEQ ID NO: 507207 - protein, 10 aa, Influenza virus
NNKNATATVY

SEQ ID NO: 507208 - protein, 10 aa, Influenza virus
NNKNWSGYSG

SEQ ID NO: 507209 - protein, 10 aa, Influenza virus
NNKPFQNVNK

SEQ ID NO: 507210 - protein, 10 aa, Influenza virus
NNKWSGYSGS

SEQ ID NO: 507211 - protein, 10 aa, Influenza virus
NNLEKRLENL

SEQ ID NO: 507212 - protein, 10 aa, Influenza virus
NNLERRLENL

SEQ ID NO: 507213 - protein, 10 aa, Influenza virus
NNLSGYSGSF

SEQ ID NO: 507214 - protein, 10 aa, Influenza virus
NNLTKGLCII

SEQ ID NO: 507215 - protein, 10 aa, Influenza virus
NNLTKGLCTI

SEQ ID NO: 507216 - protein, 10 aa, Influenza virus
NNLTKRLCTI

SEQ ID NO: 507217 - protein, 10 aa, Influenza virus
NNLTRELCTI

SEQ ID NO: 507218 - protein, 10 aa, Influenza virus
NNLTRGLCTI

SEQ ID NO: 507219 - protein, 10 aa, Influenza virus
NNMARAVKLY

SEQ ID NO: 507220 - protein, 10 aa, Influenza virus
NNMDKAVKLY

SEQ ID NO: 507221 - protein, 10 aa, Influenza virus
NNMDRAVKLY

SEQ ID NO: 507222 - protein, 10 aa, Influenza virus
NNMINNDLGP

SEQ ID NO: 507223 - protein, 10 aa, Influenza virus
NNMNWSGYSG

SEQ ID NO: 507224 - protein, 10 aa, Influenza virus
NNNASAIVWY

SEQ ID NO: 507225 - protein, 10 aa, Influenza virus
NNNASAVIWY

SEQ ID NO: 507226 - protein, 10 aa, Influenza virus
NNNASAVVWY

SEQ ID NO: 507227 - protein, 10 aa, Influenza virus
NNNASTVIWY

SEQ ID NO: 507228 - protein, 10 aa, Influenza virus
NNNATATVYY

SEQ ID NO: 507229 - protein, 10 aa, Influenza virus
NNNGELRHLF

SEQ ID NO: 507230 - protein, 10 aa, Influenza virus
NNNGVKGFAY

SEQ ID NO: 507231 - protein, 10 aa, Influenza virus
NNNGVKGFSY

SEQ ID NO: 507232 - protein, 10 aa, Influenza virus
NNNKGAVFKS

SEQ ID NO: 507233 - protein, 10 aa, Influenza virus
NNNNATATVY

SEQ ID NO: 507234 - protein, 10 aa, Influenza virus
NNNNGVKGFA

SEQ ID NO: 507235 - protein, 10 aa, Influenza virus
NNNNGVKGFS

SEQ ID NO: 507236 - protein, 10 aa, Influenza virus
NNNNNTATLC

SEQ ID NO: 507237 - protein, 10 aa, Influenza virus
NNNWFGYFGI

SEQ ID NO: 507238 - protein, 10 aa, Influenza virus
NNNWSGYSGI

SEQ ID NO: 507239 - protein, 10 aa, Influenza virus
NNNWSGYSGS

SEQ ID NO: 507240 - protein, 10 aa, Influenza virus
NNPGRVSVST

SEQ ID NO: 507241 - protein, 10 aa, Influenza virus
NNPGRVTVST

SEQ ID NO: 507242 - protein, 10 aa, Influenza virus
NNPITGSPGA

SEQ ID NO: 507243 - protein, 10 aa, Influenza virus
NNQASYKIFK

SEQ ID NO: 507244 - protein, 10 aa, Influenza virus
NNQASYRIFK

SEQ ID NO: 507245 - protein, 10 aa, Influenza virus
NNQDWSGYSG

SEQ ID NO: 507246 - protein, 10 aa, Influenza virus
NNQNWSGYSG

SEQ ID NO: 507247 - protein, 10 aa, Influenza virus
NNQVFPQLNQ

SEQ ID NO: 507248 - protein, 10 aa, Influenza virus
NNRIKINPVT

SEQ ID NO: 507249 - protein, 10 aa, Influenza virus
NNRKEPALIV

SEQ ID NO: 507250 - protein, 10 aa, Influenza virus
NNRNWSGYSG

SEQ ID NO: 507251 - protein, 10 aa, Influenza virus
NNRSGYSGIF

SEQ ID NO: 507252 - protein, 10 aa, Influenza virus
NNSCMETIRN

SEQ ID NO: 507253 - protein, 10 aa, Influenza virus
NNSKKQIDTI

SEQ ID NO: 507254 - protein, 10 aa, Influenza virus
NNSSDTVDTL

SEQ ID NO: 507255 - protein, 10 aa, Influenza virus
NNSTATLCLG

SEQ ID NO: 507256 - protein, 10 aa, Influenza virus
NNSTDKIDTL

SEQ ID NO: 507257 - protein, 10 aa, Influenza virus
NNSTDKVDTI

SEQ ID NO: 507258 - protein, 10 aa, Influenza virus
NNSTDKVDTL

SEQ ID NO: 507259 - protein, 10 aa, Influenza virus
NNSTDKVNTI

SEQ ID NO: 507260 - protein, 10 aa, Influenza virus
NNSTDTVDTI

SEQ ID NO: 507261 - protein, 10 aa, Influenza virus
NNSTDTVDTL

SEQ ID NO: 507262 - protein, 10 aa, Influenza virus
NNSTDTVDTV

SEQ ID NO: 507263 - protein, 10 aa, Influenza virus
NNSTDTVNTL

SEQ ID NO: 507264 - protein, 10 aa, Influenza virus
NNSTEHVDTI

SEQ ID NO: 507265 - protein, 10 aa, Influenza virus
NNSTEKVDTI

SEQ ID NO: 507266 - protein, 10 aa, Influenza virus
NNSTEQVDTI

SEQ ID NO: 507267 - protein, 10 aa, Influenza virus
NNSTERVDTI

SEQ ID NO: 507268 - protein, 10 aa, Influenza virus
NNSTETVNTL

SEQ ID NO: 507269 - protein, 10 aa, Influenza virus
NNSTKQIDTI

SEQ ID NO: 507270 - protein, 10 aa, Influenza virus
NNSTKQVDTI

SEQ ID NO: 507271 - protein, 10 aa, Influenza virus
NNSTNTVNTL

SEQ ID NO: 507272 - protein, 10 aa, Influenza virus
NNSTTKVDTI

SEQ ID NO: 507273 - protein, 10 aa, Influenza virus
NNSTTQIDTI

SEQ ID NO: 507274 - protein, 10 aa, Influenza virus
NNSTTQVDTI

SEQ ID NO: 507275 - protein, 10 aa, Influenza virus
NNSTTQVDTL

SEQ ID NO: 507276 - protein, 10 aa, Influenza virus
NNSTTQVNTI

SEQ ID NO: 507277 - protein, 10 aa, Influenza virus
NNSTVQVDTI

SEQ ID NO: 507278 - protein, 10 aa, Influenza virus
NNSWSGYSGI

SEQ ID NO: 507279 - protein, 10 aa, Influenza virus
NNTCMETIRN

SEQ ID NO: 507280 - protein, 10 aa, Influenza virus
NNTEPLCDVS

SEQ ID NO: 507281 - protein, 10 aa, Influenza virus
NNTEPLCEVS

SEQ ID NO: 507282 - protein, 10 aa, Influenza virus
NNTEPLCNVS

SEQ ID NO: 507283 - protein, 10 aa, Influenza virus
NNTNGEQILI

SEQ ID NO: 507284 - protein, 10 aa, Influenza virus
NNTSGEQMLI

SEQ ID NO: 507285 - protein, 10 aa, Influenza virus
NNTSGEQMLV

SEQ ID NO: 507286 - protein, 10 aa, Influenza virus
NNTSGEQVLV

SEQ ID NO: 507287 - protein, 10 aa, Influenza virus
NNTTGRDVLV

SEQ ID NO: 507288 - protein, 10 aa, Influenza virus
NNTTLIENTY

SEQ ID NO: 507289 - protein, 10 aa, Influenza virus
NNTTNYYNET

SEQ ID NO: 507290 - protein, 10 aa, Influenza virus
NNTTVVENKY

SEQ ID NO: 507291 - protein, 10 aa, Influenza virus
NNTTVVENTY

SEQ ID NO: 507292 - protein, 10 aa, Influenza virus
NNTVINNITT

SEQ ID NO: 507293 - protein, 10 aa, Influenza virus
NNTVKDRSPY

SEQ ID NO: 507294 - protein, 10 aa, Influenza virus
NNTVVNNITT

SEQ ID NO: 507295 - protein, 10 aa, Influenza virus
NNTWLGRTIS

SEQ ID NO: 507296 - protein, 10 aa, Influenza virus
NNTYDHAQYR

SEQ ID NO: 507297 - protein, 10 aa, Influenza virus
NNTYDHKKYR

SEQ ID NO: 507298 - protein, 10 aa, Influenza virus
NNTYDHRKYK

SEQ ID NO: 507299 - protein, 10 aa, Influenza virus
NNTYDHSHYR

SEQ ID NO: 507300 - protein, 10 aa, Influenza virus
NNTYDHSKYR

SEQ ID NO: 507301 - protein, 10 aa, Influenza virus
NNTYDHSQYR

SEQ ID NO: 507302 - protein, 10 aa, Influenza virus
NNTYDHSRYR

SEQ ID NO: 507303 - protein, 10 aa, Influenza virus
NNTYDHSTYR

SEQ ID NO: 507304 - protein, 10 aa, Influenza virus
NNTYDHTKYR

SEQ ID NO: 507305 - protein, 10 aa, Influenza virus
NNTYDHTQYR

SEQ ID NO: 507306 - protein, 10 aa, Influenza virus
NNTYNHTEYR

SEQ ID NO: 507307 - protein, 10 aa, Influenza virus
NNTYNHTQYR

SEQ ID NO: 507308 - protein, 10 aa, Influenza virus
NNVIDKMNKQ

SEQ ID NO: 507309 - protein, 10 aa, Influenza virus
NNVIDKMNNQ

SEQ ID NO: 507310 - protein, 10 aa, Influenza virus
NNVIDKMYKQ

SEQ ID NO: 507311 - protein, 10 aa, Influenza virus
NNVTVTSSVE

SEQ ID NO: 507312 - protein, 10 aa, Influenza virus
NNWFGYFGIF

SEQ ID NO: 507313 - protein, 10 aa, Influenza virus
NNWSGYSGIF

SEQ ID NO: 507314 - protein, 10 aa, Influenza virus
NNWSGYSGSF

SEQ ID NO: 507315 - protein, 10 aa, Influenza virus
NNWSGYSGVF

SEQ ID NO: 507316 - protein, 10 aa, Influenza virus
NNYEELKHLL

SEQ ID NO: 507317 - protein, 10 aa, Influenza virus
NNYGVKGFGF

SEQ ID NO: 507318 - protein, 10 aa, Influenza virus
NPAHKSQLIW

SEQ ID NO: 507319 - protein, 10 aa, Influenza virus
NPAHKSQLVW

SEQ ID NO: 507320 - protein, 10 aa, Influenza virus
NPALRMKWMM

SEQ ID NO: 507321 - protein, 10 aa, Influenza virus
NPANGICYPG

SEQ ID NO: 507322 - protein, 10 aa, Influenza virus
NPAYCNTDLG

SEQ ID NO: 507323 - protein, 10 aa, Influenza virus
NPCFYVELIR

SEQ ID NO: 507324 - protein, 10 aa, Influenza virus
NPDPGVKGFA

SEQ ID NO: 507325 - protein, 10 aa, Influenza virus
NPEAYNFNEG

SEQ ID NO: 507326 - protein, 10 aa, Influenza virus
NPGDSIIFNS

SEQ ID NO: 507327 - protein, 10 aa, Influenza virus
NPGNAEIEDL

SEQ ID NO: 507328 - protein, 10 aa, Influenza virus
NPGRVSVSTK

SEQ ID NO: 507329 - protein, 10 aa, Influenza virus
NPGRVTVSTK

SEQ ID NO: 507330 - protein, 10 aa, Influenza virus
NPGRVTVSTQ

SEQ ID NO: 507331 - protein, 10 aa, Influenza virus
NPGRVTVSTR

SEQ ID NO: 507332 - protein, 10 aa, Influenza virus
NPGVKGWAFD

SEQ ID NO: 507333 - protein, 10 aa, Influenza virus
NPIICLGHHA

SEQ ID NO: 507334 - protein, 10 aa, Influenza virus
NPINGICYPG

SEQ ID NO: 507335 - protein, 10 aa, Influenza virus
NPITGSPCAP

SEQ ID NO: 507336 - protein, 10 aa, Influenza virus
NPITGSPGAP

SEQ ID NO: 507337 - protein, 10 aa, Influenza virus
NPITGSPGSP

SEQ ID NO: 507338 - protein, 10 aa, Influenza virus
NPITGSPGVP

SEQ ID NO: 507339 - protein, 10 aa, Influenza virus
NPITGSPSAP

SEQ ID NO: 507340 - protein, 10 aa, Influenza virus
NPKCDIHLKD

SEQ ID NO: 507341 - protein, 10 aa, Influenza virus
NPKCDIHLRD

SEQ ID NO: 507342 - protein, 10 aa, Influenza virus
NPKCDLYLNG

SEQ ID NO: 507343 - protein, 10 aa, Influenza virus
NPKCDLYLSG

SEQ ID NO: 507344 - protein, 10 aa, Influenza virus
NPKCDPYLNG

SEQ ID NO: 507345 - protein, 10 aa, Influenza virus
NPKCDTHLKD

SEQ ID NO: 507346 - protein, 10 aa, Influenza virus
NPKCDVHLKD

SEQ ID NO: 507347 - protein, 10 aa, Influenza virus
NPKSKLFTLS

SEQ ID NO: 507348 - protein, 10 aa, Influenza virus
NPLIKHENRM

SEQ ID NO: 507349 - protein, 10 aa, Influenza virus
NPLIRHENRM

SEQ ID NO: 507350 - protein, 10 aa, Influenza virus
NPMCDDLIGK

SEQ ID NO: 507351 - protein, 10 aa, Influenza virus
NPMCDELIGK

SEQ ID NO: 507352 - protein, 10 aa, Influenza virus
NPMCDNLIGK

SEQ ID NO: 507353 - protein, 10 aa, Influenza virus
NPMCDYLIGK

SEQ ID NO: 507354 - protein, 10 aa, Influenza virus
NPMHQLLRHF

SEQ ID NO: 507355 - protein, 10 aa, Influenza virus
NPNQKIICIS

SEQ ID NO: 507356 - protein, 10 aa, Influenza virus
NPNQKIITID

SEQ ID NO: 507357 - protein, 10 aa, Influenza virus
NPNQKIITIG

SEQ ID NO: 507358 - protein, 10 aa, Influenza virus
NPNQKILCAS

SEQ ID NO: 507359 - protein, 10 aa, Influenza virus
NPNQKILCTS

SEQ ID NO: 507360 - protein, 10 aa, Influenza virus
NPNQKILFAS

SEQ ID NO: 507361 - protein, 10 aa, Influenza virus
NPNQKIMCIS

SEQ ID NO: 507362 - protein, 10 aa, Influenza virus
NPNQKIQCTS

SEQ ID NO: 507363 - protein, 10 aa, Influenza virus
NPNQKITCIS

SEQ ID NO: 507364 - protein, 10 aa, Influenza virus
NPNQKIVTIG

SEQ ID NO: 507365 - protein, 10 aa, Influenza virus
NPNQKLFALS

SEQ ID NO: 507366 - protein, 10 aa, Influenza virus
NPNQKLFASS

SEQ ID NO: 507367 - protein, 10 aa, Influenza virus
NPNQKLFTLS

SEQ ID NO: 507368 - protein, 10 aa, Influenza virus
NPNQKTITIG

SEQ ID NO: 507369 - protein, 10 aa, Influenza virus
NPNQMIITIG

SEQ ID NO: 507370 - protein, 10 aa, Influenza virus
NPNWSGYSGS

SEQ ID NO: 507371 - protein, 10 aa, Influenza virus
NPRCDDLIGK

SEQ ID NO: 507372 - protein, 10 aa, Influenza virus
NPRIFLAMIT

SEQ ID NO: 507373 - protein, 10 aa, Influenza virus
NPRMFLAMIT

SEQ ID NO: 507374 - protein, 10 aa, Influenza virus
NPRVFLAMIT

SEQ ID NO: 507375 - protein, 10 aa, Influenza virus
NPRVFLTMIT

SEQ ID NO: 507376 - protein, 10 aa, Influenza virus
NPSAGKDPKK

SEQ ID NO: 507377 - protein, 10 aa, Influenza virus
NPSCASNINI

SEQ ID NO: 507378 - protein, 10 aa, Influenza virus
NPSCATNINI

SEQ ID NO: 507379 - protein, 10 aa, Influenza virus
NPSHEGEGIP

SEQ ID NO: 507380 - protein, 10 aa, Influenza virus
NPSLRMKWMM

SEQ ID NO: 507381 - protein, 10 aa, Influenza virus
NPSQKLFALS

SEQ ID NO: 507382 - protein, 10 aa, Influenza virus
NPTEEQAVDI

SEQ ID NO: 507383 - protein, 10 aa, Influenza virus
NPTEEQAVEI

SEQ ID NO: 507384 - protein, 10 aa, Influenza virus
NPTEEQAVGI

SEQ ID NO: 507385 - protein, 10 aa, Influenza virus
NPTEEQAVNI

SEQ ID NO: 507386 - protein, 10 aa, Influenza virus
NPTLLFLEVP

SEQ ID NO: 507387 - protein, 10 aa, Influenza virus
NPTLLFLKIP

SEQ ID NO: 507388 - protein, 10 aa, Influenza virus
NPTLLFLKMP

SEQ ID NO: 507389 - protein, 10 aa, Influenza virus
NPTLLFLKVP

SEQ ID NO: 507390 - protein, 10 aa, Influenza virus
NPTNGICYPG

SEQ ID NO: 507391 - protein, 10 aa, Influenza virus
NPVELSSGYK

SEQ ID NO: 507392 - protein, 10 aa, Influenza virus
NPVHKSQLIW

SEQ ID NO: 507393 - protein, 10 aa, Influenza virus
NPVICLGHHA

SEQ ID NO: 507394 - protein, 10 aa, Influenza virus
NPVICLGHHS

SEQ ID NO: 507395 - protein, 10 aa, Influenza virus
NPVICMGHHA

SEQ ID NO: 507396 - protein, 10 aa, Influenza virus
NPVKLNSGYK

SEQ ID NO: 507397 - protein, 10 aa, Influenza virus
NPVKLSGGYK

SEQ ID NO: 507398 - protein, 10 aa, Influenza virus
NPVKLSSGYK

SEQ ID NO: 507399 - protein, 10 aa, Influenza virus
NPVNGICYPG

SEQ ID NO: 507400 - protein, 10 aa, Influenza virus
NPVTLSSGYK

SEQ ID NO: 507401 - protein, 10 aa, Influenza virus
NPVTLTMGYK

SEQ ID NO: 507402 - protein, 10 aa, Influenza virus
NPYTLVSTKE

SEQ ID NO: 507403 - protein, 10 aa, Influenza virus
NQASYKIFKS

SEQ ID NO: 507404 - protein, 10 aa, Influenza virus
NQASYRIFKS

SEQ ID NO: 507405 - protein, 10 aa, Influenza virus
NQCMESIRNN

SEQ ID NO: 507406 - protein, 10 aa, Influenza virus
NQDSFYRSMK

SEQ ID NO: 507407 - protein, 10 aa, Influenza virus
NQDWSGYSGA

SEQ ID NO: 507408 - protein, 10 aa, Influenza virus
NQEELKSLFS

SEQ ID NO: 507409 - protein, 10 aa, Influenza virus
NQEELRFLFS

SEQ ID NO: 507410 - protein, 10 aa, Influenza virus
NQEELRSLFS

SEQ ID NO: 507411 - protein, 10 aa, Influenza virus
NQEYTSGRQE

SEQ ID NO: 507412 - protein, 10 aa, Influenza virus
NQFALGQGTT

SEQ ID NO: 507413 - protein, 10 aa, Influenza virus
NQGSFYRNMR

SEQ ID NO: 507414 - protein, 10 aa, Influenza virus
NQGSFYRSIR

SEQ ID NO: 507415 - protein, 10 aa, Influenza virus
NQGSFYRSMR

SEQ ID NO: 507416 - protein, 10 aa, Influenza virus
NQGVKGWAFD

SEQ ID NO: 507417 - protein, 10 aa, Influenza virus
NQHIIDLADS

SEQ ID NO: 507418 - protein, 10 aa, Influenza virus
NQHTIDLADS

SEQ ID NO: 507419 - protein, 10 aa, Influenza virus
NQHTIDLAES

SEQ ID NO: 507420 - protein, 10 aa, Influenza virus
NQHTIDLTDA

SEQ ID NO: 507421 - protein, 10 aa, Influenza virus
NQHTIDLTDS

SEQ ID NO: 507422 - protein, 10 aa, Influenza virus
NQHTIDLTNS

SEQ ID NO: 507423 - protein, 10 aa, Influenza virus
NQHTIDMADS

SEQ ID NO: 507424 - protein, 10 aa, Influenza virus
NQHTIDMGDS

SEQ ID NO: 507425 - protein, 10 aa, Influenza virus
NQHTIDMTDS

SEQ ID NO: 507426 - protein, 10 aa, Influenza virus
NQHTIDSTDS

SEQ ID NO: 507427 - protein, 10 aa, Influenza virus
NQHTIDVADS

SEQ ID NO: 507428 - protein, 10 aa, Influenza virus
NQHTIDVTDS

SEQ ID NO: 507429 - protein, 10 aa, Influenza virus
NQHTIHLTDS

SEQ ID NO: 507430 - protein, 10 aa, Influenza virus
NQIKIRRRVD

SEQ ID NO: 507431 - protein, 10 aa, Influenza virus
NQITGKLNRI

SEQ ID NO: 507432 - protein, 10 aa, Influenza virus
NQITGKLNRL

SEQ ID NO: 507433 - protein, 10 aa, Influenza virus
NQKIITIGFV

SEQ ID NO: 507434 - protein, 10 aa, Influenza virus
NQKIITIGSA

SEQ ID NO: 507435 - protein, 10 aa, Influenza virus
NQKIITIGSI

SEQ ID NO: 507436 - protein, 10 aa, Influenza virus
NQKIITIGSV

SEQ ID NO: 507437 - protein, 10 aa, Influenza virus
NQKIITMGSV

SEQ ID NO: 507438 - protein, 10 aa, Influenza virus
NQKILCASAT

SEQ ID NO: 507439 - protein, 10 aa, Influenza virus
NQKILCTSAI

SEQ ID NO: 507440 - protein, 10 aa, Influenza virus
NQKILCTSAT

SEQ ID NO: 507441 - protein, 10 aa, Influenza virus
NQKILDEHDS

SEQ ID NO: 507442 - protein, 10 aa, Influenza virus
NQKILFASAT

SEQ ID NO: 507443 - protein, 10 aa, Influenza virus
NQKIMTIGSV

SEQ ID NO: 507444 - protein, 10 aa, Influenza virus
NQKIQCTSAT

SEQ ID NO: 507445 - protein, 10 aa, Influenza virus
NQKLFALSEV

SEQ ID NO: 507446 - protein, 10 aa, Influenza virus
NQKLFALSGV

SEQ ID NO: 507447 - protein, 10 aa, Influenza virus
NQKLFASSGI

SEQ ID NO: 507448 - protein, 10 aa, Influenza virus
NQKLFTLSGV

SEQ ID NO: 507449 - protein, 10 aa, Influenza virus
NQKTITIGSV

SEQ ID NO: 507450 - protein, 10 aa, Influenza virus
NQKTLDEHDA

SEQ ID NO: 507451 - protein, 10 aa, Influenza virus
NQKTLDEHDS

SEQ ID NO: 507452 - protein, 10 aa, Influenza virus
NQKTLDKHDS

SEQ ID NO: 507453 - protein, 10 aa, Influenza virus
NQNNTTVVEN

SEQ ID NO: 507454 - protein, 10 aa, Influenza virus
NQNPRIFLAM

SEQ ID NO: 507455 - protein, 10 aa, Influenza virus
NQNPRMFLAM

SEQ ID NO: 507456 - protein, 10 aa, Influenza virus
NQNPRVFLAM

SEQ ID NO: 507457 - protein, 10 aa, Influenza virus
NQNPRVFLTM

SEQ ID NO: 507458 - protein, 10 aa, Influenza virus
NQNQNPRMFL

SEQ ID NO: 507459 - protein, 10 aa, Influenza virus
NQNSTWVSQT

SEQ ID NO: 507460 - protein, 10 aa, Influenza virus
NQNTIDLTDS

SEQ ID NO: 507461 - protein, 10 aa, Influenza virus
NQNWSGYSGA

SEQ ID NO: 507462 - protein, 10 aa, Influenza virus
NQNWSGYSGS

SEQ ID NO: 507463 - protein, 10 aa, Influenza virus
NQNWSGYSGV

SEQ ID NO: 507464 - protein, 10 aa, Influenza virus
NQPAATALAN

SEQ ID NO: 507465 - protein, 10 aa, Influenza virus
NQQFELIDNE

SEQ ID NO: 507466 - protein, 10 aa, Influenza virus
NQQFELIDNK

SEQ ID NO: 507467 - protein, 10 aa, Influenza virus
NQQFELIDSE

SEQ ID NO: 507468 - protein, 10 aa, Influenza virus
NQQFELINNE

SEQ ID NO: 507469 - protein, 10 aa, Influenza virus
NQQFEMIDNE

SEQ ID NO: 507470 - protein, 10 aa, Influenza virus
NQQFGLIDNE

SEQ ID NO: 507471 - protein, 10 aa, Influenza virus
NQQFKLIDNE

SEQ ID NO: 507472 - protein, 10 aa, Influenza virus
NQRGILEDEQ

SEQ ID NO: 507473 - protein, 10 aa, Influenza virus
NQRLNPMHQL

SEQ ID NO: 507474 - protein, 10 aa, Influenza virus
NQRLNTMHQL

SEQ ID NO: 507475 - protein, 10 aa, Influenza virus
NQSGRISIYW

SEQ ID NO: 507476 - protein, 10 aa, Influenza virus
NQSPRMFLAM

SEQ ID NO: 507477 - protein, 10 aa, Influenza virus
NQTKKMTITF

SEQ ID NO: 507478 - protein, 10 aa, Influenza virus
NQTKTMTITF

SEQ ID NO: 507479 - protein, 10 aa, Influenza virus
NQTLVSNNDW

SEQ ID NO: 507480 - protein, 10 aa, Influenza virus
NQTYRNNRKE

SEQ ID NO: 507481 - protein, 10 aa, Influenza virus
NQTYRNTRKE

SEQ ID NO: 507482 - protein, 10 aa, Influenza virus
NQVEKRINMI

SEQ ID NO: 507483 - protein, 10 aa, Influenza virus
NQVEKRINML

SEQ ID NO: 507484 - protein, 10 aa, Influenza virus
NQVENRINML

SEQ ID NO: 507485 - protein, 10 aa, Influenza virus
NQVEQRINML

SEQ ID NO: 507486 - protein, 10 aa, Influenza virus
NQVFPQLNQT

SEQ ID NO: 507487 - protein, 10 aa, Influenza virus
NQVKIRRRVD

SEQ ID NO: 507488 - protein, 10 aa, Influenza virus
NRANQRLNPM

SEQ ID NO: 507489 - protein, 10 aa, Influenza virus
NRANQRLNTM

SEQ ID NO: 507490 - protein, 10 aa, Influenza virus
NRCFYVELIR

SEQ ID NO: 507491 - protein, 10 aa, Influenza virus
NRCFYVELVR

SEQ ID NO: 507492 - protein, 10 aa, Influenza virus
NRCYQFALGQ

SEQ ID NO: 507493 - protein, 10 aa, Influenza virus
NRDITIGSIC

SEQ ID NO: 507494 - protein, 10 aa, Influenza virus
NREFEVMNHE

SEQ ID NO: 507495 - protein, 10 aa, Influenza virus
NREFEVVDHE

SEQ ID NO: 507496 - protein, 10 aa, Influenza virus
NREFEVVNHE

SEQ ID NO: 507497 - protein, 10 aa, Influenza virus
NREFGVVNHE

SEQ ID NO: 507498 - protein, 10 aa, Influenza virus
NRFIEKTNQQ

SEQ ID NO: 507499 - protein, 10 aa, Influenza virus
NRFQIQGIKL

SEQ ID NO: 507500 - protein, 10 aa, Influenza virus
NRFQIQGVKL

SEQ ID NO: 507501 - protein, 10 aa, Influenza virus
NRFQIQGVRL

SEQ ID NO: 507502 - protein, 10 aa, Influenza virus
NRFYRTCKLL

SEQ ID NO: 507503 - protein, 10 aa, Influenza virus
NRFYRTCKLV

SEQ ID NO: 507504 - protein, 10 aa, Influenza virus
NRGLFGAIAG

SEQ ID NO: 507505 - protein, 10 aa, Influenza virus
NRGLFGAKAG

SEQ ID NO: 507506 - protein, 10 aa, Influenza virus
NRGSFYRSMR

SEQ ID NO: 507507 - protein, 10 aa, Influenza virus
NRHSNGTIHD

SEQ ID NO: 507508 - protein, 10 aa, Influenza virus
NRIFQPNIGP

SEQ ID NO: 507509 - protein, 10 aa, Influenza virus
NRIFRPNIGP

SEQ ID NO: 507510 - protein, 10 aa, Influenza virus
NRIIEKTNQQ

SEQ ID NO: 507511 - protein, 10 aa, Influenza virus
NRIKINPVTL

SEQ ID NO: 507512 - protein, 10 aa, Influenza virus
NRIMINPVKL

SEQ ID NO: 507513 - protein, 10 aa, Influenza virus
NRINMLADRI

SEQ ID NO: 507514 - protein, 10 aa, Influenza virus
NRIQIDPVKL

SEQ ID NO: 507515 - protein, 10 aa, Influenza virus
NRIQIDQVKL

SEQ ID NO: 507516 - protein, 10 aa, Influenza virus
NRIQIDSVKL

SEQ ID NO: 507517 - protein, 10 aa, Influenza virus
NRIQINPVKL

SEQ ID NO: 507518 - protein, 10 aa, Influenza virus
NRIRIDPVKL

SEQ ID NO: 507519 - protein, 10 aa, Influenza virus
NRKEPALIVW

SEQ ID NO: 507520 - protein, 10 aa, Influenza virus
NRKEYEEEAK

SEQ ID NO: 507521 - protein, 10 aa, Influenza virus
NRKMEDGFLD

SEQ ID NO: 507522 - protein, 10 aa, Influenza virus
NRKVDDGFLD

SEQ ID NO: 507523 - protein, 10 aa, Influenza virus
NRLIDKTNQQ

SEQ ID NO: 507524 - protein, 10 aa, Influenza virus
NRLIDRTNHQ

SEQ ID NO: 507525 - protein, 10 aa, Influenza virus
NRLIEKTNDK

SEQ ID NO: 507526 - protein, 10 aa, Influenza virus
NRLIEKTNEK

SEQ ID NO: 507527 - protein, 10 aa, Influenza virus
NRLIEKTNKQ

SEQ ID NO: 507528 - protein, 10 aa, Influenza virus
NRLIEKTNQQ

SEQ ID NO: 507529 - protein, 10 aa, Influenza virus
NRLIEKTNTE

SEQ ID NO: 507530 - protein, 10 aa, Influenza virus
NRLIEKTNTQ

SEQ ID NO: 507531 - protein, 10 aa, Influenza virus
NRLIERTNEK

SEQ ID NO: 507532 - protein, 10 aa, Influenza virus
NRLIERTNQQ

SEQ ID NO: 507533 - protein, 10 aa, Influenza virus
NRLIGKTNQQ

SEQ ID NO: 507534 - protein, 10 aa, Influenza virus
NRLISKTNQQ

SEQ ID NO: 507535 - protein, 10 aa, Influenza virus
NRLNINPVKL

SEQ ID NO: 507536 - protein, 10 aa, Influenza virus
NRLNINPVRL

SEQ ID NO: 507537 - protein, 10 aa, Influenza virus
NRLNINPVTL

SEQ ID NO: 507538 - protein, 10 aa, Influenza virus
NRLNINSVKL

SEQ ID NO: 507539 - protein, 10 aa, Influenza virus
NRLNNVIDKM

SEQ ID NO: 507540 - protein, 10 aa, Influenza virus
NRLSINPVKL

SEQ ID NO: 507541 - protein, 10 aa, Influenza virus
NRMQFSSLTV

SEQ ID NO: 507542 - protein, 10 aa, Influenza virus
NRMQINPVKL

SEQ ID NO: 507543 - protein, 10 aa, Influenza virus
NRMVIASTTA

SEQ ID NO: 507544 - protein, 10 aa, Influenza virus
NRMVLASTTA

SEQ ID NO: 507545 - protein, 10 aa, Influenza virus
NRNEIKGVKL

SEQ ID NO: 507546 - protein, 10 aa, Influenza virus
NRNFKPNIGP

SEQ ID NO: 507547 - protein, 10 aa, Influenza virus
NRNFQPNIGP

SEQ ID NO: 507548 - protein, 10 aa, Influenza virus
NRNQPAATAL

SEQ ID NO: 507549 - protein, 10 aa, Influenza virus
NRNWSGYSGS

SEQ ID NO: 507550 - protein, 10 aa, Influenza virus
NRPIIEIDMN

SEQ ID NO: 507551 - protein, 10 aa, Influenza virus
NRPIIEIDMS

SEQ ID NO: 507552 - protein, 10 aa, Influenza virus
NRPIIEIDMT

SEQ ID NO: 507553 - protein, 10 aa, Influenza virus
NRPVIEIDMN

SEQ ID NO: 507554 - protein, 10 aa, Influenza virus
NRPVIEIDMS

SEQ ID NO: 507555 - protein, 10 aa, Influenza virus
NRPWIRFNSD

SEQ ID NO: 507556 - protein, 10 aa, Influenza virus
NRPWIRFNSN

SEQ ID NO: 507557 - protein, 10 aa, Influenza virus
NRPWIRINNE

SEQ ID NO: 507558 - protein, 10 aa, Influenza virus
NRPWISFDQN

SEQ ID NO: 507559 - protein, 10 aa, Influenza virus
NRPWMRINNE

SEQ ID NO: 507560 - protein, 10 aa, Influenza virus
NRPWMRISNE

SEQ ID NO: 507561 - protein, 10 aa, Influenza virus
NRPWVRINNE

SEQ ID NO: 507562 - protein, 10 aa, Influenza virus
NRPWVRMNNE

SEQ ID NO: 507563 - protein, 10 aa, Influenza virus
NRPWVSFDQN

SEQ ID NO: 507564 - protein, 10 aa, Influenza virus
NRPWVSFNHN

SEQ ID NO: 507565 - protein, 10 aa, Influenza virus
NRPWVSFNQD

SEQ ID NO: 507566 - protein, 10 aa, Influenza virus
NRPWVSFNQN

SEQ ID NO: 507567 - protein, 10 aa, Influenza virus
NRQEIEGARL

SEQ ID NO: 507568 - protein, 10 aa, Influenza virus
NRQEIEGVKL

SEQ ID NO: 507569 - protein, 10 aa, Influenza virus
NRQEIEGVRL

SEQ ID NO: 507570 - protein, 10 aa, Influenza virus
NRQEIGGVKL

SEQ ID NO: 507571 - protein, 10 aa, Influenza virus
NRRLTTTIKP

SEQ ID NO: 507572 - protein, 10 aa, Influenza virus
NRRLTTTIKT

SEQ ID NO: 507573 - protein, 10 aa, Influenza virus
NRRPTTTIKT

SEQ ID NO: 507574 - protein, 10 aa, Influenza virus
NRSFKPNIGP

SEQ ID NO: 507575 - protein, 10 aa, Influenza virus
NRSFQPNIGP

SEQ ID NO: 507576 - protein, 10 aa, Influenza virus
NRSFRPNIGP

SEQ ID NO: 507577 - protein, 10 aa, Influenza virus
NRSGYSGIFS

SEQ ID NO: 507578 - protein, 10 aa, Influenza virus
NRSGYSGSFI

SEQ ID NO: 507579 - protein, 10 aa, Influenza virus
NRSILNTSQR

SEQ ID NO: 507580 - protein, 10 aa, Influenza virus
NRSPYRALMS

SEQ ID NO: 507581 - protein, 10 aa, Influenza virus
NRTFQNIDKN

SEQ ID NO: 507582 - protein, 10 aa, Influenza virus
NRTFQNIDRN

SEQ ID NO: 507583 - protein, 10 aa, Influenza virus
NRTFQNVSPL

SEQ ID NO: 507584 - protein, 10 aa, Influenza virus
NRTGTFEFTS

SEQ ID NO: 507585 - protein, 10 aa, Influenza virus
NRTHQYSEKG

SEQ ID NO: 507586 - protein, 10 aa, Influenza virus
NRTHQYSERG

SEQ ID NO: 507587 - protein, 10 aa, Influenza virus
NRVKIDPVKL

SEQ ID NO: 507588 - protein, 10 aa, Influenza virus
NRVWWTSNSI

SEQ ID NO: 507589 - protein, 10 aa, Influenza virus
NRYLEEHPSA

SEQ ID NO: 507590 - protein, 10 aa, Influenza virus
NRYLEENPSA

SEQ ID NO: 507591 - protein, 10 aa, Influenza virus
NSAAFEDLRV

SEQ ID NO: 507592 - protein, 10 aa, Influenza virus
NSADHRIYWI

SEQ ID NO: 507593 - protein, 10 aa, Influenza virus
NSADHRVYWI

SEQ ID NO: 507594 - protein, 10 aa, Influenza virus
NSAHHRVYWI

SEQ ID NO: 507595 - protein, 10 aa, Influenza virus
NSALGSPGCD

SEQ ID NO: 507596 - protein, 10 aa, Influenza virus
NSCIESIRNG

SEQ ID NO: 507597 - protein, 10 aa, Influenza virus
NSCMETIRNG

SEQ ID NO: 507598 - protein, 10 aa, Influenza virus
NSDFICVGWS

SEQ ID NO: 507599 - protein, 10 aa, Influenza virus
NSDFLCVGWS

SEQ ID NO: 507600 - protein, 10 aa, Influenza virus
NSDFMCVGWS

SEQ ID NO: 507601 - protein, 10 aa, Influenza virus
NSDLDYQIGY

SEQ ID NO: 507602 - protein, 10 aa, Influenza virus
NSDLEALMEW

SEQ ID NO: 507603 - protein, 10 aa, Influenza virus
NSDLNYQIGY

SEQ ID NO: 507604 - protein, 10 aa, Influenza virus
NSDVLVTREP

SEQ ID NO: 507605 - protein, 10 aa, Influenza virus
NSDWSGYSGS

SEQ ID NO: 507606 - protein, 10 aa, Influenza virus
NSEFICVGWS

SEQ ID NO: 507607 - protein, 10 aa, Influenza virus
NSEFLCVGWS

SEQ ID NO: 507608 - protein, 10 aa, Influenza virus
NSEGIGQAAD

SEQ ID NO: 507609 - protein, 10 aa, Influenza virus
NSEGMGQAAD

SEQ ID NO: 507610 - protein, 10 aa, Influenza virus
NSEGRGQAAD

SEQ ID NO: 507611 - protein, 10 aa, Influenza virus
NSEGTGIAAD

SEQ ID NO: 507612 - protein, 10 aa, Influenza virus
NSEGTGIVAD

SEQ ID NO: 507613 - protein, 10 aa, Influenza virus
NSEGTGMAAD

SEQ ID NO: 507614 - protein, 10 aa, Influenza virus
NSEGTGQAAD

SEQ ID NO: 507615 - protein, 10 aa, Influenza virus
NSEGTGTAAD

SEQ ID NO: 507616 - protein, 10 aa, Influenza virus
NSEMNKLYER

SEQ ID NO: 507617 - protein, 10 aa, Influenza virus
NSFEQITFIQ

SEQ ID NO: 507618 - protein, 10 aa, Influenza virus
NSFEQITFLQ

SEQ ID NO: 507619 - protein, 10 aa, Influenza virus
NSFEQITFMQ

SEQ ID NO: 507620 - protein, 10 aa, Influenza virus
NSFFSRLNWL

SEQ ID NO: 507621 - protein, 10 aa, Influenza virus
NSFLAHALKL

SEQ ID NO: 507622 - protein, 10 aa, Influenza virus
NSFLTHALRF

SEQ ID NO: 507623 - protein, 10 aa, Influenza virus
NSFLVHALKS

SEQ ID NO: 507624 - protein, 10 aa, Influenza virus
NSFSRTELIN

SEQ ID NO: 507625 - protein, 10 aa, Influenza virus
NSFSRTELIP

SEQ ID NO: 507626 - protein, 10 aa, Influenza virus
NSFSRTELIS

SEQ ID NO: 507627 - protein, 10 aa, Influenza virus
NSFVPVVGAR

SEQ ID NO: 507628 - protein, 10 aa, Influenza virus
NSFYAELKWL

SEQ ID NO: 507629 - protein, 10 aa, Influenza virus
NSGDYARLYI

SEQ ID NO: 507630 - protein, 10 aa, Influenza virus
NSGKVECVCR

SEQ ID NO: 507631 - protein, 10 aa, Influenza virus
NSGVKGWAFD

SEQ ID NO: 507632 - protein, 10 aa, Influenza virus
NSGVLVTREP

SEQ ID NO: 507633 - protein, 10 aa, Influenza virus
NSGYKDIILW

SEQ ID NO: 507634 - protein, 10 aa, Influenza virus
NSHYEECSCY

SEQ ID NO: 507635 - protein, 10 aa, Influenza virus
NSIAVFCGTS

SEQ ID NO: 507636 - protein, 10 aa, Influenza virus
NSIGNLIAPR

SEQ ID NO: 507637 - protein, 10 aa, Influenza virus
NSIIAFCGTS

SEQ ID NO: 507638 - protein, 10 aa, Influenza virus
NSIIDKMNTQ

SEQ ID NO: 507639 - protein, 10 aa, Influenza virus
NSIIEKMNTQ

SEQ ID NO: 507640 - protein, 10 aa, Influenza virus
NSIIGKMNTQ

SEQ ID NO: 507641 - protein, 10 aa, Influenza virus
NSIINKMNTQ

SEQ ID NO: 507642 - protein, 10 aa, Influenza virus
NSIISMCSST

SEQ ID NO: 507643 - protein, 10 aa, Influenza virus
NSIIVFCGTS

SEQ ID NO: 507644 - protein, 10 aa, Influenza virus
NSIRIGSKGD

SEQ ID NO: 507645 - protein, 10 aa, Influenza virus
NSIRIGSRGD

SEQ ID NO: 507646 - protein, 10 aa, Influenza virus
NSIRLAAGGD

SEQ ID NO: 507647 - protein, 10 aa, Influenza virus
NSIRLSADGD

SEQ ID NO: 507648 - protein, 10 aa, Influenza virus
NSIRLSAGGA

SEQ ID NO: 507649 - protein, 10 aa, Influenza virus
NSIRLSAGGD

SEQ ID NO: 507650 - protein, 10 aa, Influenza virus
NSIRLSAGGH

SEQ ID NO: 507651 - protein, 10 aa, Influenza virus
NSIRLSAGGN

SEQ ID NO: 507652 - protein, 10 aa, Influenza virus
NSIRLSASGD

SEQ ID NO: 507653 - protein, 10 aa, Influenza virus
NSIVAFCGTS

SEQ ID NO: 507654 - protein, 10 aa, Influenza virus
NSIVALCGSK

SEQ ID NO: 507655 - protein, 10 aa, Influenza virus
NSIVALCGSR

SEQ ID NO: 507656 - protein, 10 aa, Influenza virus
NSIVSMCSST

SEQ ID NO: 507657 - protein, 10 aa, Influenza virus
NSIVTFCGLD

SEQ ID NO: 507658 - protein, 10 aa, Influenza virus
NSIVTFCGLN

SEQ ID NO: 507659 - protein, 10 aa, Influenza virus
NSIVVFCGTP

SEQ ID NO: 507660 - protein, 10 aa, Influenza virus
NSIVVFCGTS

SEQ ID NO: 507661 - protein, 10 aa, Influenza virus
NSIVVFCSTS

SEQ ID NO: 507662 - protein, 10 aa, Influenza virus
NSIWTSSSST

SEQ ID NO: 507663 - protein, 10 aa, Influenza virus
NSIYASPQLE

SEQ ID NO: 507664 - protein, 10 aa, Influenza virus
NSKFESVAWS

SEQ ID NO: 507665 - protein, 10 aa, Influenza virus
NSLIALCGSP

SEQ ID NO: 507666 - protein, 10 aa, Influenza virus
NSLKLAIGLR

SEQ ID NO: 507667 - protein, 10 aa, Influenza virus
NSLVALCGSP

SEQ ID NO: 507668 - protein, 10 aa, Influenza virus
NSLYASPQLE

SEQ ID NO: 507669 - protein, 10 aa, Influenza virus
NSLYASSQLE

SEQ ID NO: 507670 - protein, 10 aa, Influenza virus
NSLYSSPQLE

SEQ ID NO: 507671 - protein, 10 aa, Influenza virus
NSMVTFCGLD

SEQ ID NO: 507672 - protein, 10 aa, Influenza virus
NSNAITRSGQ

SEQ ID NO: 507673 - protein, 10 aa, Influenza virus
NSNCKDPNNE

SEQ ID NO: 507674 - protein, 10 aa, Influenza virus
NSNCRDPNNE

SEQ ID NO: 507675 - protein, 10 aa, Influenza virus
NSNCRNPNNE

SEQ ID NO: 507676 - protein, 10 aa, Influenza virus
NSNGVQDIID

SEQ ID NO: 507677 - protein, 10 aa, Influenza virus
NSNLDYQIGY

SEQ ID NO: 507678 - protein, 10 aa, Influenza virus
NSNNGVKGFS

SEQ ID NO: 507679 - protein, 10 aa, Influenza virus
NSNWSGYSGI

SEQ ID NO: 507680 - protein, 10 aa, Influenza virus
NSNWSGYSGS

SEQ ID NO: 507681 - protein, 10 aa, Influenza virus
NSPGRVTVST

SEQ ID NO: 507682 - protein, 10 aa, Influenza virus
NSPLPFQNID

SEQ ID NO: 507683 - protein, 10 aa, Influenza virus
NSQASYKIFK

SEQ ID NO: 507684 - protein, 10 aa, Influenza virus
NSQDTEISFT

SEQ ID NO: 507685 - protein, 10 aa, Influenza virus
NSQDTELSFT

SEQ ID NO: 507686 - protein, 10 aa, Influenza virus
NSQDTEVSFT

SEQ ID NO: 507687 - protein, 10 aa, Influenza virus
NSQGEGTAAD

SEQ ID NO: 507688 - protein, 10 aa, Influenza virus
NSQGSGYAAD

SEQ ID NO: 507689 - protein, 10 aa, Influenza virus
NSRFESVAWS

SEQ ID NO: 507690 - protein, 10 aa, Influenza virus
NSSCAAMDDF

SEQ ID NO: 507691 - protein, 10 aa, Influenza virus
NSSDICYPGK

SEQ ID NO: 507692 - protein, 10 aa, Influenza virus
NSSDICYPGR

SEQ ID NO: 507693 - protein, 10 aa, Influenza virus
NSSDKVDTLL

SEQ ID NO: 507694 - protein, 10 aa, Influenza virus
NSSDTVDTLT

SEQ ID NO: 507695 - protein, 10 aa, Influenza virus
NSSEKVDTLL

SEQ ID NO: 507696 - protein, 10 aa, Influenza virus
NSSEKVNTLL

SEQ ID NO: 507697 - protein, 10 aa, Influenza virus
NSSERVDTLL

SEQ ID NO: 507698 - protein, 10 aa, Influenza virus
NSSILTDSQT

SEQ ID NO: 507699 - protein, 10 aa, Influenza virus
NSSKPFQNAS

SEQ ID NO: 507700 - protein, 10 aa, Influenza virus
NSSKPFQNTS

SEQ ID NO: 507701 - protein, 10 aa, Influenza virus
NSSKPLQNAS

SEQ ID NO: 507702 - protein, 10 aa, Influenza virus
NSSLTHALRE

SEQ ID NO: 507703 - protein, 10 aa, Influenza virus
NSSMPFHNIH

SEQ ID NO: 507704 - protein, 10 aa, Influenza virus
NSSMPFHNVH

SEQ ID NO: 507705 - protein, 10 aa, Influenza virus
NSSMPLHNIH

SEQ ID NO: 507706 - protein, 10 aa, Influenza virus
NSSMQCRICI

SEQ ID NO: 507707 - protein, 10 aa, Influenza virus
NSSRPFQNAS

SEQ ID NO: 507708 - protein, 10 aa, Influenza virus
NSSYVCSGLV

SEQ ID NO: 507709 - protein, 10 aa, Influenza virus
NSTCVVVMTD

SEQ ID NO: 507710 - protein, 10 aa, Influenza virus
NSTDKIDTLT

SEQ ID NO: 507711 - protein, 10 aa, Influenza virus
NSTDKVDTII

SEQ ID NO: 507712 - protein, 10 aa, Influenza virus
NSTDKVDTLT

SEQ ID NO: 507713 - protein, 10 aa, Influenza virus
NSTDKVNTII

SEQ ID NO: 507714 - protein, 10 aa, Influenza virus
NSTDTVDTIL

SEQ ID NO: 507715 - protein, 10 aa, Influenza virus
NSTDTVDTLI

SEQ ID NO: 507716 - protein, 10 aa, Influenza virus
NSTDTVDTLL

SEQ ID NO: 507717 - protein, 10 aa, Influenza virus
NSTDTVDTLT

SEQ ID NO: 507718 - protein, 10 aa, Influenza virus
NSTDTVDTVL

SEQ ID NO: 507719 - protein, 10 aa, Influenza virus
NSTDTVNTLI

SEQ ID NO: 507720 - protein, 10 aa, Influenza virus
NSTDTVNTLM

SEQ ID NO: 507721 - protein, 10 aa, Influenza virus
NSTDTVNTLT

SEQ ID NO: 507722 - protein, 10 aa, Influenza virus
NSTEHVDTIM

SEQ ID NO: 507723 - protein, 10 aa, Influenza virus
NSTEKVDTII

SEQ ID NO: 507724 - protein, 10 aa, Influenza virus
NSTEKVDTLL

SEQ ID NO: 507725 - protein, 10 aa, Influenza virus
NSTEQVDTIM

SEQ ID NO: 507726 - protein, 10 aa, Influenza virus
NSTERVDTII

SEQ ID NO: 507727 - protein, 10 aa, Influenza virus
NSTERVDTIM

SEQ ID NO: 507728 - protein, 10 aa, Influenza virus
NSTETVNTLI

SEQ ID NO: 507729 - protein, 10 aa, Influenza virus
NSTETVNTLS

SEQ ID NO: 507730 - protein, 10 aa, Influenza virus
NSTETVNTLT

SEQ ID NO: 507731 - protein, 10 aa, Influenza virus
NSTKQVDTIM

SEQ ID NO: 507732 - protein, 10 aa, Influenza virus
NSTNTVNTLI

SEQ ID NO: 507733 - protein, 10 aa, Influenza virus
NSTTHDRTAF

SEQ ID NO: 507734 - protein, 10 aa, Influenza virus
NSTVQVDTIM

SEQ ID NO: 507735 - protein, 10 aa, Influenza virus
NSTVVNNITT

SEQ ID NO: 507736 - protein, 10 aa, Influenza virus
NSTYKILSIY

SEQ ID NO: 507737 - protein, 10 aa, Influenza virus
NSVIEKINTQ

SEQ ID NO: 507738 - protein, 10 aa, Influenza virus
NSVIEKMNIQ

SEQ ID NO: 507739 - protein, 10 aa, Influenza virus
NSVIEKMNTQ

SEQ ID NO: 507740 - protein, 10 aa, Influenza virus
NSVKLFSGYK

SEQ ID NO: 507741 - protein, 10 aa, Influenza virus
NSVKLSSGYK

SEQ ID NO: 507742 - protein, 10 aa, Influenza virus
NSVRIGSKGD

SEQ ID NO: 507743 - protein, 10 aa, Influenza virus
NSVRLSAGGD

SEQ ID NO: 507744 - protein, 10 aa, Influenza virus
NSVVEKMNTQ

SEQ ID NO: 507745 - protein, 10 aa, Influenza virus
NSVVVFCGTS

SEQ ID NO: 507746 - protein, 10 aa, Influenza virus
NSWHIFGKDN

SEQ ID NO: 507747 - protein, 10 aa, Influenza virus
NSWHIFSKDN

SEQ ID NO: 507748 - protein, 10 aa, Influenza virus
NSWHILSKDN

SEQ ID NO: 507749 - protein, 10 aa, Influenza virus
NSWHIYGKDN

SEQ ID NO: 507750 - protein, 10 aa, Influenza virus
NSWLGRTISK

SEQ ID NO: 507751 - protein, 10 aa, Influenza virus
NSWLGRTTSK

SEQ ID NO: 507752 - protein, 10 aa, Influenza virus
NSWSYIVEKP

SEQ ID NO: 507753 - protein, 10 aa, Influenza virus
NTALLNASCA

SEQ ID NO: 507754 - protein, 10 aa, Influenza virus
NTALSTIALL

SEQ ID NO: 507755 - protein, 10 aa, Influenza virus
NTAMLNASCA

SEQ ID NO: 507756 - protein, 10 aa, Influenza virus
NTASRSGYEM

SEQ ID NO: 507757 - protein, 10 aa, Influenza virus
NTCIESIRNG

SEQ ID NO: 507758 - protein, 10 aa, Influenza virus
NTCMETIRNG

SEQ ID NO: 507759 - protein, 10 aa, Influenza virus
NTDLEALMEW

SEQ ID NO: 507760 - protein, 10 aa, Influenza virus
NTDLEVLMEW

SEQ ID NO: 507761 - protein, 10 aa, Influenza virus
NTDLGAPLEL

SEQ ID NO: 507762 - protein, 10 aa, Influenza virus
NTDLGSPLEL

SEQ ID NO: 507763 - protein, 10 aa, Influenza virus
NTDLGTPLEL

SEQ ID NO: 507764 - protein, 10 aa, Influenza virus
NTDWSGYSGS

SEQ ID NO: 507765 - protein, 10 aa, Influenza virus
NTEFESIESE

SEQ ID NO: 507766 - protein, 10 aa, Influenza virus
NTELLVLMEN

SEQ ID NO: 507767 - protein, 10 aa, Influenza virus
NTEPLCDVSG

SEQ ID NO: 507768 - protein, 10 aa, Influenza virus
NTEPLCEVSG

SEQ ID NO: 507769 - protein, 10 aa, Influenza virus
NTEPLCNVSG

SEQ ID NO: 507770 - protein, 10 aa, Influenza virus
NTFGDCPKYV

SEQ ID NO: 507771 - protein, 10 aa, Influenza virus
NTGSYVRLYL

SEQ ID NO: 507772 - protein, 10 aa, Influenza virus
NTIDLTDSEM

SEQ ID NO: 507773 - protein, 10 aa, Influenza virus
NTIGDCPKYM

SEQ ID NO: 507774 - protein, 10 aa, Influenza virus
NTIGDCPKYV

SEQ ID NO: 507775 - protein, 10 aa, Influenza virus
NTIGNCPKYV

SEQ ID NO: 507776 - protein, 10 aa, Influenza virus
NTIGNLIAPR

SEQ ID NO: 507777 - protein, 10 aa, Influenza virus
NTIGNLVAPR

SEQ ID NO: 507778 - protein, 10 aa, Influenza virus
NTIIENNVTV

SEQ ID NO: 507779 - protein, 10 aa, Influenza virus
NTIIESNVTV

SEQ ID NO: 507780 - protein, 10 aa, Influenza virus
NTILEKNVTV

SEQ ID NO: 507781 - protein, 10 aa, Influenza virus
NTILSTKALL

SEQ ID NO: 507782 - protein, 10 aa, Influenza virus
NTINRIFQPN

SEQ ID NO: 507783 - protein, 10 aa, Influenza virus
NTINRNFQPN

SEQ ID NO: 507784 - protein, 10 aa, Influenza virus
NTINRSFQPN

SEQ ID NO: 507785 - protein, 10 aa, Influenza virus
NTINRSFRPN

SEQ ID NO: 507786 - protein, 10 aa, Influenza virus
NTINSKIDDQ

SEQ ID NO: 507787 - protein, 10 aa, Influenza virus
NTKCQTSLGG

SEQ ID NO: 507788 - protein, 10 aa, Influenza virus
NTKCQTSMGG

SEQ ID NO: 507789 - protein, 10 aa, Influenza virus
NTKCQTSVGG

SEQ ID NO: 507790 - protein, 10 aa, Influenza virus
NTKCQTYAGA

SEQ ID NO: 507791 - protein, 10 aa, Influenza virus
NTKLPFQNLS

SEQ ID NO: 507792 - protein, 10 aa, Influenza virus
NTKWNENQNP

SEQ ID NO: 507793 - protein, 10 aa, Influenza virus
NTLAERGVEV

SEQ ID NO: 507794 - protein, 10 aa, Influenza virus
NTLIEQNIPV

SEQ ID NO: 507795 - protein, 10 aa, Influenza virus
NTLIEQNVPV

SEQ ID NO: 507796 - protein, 10 aa, Influenza virus
NTLKLATGMR

SEQ ID NO: 507797 - protein, 10 aa, Influenza virus
NTLLENDVPV

SEQ ID NO: 507798 - protein, 10 aa, Influenza virus
NTLRTQESEC

SEQ ID NO: 507799 - protein, 10 aa, Influenza virus
NTLSEQNVPV

SEQ ID NO: 507800 - protein, 10 aa, Influenza virus
NTLSSVNTNT

SEQ ID NO: 507801 - protein, 10 aa, Influenza virus
NTLSSVTTNT

SEQ ID NO: 507802 - protein, 10 aa, Influenza virus
NTLTEKGIEV

SEQ ID NO: 507803 - protein, 10 aa, Influenza virus
NTLTEKGVEV

SEQ ID NO: 507804 - protein, 10 aa, Influenza virus
NTLTEQNVPV

SEQ ID NO: 507805 - protein, 10 aa, Influenza virus
NTLTEREVEV

SEQ ID NO: 507806 - protein, 10 aa, Influenza virus
NTLTERGIEV

SEQ ID NO: 507807 - protein, 10 aa, Influenza virus
NTLTERGVEV

SEQ ID NO: 507808 - protein, 10 aa, Influenza virus
NTLTSVTTNT

SEQ ID NO: 507809 - protein, 10 aa, Influenza virus
NTMHQLLRHF

SEQ ID NO: 507810 - protein, 10 aa, Influenza virus
NTMTKDAERG

SEQ ID NO: 507811 - protein, 10 aa, Influenza virus
NTNGEQILII

SEQ ID NO: 507812 - protein, 10 aa, Influenza virus
NTNKTFQNID

SEQ ID NO: 507813 - protein, 10 aa, Influenza virus
NTNKTFQNIE

SEQ ID NO: 507814 - protein, 10 aa, Influenza virus
NTNRTFQNID

SEQ ID NO: 507815 - protein, 10 aa, Influenza virus
NTNTINRSFQ

SEQ ID NO: 507816 - protein, 10 aa, Influenza virus
NTNTLSSVTT

SEQ ID NO: 507817 - protein, 10 aa, Influenza virus
NTPSIDPKGL

SEQ ID NO: 507818 - protein, 10 aa, Influenza virus
NTPSIEPKGL

SEQ ID NO: 507819 - protein, 10 aa, Influenza virus
NTPSIEPRGL

SEQ ID NO: 507820 - protein, 10 aa, Influenza virus
NTPSVEPKGL

SEQ ID NO: 507821 - protein, 10 aa, Influenza virus
NTPSVEPRGL

SEQ ID NO: 507822 - protein, 10 aa, Influenza virus
NTQFEAIGRE

SEQ ID NO: 507823 - protein, 10 aa, Influenza virus
NTQFEAVGKE

SEQ ID NO: 507824 - protein, 10 aa, Influenza virus
NTQFEAVGRE

SEQ ID NO: 507825 - protein, 10 aa, Influenza virus
NTQFELIDNE

SEQ ID NO: 507826 - protein, 10 aa, Influenza virus
NTQFETVGKE

SEQ ID NO: 507827 - protein, 10 aa, Influenza virus
NTQFTAVGKE

SEQ ID NO: 507828 - protein, 10 aa, Influenza virus
NTQFTSVGKE

SEQ ID NO: 507829 - protein, 10 aa, Influenza virus
NTQFTVVGKE

SEQ ID NO: 507830 - protein, 10 aa, Influenza virus
NTQGEGTAAD

SEQ ID NO: 507831 - protein, 10 aa, Influenza virus
NTQIIVILVL

SEQ ID NO: 507832 - protein, 10 aa, Influenza virus
NTRCQTSVGG

SEQ ID NO: 507833 - protein, 10 aa, Influenza virus
NTRKEPALIV

SEQ ID NO: 507834 - protein, 10 aa, Influenza virus
NTRLPFQNLS

SEQ ID NO: 507835 - protein, 10 aa, Influenza virus
NTSGEQMLII

SEQ ID NO: 507836 - protein, 10 aa, Influenza virus
NTSGEQMLVI

SEQ ID NO: 507837 - protein, 10 aa, Influenza virus
NTSGEQVLVI

SEQ ID NO: 507838 - protein, 10 aa, Influenza virus
NTSKHYIGKC

SEQ ID NO: 507839 - protein, 10 aa, Influenza virus
NTSKPFQNIC

SEQ ID NO: 507840 - protein, 10 aa, Influenza virus
NTSKPFQNTS

SEQ ID NO: 507841 - protein, 10 aa, Influenza virus
NTSKPLQNTS

SEQ ID NO: 507842 - protein, 10 aa, Influenza virus
NTSQRGILED

SEQ ID NO: 507843 - protein, 10 aa, Influenza virus
NTSQRGVLED

SEQ ID NO: 507844 - protein, 10 aa, Influenza virus
NTSRHYIGKC

SEQ ID NO: 507845 - protein, 10 aa, Influenza virus
NTSRHYMGEC

SEQ ID NO: 507846 - protein, 10 aa, Influenza virus
NTSYKILSIY

SEQ ID NO: 507847 - protein, 10 aa, Influenza virus
NTTGRDVLVI

SEQ ID NO: 507848 - protein, 10 aa, Influenza virus
NTTGRDVLVL

SEQ ID NO: 507849 - protein, 10 aa, Influenza virus
NTTGRDVLVM

SEQ ID NO: 507850 - protein, 10 aa, Influenza virus
NTTLIENTYV

SEQ ID NO: 507851 - protein, 10 aa, Influenza virus
NTTLPFHNIH

SEQ ID NO: 507852 - protein, 10 aa, Influenza virus
NTTLPFHNVH

SEQ ID NO: 507853 - protein, 10 aa, Influenza virus
NTTLSTIALF

SEQ ID NO: 507854 - protein, 10 aa, Influenza virus
NTTLSTIALI

SEQ ID NO: 507855 - protein, 10 aa, Influenza virus
NTTLSTIALL

SEQ ID NO: 507856 - protein, 10 aa, Influenza virus
NTTNYYNETF

SEQ ID NO: 507857 - protein, 10 aa, Influenza virus
NTTVVENTYV

SEQ ID NO: 507858 - protein, 10 aa, Influenza virus
NTTYKILSIY

SEQ ID NO: 507859 - protein, 10 aa, Influenza virus
NTTYRILSIY

SEQ ID NO: 507860 - protein, 10 aa, Influenza virus
NTVINNITTT

SEQ ID NO: 507861 - protein, 10 aa, Influenza virus
NTVKDRSPYR

SEQ ID NO: 507862 - protein, 10 aa, Influenza virus
NTVVNNITTT

SEQ ID NO: 507863 - protein, 10 aa, Influenza virus
NTWARNILRT

SEQ ID NO: 507864 - protein, 10 aa, Influenza virus
NTWLGRTFSP

SEQ ID NO: 507865 - protein, 10 aa, Influenza virus
NTWLGRTISI

SEQ ID NO: 507866 - protein, 10 aa, Influenza virus
NTWLGRTISP

SEQ ID NO: 507867 - protein, 10 aa, Influenza virus
NTWLGRTIST

SEQ ID NO: 507868 - protein, 10 aa, Influenza virus
NTWLGRTLNT

SEQ ID NO: 507869 - protein, 10 aa, Influenza virus
NTWVGRTISI

SEQ ID NO: 507870 - protein, 10 aa, Influenza virus
NTYDHAQYRE

SEQ ID NO: 507871 - protein, 10 aa, Influenza virus
NTYDHSHYRE

SEQ ID NO: 507872 - protein, 10 aa, Influenza virus
NTYDHSQYRE

SEQ ID NO: 507873 - protein, 10 aa, Influenza virus
NTYDHTQYRE

SEQ ID NO: 507874 - protein, 10 aa, Influenza virus
NTYINNATII

SEQ ID NO: 507875 - protein, 10 aa, Influenza virus
NTYINNTTII

SEQ ID NO: 507876 - protein, 10 aa, Influenza virus
NTYNHTEYRQ

SEQ ID NO: 507877 - protein, 10 aa, Influenza virus
NTYNHTQYRE

SEQ ID NO: 507878 - protein, 10 aa, Influenza virus
NTYQWIIKNW

SEQ ID NO: 507879 - protein, 10 aa, Influenza virus
NTYQWIIRNW

SEQ ID NO: 507880 - protein, 10 aa, Influenza virus
NTYQWVIRNW

SEQ ID NO: 507881 - protein, 10 aa, Influenza virus
NTYVNKTTVI

SEQ ID NO: 507882 - protein, 10 aa, Influenza virus
NTYVNNTTII

SEQ ID NO: 507883 - protein, 10 aa, Influenza virus
NTYVNNTTVI

SEQ ID NO: 507884 - protein, 10 aa, Influenza virus
NVECVCRDNW

SEQ ID NO: 507885 - protein, 10 aa, Influenza virus
NVEGWVVIAK

SEQ ID NO: 507886 - protein, 10 aa, Influenza virus
NVELLVLMEN

SEQ ID NO: 507887 - protein, 10 aa, Influenza virus
NVENLFDEVR

SEQ ID NO: 507888 - protein, 10 aa, Influenza virus
NVESNGNLIA

SEQ ID NO: 507889 - protein, 10 aa, Influenza virus
NVESNGNLVA

SEQ ID NO: 507890 - protein, 10 aa, Influenza virus
NVGLNISLHL

SEQ ID NO: 507891 - protein, 10 aa, Influenza virus
NVGLNMSLHL

SEQ ID NO: 507892 - protein, 10 aa, Influenza virus
NVGLNVSLHL

SEQ ID NO: 507893 - protein, 10 aa, Influenza virus
NVGYLCAGIP

SEQ ID NO: 507894 - protein, 10 aa, Influenza virus
NVHPLAIGEC

SEQ ID NO: 507895 - protein, 10 aa, Influenza virus
NVHPLTIGEC

SEQ ID NO: 507896 - protein, 10 aa, Influenza virus
NVHRNAIGDC

SEQ ID NO: 507897 - protein, 10 aa, Influenza virus
NVHRNTIGDC

SEQ ID NO: 507898 - protein, 10 aa, Influenza virus
NVHRNTIGNC

SEQ ID NO: 507899 - protein, 10 aa, Influenza virus
NVHRSTIGDC

SEQ ID NO: 507900 - protein, 10 aa, Influenza virus
NVIDKMNKQF

SEQ ID NO: 507901 - protein, 10 aa, Influenza virus
NVIDKMNKQL

SEQ ID NO: 507902 - protein, 10 aa, Influenza virus
NVIDKMNNQF

SEQ ID NO: 507903 - protein, 10 aa, Influenza virus
NVIDKMYKQF

SEQ ID NO: 507904 - protein, 10 aa, Influenza virus
NVILWFSFGA

SEQ ID NO: 507905 - protein, 10 aa, Influenza virus
NVINDKIDDQ

SEQ ID NO: 507906 - protein, 10 aa, Influenza virus
NVINWTKDSI

SEQ ID NO: 507907 - protein, 10 aa, Influenza virus
NVINWTQDAM

SEQ ID NO: 507908 - protein, 10 aa, Influenza virus
NVINWTRDAM

SEQ ID NO: 507909 - protein, 10 aa, Influenza virus
NVINWTRDSI

SEQ ID NO: 507910 - protein, 10 aa, Influenza virus
NVINWTRDSL

SEQ ID NO: 507911 - protein, 10 aa, Influenza virus
NVINWTRDSM

SEQ ID NO: 507912 - protein, 10 aa, Influenza virus
NVINWTRDSV

SEQ ID NO: 507913 - protein, 10 aa, Influenza virus
NVKELGNGCF

SEQ ID NO: 507914 - protein, 10 aa, Influenza virus
NVKNLFDEVK

SEQ ID NO: 507915 - protein, 10 aa, Influenza virus
NVKNLFDEVR

SEQ ID NO: 507916 - protein, 10 aa, Influenza virus
NVKNLHDQIK

SEQ ID NO: 507917 - protein, 10 aa, Influenza virus
NVKNLHEQVK

SEQ ID NO: 507918 - protein, 10 aa, Influenza virus
NVKNLHEQVR

SEQ ID NO: 507919 - protein, 10 aa, Influenza virus
NVKNLYDKVR

SEQ ID NO: 507920 - protein, 10 aa, Influenza virus
NVKNLYDRVR

SEQ ID NO: 507921 - protein, 10 aa, Influenza virus
NVKNLYEKVR

SEQ ID NO: 507922 - protein, 10 aa, Influenza virus
NVKNLYNKVR

SEQ ID NO: 507923 - protein, 10 aa, Influenza virus
NVKSLKLAIG

SEQ ID NO: 507924 - protein, 10 aa, Influenza virus
NVKSLKLASG

SEQ ID NO: 507925 - protein, 10 aa, Influenza virus
NVKSLKLATG

SEQ ID NO: 507926 - protein, 10 aa, Influenza virus
NVLDGVTASC

SEQ ID NO: 507927 - protein, 10 aa, Influenza virus
NVLIGQGDIV

SEQ ID NO: 507928 - protein, 10 aa, Influenza virus
NVLIGQGDVV

SEQ ID NO: 507929 - protein, 10 aa, Influenza virus
NVLLKHRFEI

SEQ ID NO: 507930 - protein, 10 aa, Influenza virus
NVLLSPEEVS

SEQ ID NO: 507931 - protein, 10 aa, Influenza virus
NVLRTQESEC

SEQ ID NO: 507932 - protein, 10 aa, Influenza virus
NVLSIAPIMF

SEQ ID NO: 507933 - protein, 10 aa, Influenza virus
NVLSVAPIMF

SEQ ID NO: 507934 - protein, 10 aa, Influenza virus
NVNKITYGAC

SEQ ID NO: 507935 - protein, 10 aa, Influenza virus
NVNRITYGAC

SEQ ID NO: 507936 - protein, 10 aa, Influenza virus
NVNRITYGPC

SEQ ID NO: 507937 - protein, 10 aa, Influenza virus
NVNRITYGVC

SEQ ID NO: 507938 - protein, 10 aa, Influenza virus
NVPEKIHTRG

SEQ ID NO: 507939 - protein, 10 aa, Influenza virus
NVPEKIRTRG

SEQ ID NO: 507940 - protein, 10 aa, Influenza virus
NVPEKIRVKR

SEQ ID NO: 507941 - protein, 10 aa, Influenza virus
NVPEWSYIVE

SEQ ID NO: 507942 - protein, 10 aa, Influenza virus
NVPQAQDRGL

SEQ ID NO: 507943 - protein, 10 aa, Influenza virus
NVPQAQNRGL

SEQ ID NO: 507944 - protein, 10 aa, Influenza virus
NVPQIEPRGL

SEQ ID NO: 507945 - protein, 10 aa, Influenza virus
NVPQIESRGL

SEQ ID NO: 507946 - protein, 10 aa, Influenza virus
NVPQIQNRGL

SEQ ID NO: 507947 - protein, 10 aa, Influenza virus
NVPQMESRGL

SEQ ID NO: 507948 - protein, 10 aa, Influenza virus
NVPQVQDRGL

SEQ ID NO: 507949 - protein, 10 aa, Influenza virus
NVPQVQNRGL

SEQ ID NO: 507950 - protein, 10 aa, Influenza virus
NVPSIQSRGL

SEQ ID NO: 507951 - protein, 10 aa, Influenza virus
NVPVTQAMEL

SEQ ID NO: 507952 - protein, 10 aa, Influenza virus
NVPVTQTMEL

SEQ ID NO: 507953 - protein, 10 aa, Influenza virus
NVPVTQVEEL

SEQ ID NO: 507954 - protein, 10 aa, Influenza virus
NVRCVCRDNW

SEQ ID NO: 507955 - protein, 10 aa, Influenza virus
NVRGSGLRIL

SEQ ID NO: 507956 - protein, 10 aa, Influenza virus
NVRGSGMRIL

SEQ ID NO: 507957 - protein, 10 aa, Influenza virus
NVRGSGMRVL

SEQ ID NO: 507958 - protein, 10 aa, Influenza virus
NVRGTGMRIL

SEQ ID NO: 507959 - protein, 10 aa, Influenza virus
NVRNLHDQIK

SEQ ID NO: 507960 - protein, 10 aa, Influenza virus
NVRNLHDQIR

SEQ ID NO: 507961 - protein, 10 aa, Influenza virus
NVRNLHDQVK

SEQ ID NO: 507962 - protein, 10 aa, Influenza virus
NVRNLHDQVR

SEQ ID NO: 507963 - protein, 10 aa, Influenza virus
NVRNLHDRIR

SEQ ID NO: 507964 - protein, 10 aa, Influenza virus
NVRNLHDRTR

SEQ ID NO: 507965 - protein, 10 aa, Influenza virus
NVRNLHDRVK

SEQ ID NO: 507966 - protein, 10 aa, Influenza virus
NVRNLHDRVR

SEQ ID NO: 507967 - protein, 10 aa, Influenza virus
NVRNLHEQIK

SEQ ID NO: 507968 - protein, 10 aa, Influenza virus
NVRNLHEQVR

SEQ ID NO: 507969 - protein, 10 aa, Influenza virus
NVRNLHERIR

SEQ ID NO: 507970 - protein, 10 aa, Influenza virus
NVRNLYDKVR

SEQ ID NO: 507971 - protein, 10 aa, Influenza virus
NVRSLKLATG

SEQ ID NO: 507972 - protein, 10 aa, Influenza virus
NVSEWSYIVE

SEQ ID NO: 507973 - protein, 10 aa, Influenza virus
NVSRIAIGNC

SEQ ID NO: 507974 - protein, 10 aa, Influenza virus
NVSSSGTSKA

SEQ ID NO: 507975 - protein, 10 aa, Influenza virus
NVSWTSNSIV

SEQ ID NO: 507976 - protein, 10 aa, Influenza virus
NVTETLYLNH

SEQ ID NO: 507977 - protein, 10 aa, Influenza virus
NVTHTGTSKA

SEQ ID NO: 507978 - protein, 10 aa, Influenza virus
NVTHVQNNYT

SEQ ID NO: 507979 - protein, 10 aa, Influenza virus
NVTKENTGSY

SEQ ID NO: 507980 - protein, 10 aa, Influenza virus
NVTNVQNDYT

SEQ ID NO: 507981 - protein, 10 aa, Influenza virus
NVTNVQNNYT

SEQ ID NO: 507982 - protein, 10 aa, Influenza virus
NVTRSGTSKA

SEQ ID NO: 507983 - protein, 10 aa, Influenza virus
NVTSSGTSKA

SEQ ID NO: 507984 - protein, 10 aa, Influenza virus
NVTVTHAKDI

SEQ ID NO: 507985 - protein, 10 aa, Influenza virus
NVTVTHAKNI

SEQ ID NO: 507986 - protein, 10 aa, Influenza virus
NVTVTHAQDI

SEQ ID NO: 507987 - protein, 10 aa, Influenza virus
NVTVTHAQDL

SEQ ID NO: 507988 - protein, 10 aa, Influenza virus
NVTVTHAQNI

SEQ ID NO: 507989 - protein, 10 aa, Influenza virus
NVTVTHAVNL

SEQ ID NO: 507990 - protein, 10 aa, Influenza virus
NVTVTHSIEL

SEQ ID NO: 507991 - protein, 10 aa, Influenza virus
NVTVTHSINL

SEQ ID NO: 507992 - protein, 10 aa, Influenza virus
NVTVTHSVDL

SEQ ID NO: 507993 - protein, 10 aa, Influenza virus
NVTVTHSVEL

SEQ ID NO: 507994 - protein, 10 aa, Influenza virus
NVTVTHSVNI

SEQ ID NO: 507995 - protein, 10 aa, Influenza virus
NVTVTHSVNL

SEQ ID NO: 507996 - protein, 10 aa, Influenza virus
NVTVTSSIEL

SEQ ID NO: 507997 - protein, 10 aa, Influenza virus
NVTVTSSVEL

SEQ ID NO: 507998 - protein, 10 aa, Influenza virus
NVTYTGISKA

SEQ ID NO: 507999 - protein, 10 aa, Influenza virus
NVTYTGTSKA

SEQ ID NO: 508000 - protein, 10 aa, Influenza virus
NVTYTGTSRA

SEQ ID NO: 508001 - protein, 10 aa, Influenza virus
NVVLNVSLHL

SEQ ID NO: 508002 - protein, 10 aa, Influenza virus
NVVRKMMTNS

SEQ ID NO: 508003 - protein, 10 aa, Influenza virus
NVVRKMMTSS

SEQ ID NO: 508004 - protein, 10 aa, Influenza virus
NVWTYNAELL

SEQ ID NO: 508005 - protein, 10 aa, Influenza virus
NVYKALSIYS

SEQ ID NO: 508006 - protein, 10 aa, Influenza virus
NVYKILSIYS

SEQ ID NO: 508007 - protein, 10 aa, Influenza virus
NVYKVLAIYS

SEQ ID NO: 508008 - protein, 10 aa, Influenza virus
NVYKVLSIYS

SEQ ID NO: 508009 - protein, 10 aa, Influenza virus
NVYQAKFEAV

SEQ ID NO: 508010 - protein, 10 aa, Influenza virus
NVYQAKFESV

SEQ ID NO: 508011 - protein, 10 aa, Influenza virus
NVYQARFEAV

SEQ ID NO: 508012 - protein, 10 aa, Influenza virus
NVYQARFESV

SEQ ID NO: 508013 - protein, 10 aa, Influenza virus
NVYQSRFEAV

SEQ ID NO: 508014 - protein, 10 aa, Influenza virus
NVYRALSIYS

SEQ ID NO: 508015 - protein, 10 aa, Influenza virus
NWFGYFGIFF

SEQ ID NO: 508016 - protein, 10 aa, Influenza virus
NWHASNRPWI

SEQ ID NO: 508017 - protein, 10 aa, Influenza virus
NWHASNRPWV

SEQ ID NO: 508018 - protein, 10 aa, Influenza virus
NWHGANRPWV

SEQ ID NO: 508019 - protein, 10 aa, Influenza virus
NWHGSNRPWI

SEQ ID NO: 508020 - protein, 10 aa, Influenza virus
NWHGSNRPWL

SEQ ID NO: 508021 - protein, 10 aa, Influenza virus
NWHGSNRPWV

SEQ ID NO: 508022 - protein, 10 aa, Influenza virus
NWILWISFAI

SEQ ID NO: 508023 - protein, 10 aa, Influenza virus
NWKGANRPII

SEQ ID NO: 508024 - protein, 10 aa, Influenza virus
NWKGANRPVI

SEQ ID NO: 508025 - protein, 10 aa, Influenza virus
NWKGSNRPII

SEQ ID NO: 508026 - protein, 10 aa, Influenza virus
NWKGSNRPIV

SEQ ID NO: 508027 - protein, 10 aa, Influenza virus
NWKGSNRPVI

SEQ ID NO: 508028 - protein, 10 aa, Influenza virus
NWKGSNRPVV

SEQ ID NO: 508029 - protein, 10 aa, Influenza virus
NWKGSNRPWI

SEQ ID NO: 508030 - protein, 10 aa, Influenza virus
NWKGSNRPWM

SEQ ID NO: 508031 - protein, 10 aa, Influenza virus
NWKGSNRPWV

SEQ ID NO: 508032 - protein, 10 aa, Influenza virus
NWLTIGISGP

SEQ ID NO: 508033 - protein, 10 aa, Influenza virus
NWLTKATNGN

SEQ ID NO: 508034 - protein, 10 aa, Influenza virus
NWLTKETNGN

SEQ ID NO: 508035 - protein, 10 aa, Influenza virus
NWLTKKEPDT

SEQ ID NO: 508036 - protein, 10 aa, Influenza virus
NWLTKKKNPE

SEQ ID NO: 508037 - protein, 10 aa, Influenza virus
NWLTKKKPDI

SEQ ID NO: 508038 - protein, 10 aa, Influenza virus
NWLTKKKPDT

SEQ ID NO: 508039 - protein, 10 aa, Influenza virus
NWNGMNRPIL

SEQ ID NO: 508040 - protein, 10 aa, Influenza virus
NWNGMNRPVL

SEQ ID NO: 508041 - protein, 10 aa, Influenza virus
NWPDGAEIEY

SEQ ID NO: 508042 - protein, 10 aa, Influenza virus
NWPDGAKIEY

SEQ ID NO: 508043 - protein, 10 aa, Influenza virus
NWPDGSDIGF

SEQ ID NO: 508044 - protein, 10 aa, Influenza virus
NWPDGSNIGF

SEQ ID NO: 508045 - protein, 10 aa, Influenza virus
NWPSSSGGLE

SEQ ID NO: 508046 - protein, 10 aa, Influenza virus
NWQGANRPII

SEQ ID NO: 508047 - protein, 10 aa, Influenza virus
NWQGANRPVI

SEQ ID NO: 508048 - protein, 10 aa, Influenza virus
NWQGSNRPVI

SEQ ID NO: 508049 - protein, 10 aa, Influenza virus
NWRGANRPVI

SEQ ID NO: 508050 - protein, 10 aa, Influenza virus
NWRGSNRPIV

SEQ ID NO: 508051 - protein, 10 aa, Influenza virus
NWRGSNRPWI

SEQ ID NO: 508052 - protein, 10 aa, Influenza virus
NWRGSNRPWV

SEQ ID NO: 508053 - protein, 10 aa, Influenza virus
NWSGYSGAFI

SEQ ID NO: 508054 - protein, 10 aa, Influenza virus
NWSGYSGAFM

SEQ ID NO: 508055 - protein, 10 aa, Influenza virus
NWSGYSGAFT

SEQ ID NO: 508056 - protein, 10 aa, Influenza virus
NWSGYSGAFV

SEQ ID NO: 508057 - protein, 10 aa, Influenza virus
NWSGYSGIFS

SEQ ID NO: 508058 - protein, 10 aa, Influenza virus
NWSGYSGSFI

SEQ ID NO: 508059 - protein, 10 aa, Influenza virus
NWSGYSGSFS

SEQ ID NO: 508060 - protein, 10 aa, Influenza virus
NWSGYSGSFT

SEQ ID NO: 508061 - protein, 10 aa, Influenza virus
NWSGYSGVFS

SEQ ID NO: 508062 - protein, 10 aa, Influenza virus
NWSWHDGAIL

SEQ ID NO: 508063 - protein, 10 aa, Influenza virus
NWTGTNRPIL

SEQ ID NO: 508064 - protein, 10 aa, Influenza virus
NWTGTNRPVL

SEQ ID NO: 508065 - protein, 10 aa, Influenza virus
NWTKDSITDI

SEQ ID NO: 508066 - protein, 10 aa, Influenza virus
NWTQDAMTEV

SEQ ID NO: 508067 - protein, 10 aa, Influenza virus
NWTRDAMTEI

SEQ ID NO: 508068 - protein, 10 aa, Influenza virus
NWTRDAMTEV

SEQ ID NO: 508069 - protein, 10 aa, Influenza virus
NWTRDSITEL

SEQ ID NO: 508070 - protein, 10 aa, Influenza virus
NWTRDSITEV

SEQ ID NO: 508071 - protein, 10 aa, Influenza virus
NWTRDSLTEI

SEQ ID NO: 508072 - protein, 10 aa, Influenza virus
NWTRDSMTEI

SEQ ID NO: 508073 - protein, 10 aa, Influenza virus
NWTRDSMTEV

SEQ ID NO: 508074 - protein, 10 aa, Influenza virus
NWTRDSVTEL

SEQ ID NO: 508075 - protein, 10 aa, Influenza virus
NYARLYIWGV

SEQ ID NO: 508076 - protein, 10 aa, Influenza virus
NYDSIRGEFN

SEQ ID NO: 508077 - protein, 10 aa, Influenza virus
NYDSIRGEFS

SEQ ID NO: 508078 - protein, 10 aa, Influenza virus
NYEELKHLLS

SEQ ID NO: 508079 - protein, 10 aa, Influenza virus
NYEELREHLS

SEQ ID NO: 508080 - protein, 10 aa, Influenza virus
NYEELREQLS

SEQ ID NO: 508081 - protein, 10 aa, Influenza virus
NYGPINVTKE

SEQ ID NO: 508082 - protein, 10 aa, Influenza virus
NYGVKGFGFR

SEQ ID NO: 508083 - protein, 10 aa, Influenza virus
NYHQSFVPSP

SEQ ID NO: 508084 - protein, 10 aa, Influenza virus
NYHYEECSCY

SEQ ID NO: 508085 - protein, 10 aa, Influenza virus
NYKEICIAWS

SEQ ID NO: 508086 - protein, 10 aa, Influenza virus
NYKEICVAWS

SEQ ID NO: 508087 - protein, 10 aa, Influenza virus
NYKEIRIAWS

SEQ ID NO: 508088 - protein, 10 aa, Influenza virus
NYKEMCAAWS

SEQ ID NO: 508089 - protein, 10 aa, Influenza virus
NYLIRALTLN

SEQ ID NO: 508090 - protein, 10 aa, Influenza virus
NYLLLNKSLC

SEQ ID NO: 508091 - protein, 10 aa, Influenza virus
NYLMLNKSLC

SEQ ID NO: 508092 - protein, 10 aa, Influenza virus
NYPKYEEESR

SEQ ID NO: 508093 - protein, 10 aa, Influenza virus
NYQQSFVPSP

SEQ ID NO: 508094 - protein, 10 aa, Influenza virus
NYQSLRSILA

SEQ ID NO: 508095 - protein, 10 aa, Influenza virus
NYREICIAWS

SEQ ID NO: 508096 - protein, 10 aa, Influenza virus
NYVCSGLVGD

SEQ ID NO: 508097 - protein, 10 aa, Influenza virus
NYVSMEFSLT

SEQ ID NO: 508098 - protein, 10 aa, Influenza virus
NYYNETFVNI

SEQ ID NO: 508099 - protein, 10 aa, Influenza virus
NYYNETFVNV

SEQ ID NO: 508100 - protein, 10 aa, Influenza virus
NYYYEECSCY

SEQ ID NO: 508101 - protein, 10 aa, Influenza virus
PAANNADHRI

SEQ ID NO: 508102 - protein, 10 aa, Influenza virus
PAANSADHRI

SEQ ID NO: 508103 - protein, 10 aa, Influenza virus
PAANSADHRV

SEQ ID NO: 508104 - protein, 10 aa, Influenza virus
PAANSAHHRV

SEQ ID NO: 508105 - protein, 10 aa, Influenza virus
PAAPHGLCYP

SEQ ID NO: 508106 - protein, 10 aa, Influenza virus
PAATALANTI

SEQ ID NO: 508107 - protein, 10 aa, Influenza virus
PADNKADHRI

SEQ ID NO: 508108 - protein, 10 aa, Influenza virus
PAECRTFFLT

SEQ ID NO: 508109 - protein, 10 aa, Influenza virus
PAFSVQRNLP

SEQ ID NO: 508110 - protein, 10 aa, Influenza virus
PAHKSQLIWM

SEQ ID NO: 508111 - protein, 10 aa, Influenza virus
PAHKSQLVWM

SEQ ID NO: 508112 - protein, 10 aa, Influenza virus
PAKLLKERGF

SEQ ID NO: 508113 - protein, 10 aa, Influenza virus
PALIIWGIHH

SEQ ID NO: 508114 - protein, 10 aa, Influenza virus
PALIIWGVHH

SEQ ID NO: 508115 - protein, 10 aa, Influenza virus
PALITWGIHH

SEQ ID NO: 508116 - protein, 10 aa, Influenza virus
PALIVWGIHH

SEQ ID NO: 508117 - protein, 10 aa, Influenza virus
PALIVWGVHH

SEQ ID NO: 508118 - protein, 10 aa, Influenza virus
PALRMKWMMA

SEQ ID NO: 508119 - protein, 10 aa, Influenza virus
PANKQASYKI

SEQ ID NO: 508120 - protein, 10 aa, Influenza virus
PANNQASYKI

SEQ ID NO: 508121 - protein, 10 aa, Influenza virus
PANNQASYRI

SEQ ID NO: 508122 - protein, 10 aa, Influenza virus
PANSQASYKI

SEQ ID NO: 508123 - protein, 10 aa, Influenza virus
PAQNAISITF

SEQ ID NO: 508124 - protein, 10 aa, Influenza virus
PAQNAISTTF

SEQ ID NO: 508125 - protein, 10 aa, Influenza virus
PASNQASYKI

SEQ ID NO: 508126 - protein, 10 aa, Influenza virus
PASRYLIDMT

SEQ ID NO: 508127 - protein, 10 aa, Influenza virus
PASRYLTDMT

SEQ ID NO: 508128 - protein, 10 aa, Influenza virus
PATAQMALQL

SEQ ID NO: 508129 - protein, 10 aa, Influenza virus
PATIGECPKY

SEQ ID NO: 508130 - protein, 10 aa, Influenza virus
PAYCNTDLGA

SEQ ID NO: 508131 - protein, 10 aa, Influenza virus
PAYCNTDLGS

SEQ ID NO: 508132 - protein, 10 aa, Influenza virus
PAYCNTDLGT

SEQ ID NO: 508133 - protein, 10 aa, Influenza virus
PCEPIIIEKN

SEQ ID NO: 508134 - protein, 10 aa, Influenza virus
PCEPIIIERN

SEQ ID NO: 508135 - protein, 10 aa, Influenza virus
PCEPIIVERN

SEQ ID NO: 508136 - protein, 10 aa, Influenza virus
PCEPTIIERN

SEQ ID NO: 508137 - protein, 10 aa, Influenza virus
PCFWLEMIRG

SEQ ID NO: 508138 - protein, 10 aa, Influenza virus
PCFWVELIRG

SEQ ID NO: 508139 - protein, 10 aa, Influenza virus
PCFWVELVRG

SEQ ID NO: 508140 - protein, 10 aa, Influenza virus
PCFWVEMIRG

SEQ ID NO: 508141 - protein, 10 aa, Influenza virus
PCFYIELIRG

SEQ ID NO: 508142 - protein, 10 aa, Influenza virus
PCFYVELIRG

SEQ ID NO: 508143 - protein, 10 aa, Influenza virus
PCFYVELTRG

SEQ ID NO: 508144 - protein, 10 aa, Influenza virus
PCLTDKGSIQ

SEQ ID NO: 508145 - protein, 10 aa, Influenza virus
PCMESIRNNT

SEQ ID NO: 508146 - protein, 10 aa, Influenza virus
PDATAVAVLK

SEQ ID NO: 508147 - protein, 10 aa, Influenza virus
PDATAVVVLK

SEQ ID NO: 508148 - protein, 10 aa, Influenza virus
PDDGAVAVLK

SEQ ID NO: 508149 - protein, 10 aa, Influenza virus
PDECRFYALS

SEQ ID NO: 508150 - protein, 10 aa, Influenza virus
PDGADINFMP

SEQ ID NO: 508151 - protein, 10 aa, Influenza virus
PDGADLPFTI

SEQ ID NO: 508152 - protein, 10 aa, Influenza virus
PDGAEIEYFL

SEQ ID NO: 508153 - protein, 10 aa, Influenza virus
PDGAELPFAI

SEQ ID NO: 508154 - protein, 10 aa, Influenza virus
PDGAELPFII

SEQ ID NO: 508155 - protein, 10 aa, Influenza virus
PDGAELPFTI

SEQ ID NO: 508156 - protein, 10 aa, Influenza virus
PDGAKIEYFL

SEQ ID NO: 508157 - protein, 10 aa, Influenza virus
PDGAKIKYFL

SEQ ID NO: 508158 - protein, 10 aa, Influenza virus
PDGAKIQYFS

SEQ ID NO: 508159 - protein, 10 aa, Influenza virus
PDGAKLPFTI

SEQ ID NO: 508160 - protein, 10 aa, Influenza virus
PDGALLPFDI

SEQ ID NO: 508161 - protein, 10 aa, Influenza virus
PDGANIDFMP

SEQ ID NO: 508162 - protein, 10 aa, Influenza virus
PDGANIGFMP

SEQ ID NO: 508163 - protein, 10 aa, Influenza virus
PDGANIGLCP

SEQ ID NO: 508164 - protein, 10 aa, Influenza virus
PDGANINFMA

SEQ ID NO: 508165 - protein, 10 aa, Influenza virus
PDGANINFMP

SEQ ID NO: 508166 - protein, 10 aa, Influenza virus
PDGANINLMP

SEQ ID NO: 508167 - protein, 10 aa, Influenza virus
PDGANTNFMP

SEQ ID NO: 508168 - protein, 10 aa, Influenza virus
PDGAQIKYFS

SEQ ID NO: 508169 - protein, 10 aa, Influenza virus
PDGAQIQYFS

SEQ ID NO: 508170 - protein, 10 aa, Influenza virus
PDGARIQYFS

SEQ ID NO: 508171 - protein, 10 aa, Influenza virus
PDGCRFYALS

SEQ ID NO: 508172 - protein, 10 aa, Influenza virus
PDGGNINFMP

SEQ ID NO: 508173 - protein, 10 aa, Influenza virus
PDGPQIQYFS

SEQ ID NO: 508174 - protein, 10 aa, Influenza virus
PDGSDIGFMP

SEQ ID NO: 508175 - protein, 10 aa, Influenza virus
PDGSKIGFMP

SEQ ID NO: 508176 - protein, 10 aa, Influenza virus
PDGSNIGFMP

SEQ ID NO: 508177 - protein, 10 aa, Influenza virus
PDHEGEGIPL

SEQ ID NO: 508178 - protein, 10 aa, Influenza virus
PDIYDFNEGS

SEQ ID NO: 508179 - protein, 10 aa, Influenza virus
PDLYDYKEDR

SEQ ID NO: 508180 - protein, 10 aa, Influenza virus
PDLYDYKENR

SEQ ID NO: 508181 - protein, 10 aa, Influenza virus
PDLYDYKESR

SEQ ID NO: 508182 - protein, 10 aa, Influenza virus
PDLYDYKKNR

SEQ ID NO: 508183 - protein, 10 aa, Influenza virus
PDNEAVAVLK

SEQ ID NO: 508184 - protein, 10 aa, Influenza virus
PDNGAVAVLK

SEQ ID NO: 508185 - protein, 10 aa, Influenza virus
PDNGAVAVVK

SEQ ID NO: 508186 - protein, 10 aa, Influenza virus
PDPFRLLQNS

SEQ ID NO: 508187 - protein, 10 aa, Influenza virus
PDPGVKGFAF

SEQ ID NO: 508188 - protein, 10 aa, Influenza virus
PDRATFLRSN

SEQ ID NO: 508189 - protein, 10 aa, Influenza virus
PDSGAVAVLK

SEQ ID NO: 508190 - protein, 10 aa, Influenza virus
PDSTAVAVIK

SEQ ID NO: 508191 - protein, 10 aa, Influenza virus
PDSVLVNTYQ

SEQ ID NO: 508192 - protein, 10 aa, Influenza virus
PDTTAVAVLK

SEQ ID NO: 508193 - protein, 10 aa, Influenza virus
PDTYDFNEGA

SEQ ID NO: 508194 - protein, 10 aa, Influenza virus
PDTYDFNEGS

SEQ ID NO: 508195 - protein, 10 aa, Influenza virus
PDTYDFNEGT

SEQ ID NO: 508196 - protein, 10 aa, Influenza virus
PDVRCICKDN

SEQ ID NO: 508197 - protein, 10 aa, Influenza virus
PDVRCICRDN

SEQ ID NO: 508198 - protein, 10 aa, Influenza virus
PDVRCVCRDN

SEQ ID NO: 508199 - protein, 10 aa, Influenza virus
PDYHYEECSC

SEQ ID NO: 508200 - protein, 10 aa, Influenza virus
PDYQIGYVCS

SEQ ID NO: 508201 - protein, 10 aa, Influenza virus
PDYQSIRSIL

SEQ ID NO: 508202 - protein, 10 aa, Influenza virus
PDYQSLRSIL

SEQ ID NO: 508203 - protein, 10 aa, Influenza virus
PEAGLKWELM

SEQ ID NO: 508204 - protein, 10 aa, Influenza virus
PEAYNFNEGS

SEQ ID NO: 508205 - protein, 10 aa, Influenza virus
PEDLIVFNTI

SEQ ID NO: 508206 - protein, 10 aa, Influenza virus
PEEAKYVEWT

SEQ ID NO: 508207 - protein, 10 aa, Influenza virus
PEEAKYVWWA

SEQ ID NO: 508208 - protein, 10 aa, Influenza virus
PEEAKYVWWT

SEQ ID NO: 508209 - protein, 10 aa, Influenza virus
PEEGTSIWTS

SEQ ID NO: 508210 - protein, 10 aa, Influenza virus
PEEISETQGT

SEQ ID NO: 508211 - protein, 10 aa, Influenza virus
PEEKTSIWTS

SEQ ID NO: 508212 - protein, 10 aa, Influenza virus
PEERPSIWTS

SEQ ID NO: 508213 - protein, 10 aa, Influenza virus
PEERTSIWTS

SEQ ID NO: 508214 - protein, 10 aa, Influenza virus
PEEVKYVWWT

SEQ ID NO: 508215 - protein, 10 aa, Influenza virus
PEEVSEAQGT

SEQ ID NO: 508216 - protein, 10 aa, Influenza virus
PEEVSETQGI

SEQ ID NO: 508217 - protein, 10 aa, Influenza virus
PEEVSETQGM

SEQ ID NO: 508218 - protein, 10 aa, Influenza virus
PEEVSETQGT

SEQ ID NO: 508219 - protein, 10 aa, Influenza virus
PEFGYLLKGE

SEQ ID NO: 508220 - protein, 10 aa, Influenza virus
PEFGYLLRGE

SEQ ID NO: 508221 - protein, 10 aa, Influenza virus
PEGMCYPGFV

SEQ ID NO: 508222 - protein, 10 aa, Influenza virus
PEGMCYPGSI

SEQ ID NO: 508223 - protein, 10 aa, Influenza virus
PEGMCYPGSV

SEQ ID NO: 508224 - protein, 10 aa, Influenza virus
PEKIHTRGLF

SEQ ID NO: 508225 - protein, 10 aa, Influenza virus
PEKIRTRGLF

SEQ ID NO: 508226 - protein, 10 aa, Influenza virus
PEKIRVKRRP

SEQ ID NO: 508227 - protein, 10 aa, Influenza virus
PEKQTRGIFG

SEQ ID NO: 508228 - protein, 10 aa, Influenza virus
PEKQTRGLFG

SEQ ID NO: 508229 - protein, 10 aa, Influenza virus
PEQSKMQFSS

SEQ ID NO: 508230 - protein, 10 aa, Influenza virus
PEQSRMQFSS

SEQ ID NO: 508231 - protein, 10 aa, Influenza virus
PERQTRGIFG

SEQ ID NO: 508232 - protein, 10 aa, Influenza virus
PERQTRGLFG

SEQ ID NO: 508233 - protein, 10 aa, Influenza virus
PESVLINTYQ

SEQ ID NO: 508234 - protein, 10 aa, Influenza virus
PESVLVNTYQ

SEQ ID NO: 508235 - protein, 10 aa, Influenza virus
PETQTRGIFG

SEQ ID NO: 508236 - protein, 10 aa, Influenza virus
PEVCLKWDLM

SEQ ID NO: 508237 - protein, 10 aa, Influenza virus
PEVCLKWELM

SEQ ID NO: 508238 - protein, 10 aa, Influenza virus
PEWSWDDGAI

SEQ ID NO: 508239 - protein, 10 aa, Influenza virus
PEWSYIIEKE

SEQ ID NO: 508240 - protein, 10 aa, Influenza virus
PEWSYIMEKE

SEQ ID NO: 508241 - protein, 10 aa, Influenza virus
PEWSYIMEKK

SEQ ID NO: 508242 - protein, 10 aa, Influenza virus
PEWSYIVEKA

SEQ ID NO: 508243 - protein, 10 aa, Influenza virus
PEWSYIVEKD

SEQ ID NO: 508244 - protein, 10 aa, Influenza virus
PEWSYIVEKE

SEQ ID NO: 508245 - protein, 10 aa, Influenza virus
PEWSYIVEKN

SEQ ID NO: 508246 - protein, 10 aa, Influenza virus
PEWSYIVERE

SEQ ID NO: 508247 - protein, 10 aa, Influenza virus
PEYGFKISKR

SEQ ID NO: 508248 - protein, 10 aa, Influenza virus
PEYGFKISRR

SEQ ID NO: 508249 - protein, 10 aa, Influenza virus
PEYGFRISKR

SEQ ID NO: 508250 - protein, 10 aa, Influenza virus
PEYGHLITGK

SEQ ID NO: 508251 - protein, 10 aa, Influenza virus
PEYGHLTTGK

SEQ ID NO: 508252 - protein, 10 aa, Influenza virus
PEYGHLVTGK

SEQ ID NO: 508253 - protein, 10 aa, Influenza virus
PEYGYLITGK

SEQ ID NO: 508254 - protein, 10 aa, Influenza virus
PEYQSLRSIL

SEQ ID NO: 508255 - protein, 10 aa, Influenza virus
PFAAAPPEQS

SEQ ID NO: 508256 - protein, 10 aa, Influenza virus
PFAAAPPKQS

SEQ ID NO: 508257 - protein, 10 aa, Influenza virus
PFAAAPPVQS

SEQ ID NO: 508258 - protein, 10 aa, Influenza virus
PFAKDNSIRL

SEQ ID NO: 508259 - protein, 10 aa, Influenza virus
PFASAPPEQS

SEQ ID NO: 508260 - protein, 10 aa, Influenza virus
PFDDRLRRDQ

SEQ ID NO: 508261 - protein, 10 aa, Influenza virus
PFDVPDYQSL

SEQ ID NO: 508262 - protein, 10 aa, Influenza virus
PFHKDNAIRL

SEQ ID NO: 508263 - protein, 10 aa, Influenza virus
PFHKDNALRL

SEQ ID NO: 508264 - protein, 10 aa, Influenza virus
PFHKDNAVRL

SEQ ID NO: 508265 - protein, 10 aa, Influenza virus
PFHKGNSARL

SEQ ID NO: 508266 - protein, 10 aa, Influenza virus
PFHLATKQVC

SEQ ID NO: 508267 - protein, 10 aa, Influenza virus
PFHLGTKQVC

SEQ ID NO: 508268 - protein, 10 aa, Influenza virus
PFHLGTRQVC

SEQ ID NO: 508269 - protein, 10 aa, Influenza virus
PFHNIHPLAI

SEQ ID NO: 508270 - protein, 10 aa, Influenza virus
PFHNIHPLTI

SEQ ID NO: 508271 - protein, 10 aa, Influenza virus
PFHNVHPFTI

SEQ ID NO: 508272 - protein, 10 aa, Influenza virus
PFHNVHPLAI

SEQ ID NO: 508273 - protein, 10 aa, Influenza virus
PFHNVHPLTI

SEQ ID NO: 508274 - protein, 10 aa, Influenza virus
PFIDRLRRDQ

SEQ ID NO: 508275 - protein, 10 aa, Influenza virus
PFISCSHFEC

SEQ ID NO: 508276 - protein, 10 aa, Influenza virus
PFISCSHLEC

SEQ ID NO: 508277 - protein, 10 aa, Influenza virus
PFISCSHMEC

SEQ ID NO: 508278 - protein, 10 aa, Influenza virus
PFISCSHSEC

SEQ ID NO: 508279 - protein, 10 aa, Influenza virus
PFISCSPLEC

SEQ ID NO: 508280 - protein, 10 aa, Influenza virus
PFISCSQLEC

SEQ ID NO: 508281 - protein, 10 aa, Influenza virus
PFISCSYLEC

SEQ ID NO: 508282 - protein, 10 aa, Influenza virus
PFKGFFPFHK

SEQ ID NO: 508283 - protein, 10 aa, Influenza virus
PFKLLQNSQI

SEQ ID NO: 508284 - protein, 10 aa, Influenza virus
PFKLLQNSQV

SEQ ID NO: 508285 - protein, 10 aa, Influenza virus
PFKLLQTSQV

SEQ ID NO: 508286 - protein, 10 aa, Influenza virus
PFLDRIRRDQ

SEQ ID NO: 508287 - protein, 10 aa, Influenza virus
PFLDRLRRDQ

SEQ ID NO: 508288 - protein, 10 aa, Influenza virus
PFLDRVRRDQ

SEQ ID NO: 508289 - protein, 10 aa, Influenza virus
PFPVGSGSFP

SEQ ID NO: 508290 - protein, 10 aa, Influenza virus
PFQGFFPFHK

SEQ ID NO: 508291 - protein, 10 aa, Influenza virus
PFQNASRHHM

SEQ ID NO: 508292 - protein, 10 aa, Influenza virus
PFQNASRHYM

SEQ ID NO: 508293 - protein, 10 aa, Influenza virus
PFQNASRYYM

SEQ ID NO: 508294 - protein, 10 aa, Influenza virus
PFQNICKPYI

SEQ ID NO: 508295 - protein, 10 aa, Influenza virus
PFQNIDSRAV

SEQ ID NO: 508296 - protein, 10 aa, Influenza virus
PFQNIDSWAV

SEQ ID NO: 508297 - protein, 10 aa, Influenza virus
PFQNIHPATI

SEQ ID NO: 508298 - protein, 10 aa, Influenza virus
PFQNIHPITI

SEQ ID NO: 508299 - protein, 10 aa, Influenza virus
PFQNIHPVTI

SEQ ID NO: 508300 - protein, 10 aa, Influenza virus
PFQNLSPRTV

SEQ ID NO: 508301 - protein, 10 aa, Influenza virus
PFQNTSKHYI

SEQ ID NO: 508302 - protein, 10 aa, Influenza virus
PFQNTSRHYI

SEQ ID NO: 508303 - protein, 10 aa, Influenza virus
PFQNTSRHYM

SEQ ID NO: 508304 - protein, 10 aa, Influenza virus
PFQNVHPITI

SEQ ID NO: 508305 - protein, 10 aa, Influenza virus
PFQNVHPVTI

SEQ ID NO: 508306 - protein, 10 aa, Influenza virus
PFQNVNKITY

SEQ ID NO: 508307 - protein, 10 aa, Influenza virus
PFQNVNKVTY

SEQ ID NO: 508308 - protein, 10 aa, Influenza virus
PFQNVNRITY

SEQ ID NO: 508309 - protein, 10 aa, Influenza virus
PFQNVSRIAI

SEQ ID NO: 508310 - protein, 10 aa, Influenza virus
PFRALISWEM

SEQ ID NO: 508311 - protein, 10 aa, Influenza virus
PFRALISWGM

SEQ ID NO: 508312 - protein, 10 aa, Influenza virus
PFRALVSWEM

SEQ ID NO: 508313 - protein, 10 aa, Influenza virus
PFRGFFPFHK

SEQ ID NO: 508314 - protein, 10 aa, Influenza virus
PFRLLQNSQV

SEQ ID NO: 508315 - protein, 10 aa, Influenza virus
PFRLLQSSQV

SEQ ID NO: 508316 - protein, 10 aa, Influenza virus
PFRTLMSCPI

SEQ ID NO: 508317 - protein, 10 aa, Influenza virus
PFRTLMSCPM

SEQ ID NO: 508318 - protein, 10 aa, Influenza virus
PFRTLMSCPV

SEQ ID NO: 508319 - protein, 10 aa, Influenza virus
PFSKDNGIRI

SEQ ID NO: 508320 - protein, 10 aa, Influenza virus
PFSKDNSIQL

SEQ ID NO: 508321 - protein, 10 aa, Influenza virus
PFSKDNSIRL

SEQ ID NO: 508322 - protein, 10 aa, Influenza virus
PFSKDNSVRL

SEQ ID NO: 508323 - protein, 10 aa, Influenza virus
PFTIGECPKY

SEQ ID NO: 508324 - protein, 10 aa, Influenza virus
PFTIGECPRY

SEQ ID NO: 508325 - protein, 10 aa, Influenza virus
PFTKDNSIRL

SEQ ID NO: 508326 - protein, 10 aa, Influenza virus
PFVACGPAEC

SEQ ID NO: 508327 - protein, 10 aa, Influenza virus
PFVACGPSEC

SEQ ID NO: 508328 - protein, 10 aa, Influenza virus
PFVACGPTEC

SEQ ID NO: 508329 - protein, 10 aa, Influenza virus
PFVACSPSEC

SEQ ID NO: 508330 - protein, 10 aa, Influenza virus
PFVRGQQGRM

SEQ ID NO: 508331 - protein, 10 aa, Influenza virus
PFVSCGPSEC

SEQ ID NO: 508332 - protein, 10 aa, Influenza virus
PFVSCSHLEC

SEQ ID NO: 508333 - protein, 10 aa, Influenza virus
PFYLGTKQVC

SEQ ID NO: 508334 - protein, 10 aa, Influenza virus
PFYLGTRQVC

SEQ ID NO: 508335 - protein, 10 aa, Influenza virus
PGAPGVKGFG

SEQ ID NO: 508336 - protein, 10 aa, Influenza virus
PGAPHGLCYP

SEQ ID NO: 508337 - protein, 10 aa, Influenza virus
PGARPKVNGQ

SEQ ID NO: 508338 - protein, 10 aa, Influenza virus
PGARPQVNGQ

SEQ ID NO: 508339 - protein, 10 aa, Influenza virus
PGARRIDFHW

SEQ ID NO: 508340 - protein, 10 aa, Influenza virus
PGARRIDFNW

SEQ ID NO: 508341 - protein, 10 aa, Influenza virus
PGATINEEAL

SEQ ID NO: 508342 - protein, 10 aa, Influenza virus
PGATVNEEAL

SEQ ID NO: 508343 - protein, 10 aa, Influenza virus
PGATVNEGAL

SEQ ID NO: 508344 - protein, 10 aa, Influenza virus
PGCDRLQDTT

SEQ ID NO: 508345 - protein, 10 aa, Influenza virus
PGDIIVFNTI

SEQ ID NO: 508346 - protein, 10 aa, Influenza virus
PGDLILFNTI

SEQ ID NO: 508347 - protein, 10 aa, Influenza virus
PGDLIVFNTI

SEQ ID NO: 508348 - protein, 10 aa, Influenza virus
PGDNIIFSHN

SEQ ID NO: 508349 - protein, 10 aa, Influenza virus
PGDNITFLHN

SEQ ID NO: 508350 - protein, 10 aa, Influenza virus
PGDNITFSDN

SEQ ID NO: 508351 - protein, 10 aa, Influenza virus
PGDNITFSHN

SEQ ID NO: 508352 - protein, 10 aa, Influenza virus
PGDRPKVNGQ

SEQ ID NO: 508353 - protein, 10 aa, Influenza virus
PGDSIIFNSI

SEQ ID NO: 508354 - protein, 10 aa, Influenza virus
PGDSITFSHN

SEQ ID NO: 508355 - protein, 10 aa, Influenza virus
PGDTVTFTFN

SEQ ID NO: 508356 - protein, 10 aa, Influenza virus
PGELDNNGEL

SEQ ID NO: 508357 - protein, 10 aa, Influenza virus
PGELNNNGEL

SEQ ID NO: 508358 - protein, 10 aa, Influenza virus
PGERIMFESN

SEQ ID NO: 508359 - protein, 10 aa, Influenza virus
PGERITFESN

SEQ ID NO: 508360 - protein, 10 aa, Influenza virus
PGERITFESS

SEQ ID NO: 508361 - protein, 10 aa, Influenza virus
PGERTTFESN

SEQ ID NO: 508362 - protein, 10 aa, Influenza virus
PGETLKVESN

SEQ ID NO: 508363 - protein, 10 aa, Influenza virus
PGETLNIESN

SEQ ID NO: 508364 - protein, 10 aa, Influenza virus
PGETLNVESN

SEQ ID NO: 508365 - protein, 10 aa, Influenza virus
PGEVDNNGEL

SEQ ID NO: 508366 - protein, 10 aa, Influenza virus
PGFHFEECSC

SEQ ID NO: 508367 - protein, 10 aa, Influenza virus
PGFVENLEEL

SEQ ID NO: 508368 - protein, 10 aa, Influenza virus
PGHNITFSHN

SEQ ID NO: 508369 - protein, 10 aa, Influenza virus
PGIFENSCIE

SEQ ID NO: 508370 - protein, 10 aa, Influenza virus
PGIFENSCLE

SEQ ID NO: 508371 - protein, 10 aa, Influenza virus
PGIFESSCLE

SEQ ID NO: 508372 - protein, 10 aa, Influenza virus
PGIFGNSCLE

SEQ ID NO: 508373 - protein, 10 aa, Influenza virus
PGIKGFAFLD

SEQ ID NO: 508374 - protein, 10 aa, Influenza virus
PGIKGFGFLN

SEQ ID NO: 508375 - protein, 10 aa, Influenza virus
PGKFTNEEAL

SEQ ID NO: 508376 - protein, 10 aa, Influenza virus
PGKQAKGLFG

SEQ ID NO: 508377 - protein, 10 aa, Influenza virus
PGLFENSCLE

SEQ ID NO: 508378 - protein, 10 aa, Influenza virus
PGLINGWYGF

SEQ ID NO: 508379 - protein, 10 aa, Influenza virus
PGLVAGWYGF

SEQ ID NO: 508380 - protein, 10 aa, Influenza virus
PGMMMGMFNM

SEQ ID NO: 508381 - protein, 10 aa, Influenza virus
PGMQIRGFVH

SEQ ID NO: 508382 - protein, 10 aa, Influenza virus
PGMQIRGFVY

SEQ ID NO: 508383 - protein, 10 aa, Influenza virus
PGNAEIEDLI

SEQ ID NO: 508384 - protein, 10 aa, Influenza virus
PGNAEIEDLT

SEQ ID NO: 508385 - protein, 10 aa, Influenza virus
PGNFNDYEEL

SEQ ID NO: 508386 - protein, 10 aa, Influenza virus
PGNLIVFNTI

SEQ ID NO: 508387 - protein, 10 aa, Influenza virus
PGNNBNGVKG

SEQ ID NO: 508388 - protein, 10 aa, Influenza virus
PGNNNKGVKG

SEQ ID NO: 508389 - protein, 10 aa, Influenza virus
PGNNNNGVKG

SEQ ID NO: 508390 - protein, 10 aa, Influenza virus
PGQTLRIRSN

SEQ ID NO: 508391 - protein, 10 aa, Influenza virus
PGQTLRVKSN

SEQ ID NO: 508392 - protein, 10 aa, Influenza virus
PGQTLRVRSD

SEQ ID NO: 508393 - protein, 10 aa, Influenza virus
PGQTLRVRSN

SEQ ID NO: 508394 - protein, 10 aa, Influenza virus
PGQTVKIKTN

SEQ ID NO: 508395 - protein, 10 aa, Influenza virus
PGQTVKIQTN

SEQ ID NO: 508396 - protein, 10 aa, Influenza virus
PGQTVKIQTS

SEQ ID NO: 508397 - protein, 10 aa, Influenza virus
PGRFTNEEAL

SEQ ID NO: 508398 - protein, 10 aa, Influenza virus
PGSFNDYEEL

SEQ ID NO: 508399 - protein, 10 aa, Influenza virus
PGSFNNYEEL

SEQ ID NO: 508400 - protein, 10 aa, Influenza virus
PGSFPDGAQI

SEQ ID NO: 508401 - protein, 10 aa, Influenza virus
PGSGDWPDGS

SEQ ID NO: 508402 - protein, 10 aa, Influenza virus
PGSGNWPDGA

SEQ ID NO: 508403 - protein, 10 aa, Influenza virus
PGSGNWPDGP

SEQ ID NO: 508404 - protein, 10 aa, Influenza virus
PGSGNWPDGS

SEQ ID NO: 508405 - protein, 10 aa, Influenza virus
PGSIENLEEL

SEQ ID NO: 508406 - protein, 10 aa, Influenza virus
PGSIENQEEL

SEQ ID NO: 508407 - protein, 10 aa, Influenza virus
PGSIKNQEEL

SEQ ID NO: 508408 - protein, 10 aa, Influenza virus
PGSLNDYEEL

SEQ ID NO: 508409 - protein, 10 aa, Influenza virus
PGSNNNGVKG

SEQ ID NO: 508410 - protein, 10 aa, Influenza virus
PGSTVNEEAL

SEQ ID NO: 508411 - protein, 10 aa, Influenza virus
PGSVENLEEL

SEQ ID NO: 508412 - protein, 10 aa, Influenza virus
PGSVENQEEL

SEQ ID NO: 508413 - protein, 10 aa, Influenza virus
PGTFDIEGLY

SEQ ID NO: 508414 - protein, 10 aa, Influenza virus
PGTFDIGGLY

SEQ ID NO: 508415 - protein, 10 aa, Influenza virus
PGTFDLEGLY

SEQ ID NO: 508416 - protein, 10 aa, Influenza virus
PGTFDLGGLY

SEQ ID NO: 508417 - protein, 10 aa, Influenza virus
PGTKGFGFLN

SEQ ID NO: 508418 - protein, 10 aa, Influenza virus
PGTRRIDFHW

SEQ ID NO: 508419 - protein, 10 aa, Influenza virus
PGTTVNEEAL

SEQ ID NO: 508420 - protein, 10 aa, Influenza virus
PGVKGFAFLD

SEQ ID NO: 508421 - protein, 10 aa, Influenza virus
PGVKGFAFLN

SEQ ID NO: 508422 - protein, 10 aa, Influenza virus
PGVKGFGFLD

SEQ ID NO: 508423 - protein, 10 aa, Influenza virus
PGVKGFGFLN

SEQ ID NO: 508424 - protein, 10 aa, Influenza virus
PGVKGFGFLS

SEQ ID NO: 508425 - protein, 10 aa, Influenza virus
PGVKGWAFDD

SEQ ID NO: 508426 - protein, 10 aa, Influenza virus
PGVKGWAFDN

SEQ ID NO: 508427 - protein, 10 aa, Influenza virus
PGVKGWAFDS

SEQ ID NO: 508428 - protein, 10 aa, Influenza virus
PGVKGWAFDY

SEQ ID NO: 508429 - protein, 10 aa, Influenza virus
PGVRCICRDN

SEQ ID NO: 508430 - protein, 10 aa, Influenza virus
PGWLTIGITG

SEQ ID NO: 508431 - protein, 10 aa, Influenza virus
PGWLTLGITG

SEQ ID NO: 508432 - protein, 10 aa, Influenza virus
PGWSWDDGAI

SEQ ID NO: 508433 - protein, 10 aa, Influenza virus
PGYNGQKSWM

SEQ ID NO: 508434 - protein, 10 aa, Influenza virus
PGYNGQKSWT

SEQ ID NO: 508435 - protein, 10 aa, Influenza virus
PGYNGQRSWM

SEQ ID NO: 508436 - protein, 10 aa, Influenza virus
PGYQSLRSIL

SEQ ID NO: 508437 - protein, 10 aa, Influenza virus
PHGLCYPGEL

SEQ ID NO: 508438 - protein, 10 aa, Influenza virus
PHLTGTWDTL

SEQ ID NO: 508439 - protein, 10 aa, Influenza virus
PHRLCYPGEL

SEQ ID NO: 508440 - protein, 10 aa, Influenza virus
PHRTLLMNEL

SEQ ID NO: 508441 - protein, 10 aa, Influenza virus
PHRTLLMSEL

SEQ ID NO: 508442 - protein, 10 aa, Influenza virus
PIAFLTSSIV

SEQ ID NO: 508443 - protein, 10 aa, Influenza virus
PIEHIASIRR

SEQ ID NO: 508444 - protein, 10 aa, Influenza virus
PIEHIASMRR

SEQ ID NO: 508445 - protein, 10 aa, Influenza virus
PIEHVASMRR

SEQ ID NO: 508446 - protein, 10 aa, Influenza virus
PIEYIASMRR

SEQ ID NO: 508447 - protein, 10 aa, Influenza virus
PIEYVASMRR

SEQ ID NO: 508448 - protein, 10 aa, Influenza virus
PIFLYVRTNG

SEQ ID NO: 508449 - protein, 10 aa, Influenza virus
PIGEAPSPYN

SEQ ID NO: 508450 - protein, 10 aa, Influenza virus
PIGEVPSPYN

SEQ ID NO: 508451 - protein, 10 aa, Influenza virus
PIGISSMVEA

SEQ ID NO: 508452 - protein, 10 aa, Influenza virus
PIGSGFFPDG

SEQ ID NO: 508453 - protein, 10 aa, Influenza virus
PIGTAPILGN

SEQ ID NO: 508454 - protein, 10 aa, Influenza virus
PIGTAPVLGN

SEQ ID NO: 508455 - protein, 10 aa, Influenza virus
PIGVAPSPSN

SEQ ID NO: 508456 - protein, 10 aa, Influenza virus
PIGVAPVLGN

SEQ ID NO: 508457 - protein, 10 aa, Influenza virus
PIHLGDCSFE

SEQ ID NO: 508458 - protein, 10 aa, Influenza virus
PIICLGHHAV

SEQ ID NO: 508459 - protein, 10 aa, Influenza virus
PIKGWAPLSK

SEQ ID NO: 508460 - protein, 10 aa, Influenza virus
PILGNYKEIC

SEQ ID NO: 508461 - protein, 10 aa, Influenza virus
PILNTSQRGI

SEQ ID NO: 508462 - protein, 10 aa, Influenza virus
PILSFIMWAG

SEQ ID NO: 508463 - protein, 10 aa, Influenza virus
PILSPLTKGI

SEQ ID NO: 508464 - protein, 10 aa, Influenza virus
PILSPLTKGM

SEQ ID NO: 508465 - protein, 10 aa, Influenza virus
PIMFSNKMAK

SEQ ID NO: 508466 - protein, 10 aa, Influenza virus
PIMFSNKMAR

SEQ ID NO: 508467 - protein, 10 aa, Influenza virus
PIMFSNKVAR

SEQ ID NO: 508468 - protein, 10 aa, Influenza virus
PINNGKGRYG

SEQ ID NO: 508469 - protein, 10 aa, Influenza virus
PINVTKENTG

SEQ ID NO: 508470 - protein, 10 aa, Influenza virus
PIRGWAPLSK

SEQ ID NO: 508471 - protein, 10 aa, Influenza virus
PIRLSGGGDI

SEQ ID NO: 508472 - protein, 10 aa, Influenza virus
PISLGDCSFA

SEQ ID NO: 508473 - protein, 10 aa, Influenza virus
PISLGGCSFA

SEQ ID NO: 508474 - protein, 10 aa, Influenza virus
PISVGSGSFP

SEQ ID NO: 508475 - protein, 10 aa, Influenza virus
PITEINTWAR

SEQ ID NO: 508476 - protein, 10 aa, Influenza virus
PITGSPCAPG

SEQ ID NO: 508477 - protein, 10 aa, Influenza virus
PITGSPGAPG

SEQ ID NO: 508478 - protein, 10 aa, Influenza virus
PITGSPGSPG

SEQ ID NO: 508479 - protein, 10 aa, Influenza virus
PITGSPGVPG

SEQ ID NO: 508480 - protein, 10 aa, Influenza virus
PITGSPSAPG

SEQ ID NO: 508481 - protein, 10 aa, Influenza virus
PITIGECPKY

SEQ ID NO: 508482 - protein, 10 aa, Influenza virus
PIVPSFDMNN

SEQ ID NO: 508483 - protein, 10 aa, Influenza virus
PIVPSFDMSK

SEQ ID NO: 508484 - protein, 10 aa, Influenza virus
PIVPSFDMSN

SEQ ID NO: 508485 - protein, 10 aa, Influenza virus
PIVPSFEMSN

SEQ ID NO: 508486 - protein, 10 aa, Influenza virus
PKCDIHLKDQ

SEQ ID NO: 508487 - protein, 10 aa, Influenza virus
PKCDIHLRDQ

SEQ ID NO: 508488 - protein, 10 aa, Influenza virus
PKCDLYLNGR

SEQ ID NO: 508489 - protein, 10 aa, Influenza virus
PKCDLYLSGR

SEQ ID NO: 508490 - protein, 10 aa, Influenza virus
PKCDPYLNGR

SEQ ID NO: 508491 - protein, 10 aa, Influenza virus
PKCDTHLKDQ

SEQ ID NO: 508492 - protein, 10 aa, Influenza virus
PKCDVHLKDQ

SEQ ID NO: 508493 - protein, 10 aa, Influenza virus
PKEDEVWWTS

SEQ ID NO: 508494 - protein, 10 aa, Influenza virus
PKEDKVWWTS

SEQ ID NO: 508495 - protein, 10 aa, Influenza virus
PKEDRVWWTS

SEQ ID NO: 508496 - protein, 10 aa, Influenza virus
PKEEKVWWTS

SEQ ID NO: 508497 - protein, 10 aa, Influenza virus
PKEIEGICYP

SEQ ID NO: 508498 - protein, 10 aa, Influenza virus
PKEKAIWTSG

SEQ ID NO: 508499 - protein, 10 aa, Influenza virus
PKEKTIWTSG

SEQ ID NO: 508500 - protein, 10 aa, Influenza virus
PKEMEGICYP

SEQ ID NO: 508501 - protein, 10 aa, Influenza virus
PKEMEGVCYP

SEQ ID NO: 508502 - protein, 10 aa, Influenza virus
PKENPAHKSQ

SEQ ID NO: 508503 - protein, 10 aa, Influenza virus
PKERTIWTSG

SEQ ID NO: 508504 - protein, 10 aa, Influenza virus
PKERTSIWTS

SEQ ID NO: 508505 - protein, 10 aa, Influenza virus
PKETRVWWTS

SEQ ID NO: 508506 - protein, 10 aa, Influenza virus
PKFLPDLYDY

SEQ ID NO: 508507 - protein, 10 aa, Influenza virus
PKGLFGAIAG

SEQ ID NO: 508508 - protein, 10 aa, Influenza virus
PKGRGLFGAI

SEQ ID NO: 508509 - protein, 10 aa, Influenza virus
PKKRGLFGAI

SEQ ID NO: 508510 - protein, 10 aa, Influenza virus
PKKTGGPIYK

SEQ ID NO: 508511 - protein, 10 aa, Influenza virus
PKKTGGPIYR

SEQ ID NO: 508512 - protein, 10 aa, Influenza virus
PKLRSGFEML

SEQ ID NO: 508513 - protein, 10 aa, Influenza virus
PKPRGLFGAI

SEQ ID NO: 508514 - protein, 10 aa, Influenza virus
PKQSRMQFSS

SEQ ID NO: 508515 - protein, 10 aa, Influenza virus
PKRNRSILNT

SEQ ID NO: 508516 - protein, 10 aa, Influenza virus
PKSKLFTLSG

SEQ ID NO: 508517 - protein, 10 aa, Influenza virus
PKSLPDLYDY

SEQ ID NO: 508518 - protein, 10 aa, Influenza virus
PKTRGLFGAI

SEQ ID NO: 508519 - protein, 10 aa, Influenza virus
PKVNGQAGRI

SEQ ID NO: 508520 - protein, 10 aa, Influenza virus
PKVNGQSGRI

SEQ ID NO: 508521 - protein, 10 aa, Influenza virus
PKYEEESKLK

SEQ ID NO: 508522 - protein, 10 aa, Influenza virus
PKYEEESKLN

SEQ ID NO: 508523 - protein, 10 aa, Influenza virus
PKYEEESRLN

SEQ ID NO: 508524 - protein, 10 aa, Influenza virus
PKYEKESKLN

SEQ ID NO: 508525 - protein, 10 aa, Influenza virus
PKYGYIIEEY

SEQ ID NO: 508526 - protein, 10 aa, Influenza virus
PKYIKQGSLK

SEQ ID NO: 508527 - protein, 10 aa, Influenza virus
PKYIKSDQLK

SEQ ID NO: 508528 - protein, 10 aa, Influenza virus
PKYIKSGQLK

SEQ ID NO: 508529 - protein, 10 aa, Influenza virus
PKYIPSGSLK

SEQ ID NO: 508530 - protein, 10 aa, Influenza virus
PKYIPSNSLK

SEQ ID NO: 508531 - protein, 10 aa, Influenza virus
PKYIPSRSLK

SEQ ID NO: 508532 - protein, 10 aa, Influenza virus
PKYISSGSLK

SEQ ID NO: 508533 - protein, 10 aa, Influenza virus
PKYLPDLYDY

SEQ ID NO: 508534 - protein, 10 aa, Influenza virus
PKYMNVKSLK

SEQ ID NO: 508535 - protein, 10 aa, Influenza virus
PKYVKQGSLK

SEQ ID NO: 508536 - protein, 10 aa, Influenza virus
PKYVKQGSLM

SEQ ID NO: 508537 - protein, 10 aa, Influenza virus
PKYVKQGSLR

SEQ ID NO: 508538 - protein, 10 aa, Influenza virus
PKYVKSDRLV

SEQ ID NO: 508539 - protein, 10 aa, Influenza virus
PKYVKSEKLV

SEQ ID NO: 508540 - protein, 10 aa, Influenza virus
PKYVKSERLV

SEQ ID NO: 508541 - protein, 10 aa, Influenza virus
PKYVKSKRLV

SEQ ID NO: 508542 - protein, 10 aa, Influenza virus
PKYVNIKSLK

SEQ ID NO: 508543 - protein, 10 aa, Influenza virus
PKYVNVKSLK

SEQ ID NO: 508544 - protein, 10 aa, Influenza virus
PKYVNVRSLK

SEQ ID NO: 508545 - protein, 10 aa, Influenza virus
PKYVRSEKLV

SEQ ID NO: 508546 - protein, 10 aa, Influenza virus
PLAGSAQHVE

SEQ ID NO: 508547 - protein, 10 aa, Influenza virus
PLAIGECPKY

SEQ ID NO: 508548 - protein, 10 aa, Influenza virus
PLAITWWNRN

SEQ ID NO: 508549 - protein, 10 aa, Influenza virus
PLALGMKNVP

SEQ ID NO: 508550 - protein, 10 aa, Influenza virus
PLASLLEMCH

SEQ ID NO: 508551 - protein, 10 aa, Influenza virus
PLAVTWWNRK

SEQ ID NO: 508552 - protein, 10 aa, Influenza virus
PLAVTWWNRN

SEQ ID NO: 508553 - protein, 10 aa, Influenza virus
PLAVTWWNRS

SEQ ID NO: 508554 - protein, 10 aa, Influenza virus
PLCAVNSWHI

SEQ ID NO: 508555 - protein, 10 aa, Influenza virus
PLCDVSGFAI

SEQ ID NO: 508556 - protein, 10 aa, Influenza virus
PLCEISGFAI

SEQ ID NO: 508557 - protein, 10 aa, Influenza virus
PLCEVNSWHI

SEQ ID NO: 508558 - protein, 10 aa, Influenza virus
PLCEVSGFAI

SEQ ID NO: 508559 - protein, 10 aa, Influenza virus
PLCEVSGFAV

SEQ ID NO: 508560 - protein, 10 aa, Influenza virus
PLCEVSSWHI

SEQ ID NO: 508561 - protein, 10 aa, Influenza virus
PLCNVSGFAI

SEQ ID NO: 508562 - protein, 10 aa, Influenza virus
PLCPFKGFFP

SEQ ID NO: 508563 - protein, 10 aa, Influenza virus
PLCPFQGFFP

SEQ ID NO: 508564 - protein, 10 aa, Influenza virus
PLCPFRGFFP

SEQ ID NO: 508565 - protein, 10 aa, Influenza virus
PLELGDCSIA

SEQ ID NO: 508566 - protein, 10 aa, Influenza virus
PLELGNCSIA

SEQ ID NO: 508567 - protein, 10 aa, Influenza virus
PLELRDCKIE

SEQ ID NO: 508568 - protein, 10 aa, Influenza virus
PLELRDCKVE

SEQ ID NO: 508569 - protein, 10 aa, Influenza virus
PLELRDCSIA

SEQ ID NO: 508570 - protein, 10 aa, Influenza virus
PLFLYVRTNG

SEQ ID NO: 508571 - protein, 10 aa, Influenza virus
PLGAINTTLP

SEQ ID NO: 508572 - protein, 10 aa, Influenza virus
PLGALNTTLP

SEQ ID NO: 508573 - protein, 10 aa, Influenza virus
PLGCKMYALH

SEQ ID NO: 508574 - protein, 10 aa, Influenza virus
PLGCKTYALH

SEQ ID NO: 508575 - protein, 10 aa, Influenza virus
PLGCRMYALH

SEQ ID NO: 508576 - protein, 10 aa, Influenza virus
PLGEAPSPYN

SEQ ID NO: 508577 - protein, 10 aa, Influenza virus
PLGSPPIVSN

SEQ ID NO: 508578 - protein, 10 aa, Influenza virus
PLGSPPMVSN

SEQ ID NO: 508579 - protein, 10 aa, Influenza virus
PLGSPPVVSN

SEQ ID NO: 508580 - protein, 10 aa, Influenza virus
PLGSSPNAYQ

SEQ ID NO: 508581 - protein, 10 aa, Influenza virus
PLGSSSNAYQ

SEQ ID NO: 508582 - protein, 10 aa, Influenza virus
PLGTPPTVSN

SEQ ID NO: 508583 - protein, 10 aa, Influenza virus
PLHNIHPLTI

SEQ ID NO: 508584 - protein, 10 aa, Influenza virus
PLIKHENRMV

SEQ ID NO: 508585 - protein, 10 aa, Influenza virus
PLILKDCSIA

SEQ ID NO: 508586 - protein, 10 aa, Influenza virus
PLILKDCSVA

SEQ ID NO: 508587 - protein, 10 aa, Influenza virus
PLILRDCSVA

SEQ ID NO: 508588 - protein, 10 aa, Influenza virus
PLIRGQQGRM

SEQ ID NO: 508589 - protein, 10 aa, Influenza virus
PLIRHENRMV

SEQ ID NO: 508590 - protein, 10 aa, Influenza virus
PLKAEIAQKL

SEQ ID NO: 508591 - protein, 10 aa, Influenza virus
PLKAEIAQRL

SEQ ID NO: 508592 - protein, 10 aa, Influenza virus
PLKLVDGQDC

SEQ ID NO: 508593 - protein, 10 aa, Influenza virus
PLLQITSLCS

SEQ ID NO: 508594 - protein, 10 aa, Influenza virus
PLLSLLEMCH

SEQ ID NO: 508595 - protein, 10 aa, Influenza virus
PLMVAYMLER

SEQ ID NO: 508596 - protein, 10 aa, Influenza virus
PLPFQNIDSR

SEQ ID NO: 508597 - protein, 10 aa, Influenza virus
PLPFQNIDSW

SEQ ID NO: 508598 - protein, 10 aa, Influenza virus
PLPFQNINPR

SEQ ID NO: 508599 - protein, 10 aa, Influenza virus
PLPLCPFKGF

SEQ ID NO: 508600 - protein, 10 aa, Influenza virus
PLPLCPFRGF

SEQ ID NO: 508601 - protein, 10 aa, Influenza virus
PLQNASRHYM

SEQ ID NO: 508602 - protein, 10 aa, Influenza virus
PLQNTSKHYI

SEQ ID NO: 508603 - protein, 10 aa, Influenza virus
PLSGSAQHIE

SEQ ID NO: 508604 - protein, 10 aa, Influenza virus
PLSGSAQHVE

SEQ ID NO: 508605 - protein, 10 aa, Influenza virus
PLSISVGSST

SEQ ID NO: 508606 - protein, 10 aa, Influenza virus
PLSKDNGIRI

SEQ ID NO: 508607 - protein, 10 aa, Influenza virus
PLSKDNSIRL

SEQ ID NO: 508608 - protein, 10 aa, Influenza virus
PLSSPPTVYN

SEQ ID NO: 508609 - protein, 10 aa, Influenza virus
PLTIGECPKY

SEQ ID NO: 508610 - protein, 10 aa, Influenza virus
PLTIGECPRY

SEQ ID NO: 508611 - protein, 10 aa, Influenza virus
PLTIGKCPKY

SEQ ID NO: 508612 - protein, 10 aa, Influenza virus
PLTKGILGFV

SEQ ID NO: 508613 - protein, 10 aa, Influenza virus
PLTKGMLGFV

SEQ ID NO: 508614 - protein, 10 aa, Influenza virus
PLTTTPTKSY

SEQ ID NO: 508615 - protein, 10 aa, Influenza virus
PLVLDDCSLE

SEQ ID NO: 508616 - protein, 10 aa, Influenza virus
PLVLDDCSLK

SEQ ID NO: 508617 - protein, 10 aa, Influenza virus
PLVLGDCSIA

SEQ ID NO: 508618 - protein, 10 aa, Influenza virus
PLVMGQQGRM

SEQ ID NO: 508619 - protein, 10 aa, Influenza virus
PLVNGQSGRI

SEQ ID NO: 508620 - protein, 10 aa, Influenza virus
PLVPCEPIII

SEQ ID NO: 508621 - protein, 10 aa, Influenza virus
PLVREQQGRM

SEQ ID NO: 508622 - protein, 10 aa, Influenza virus
PLVRGQQGRM

SEQ ID NO: 508623 - protein, 10 aa, Influenza virus
PLVRGQQGTM

SEQ ID NO: 508624 - protein, 10 aa, Influenza virus
PLVRGQQGWM

SEQ ID NO: 508625 - protein, 10 aa, Influenza virus
PMFLYIRTNG

SEQ ID NO: 508626 - protein, 10 aa, Influenza virus
PMFLYVRTNG

SEQ ID NO: 508627 - protein, 10 aa, Influenza virus
PMGFRYSGIK

SEQ ID NO: 508628 - protein, 10 aa, Influenza virus
PMGTAPVLGN

SEQ ID NO: 508629 - protein, 10 aa, Influenza virus
PMGVAPSPSN

SEQ ID NO: 508630 - protein, 10 aa, Influenza virus
PMHQLLRHFQ

SEQ ID NO: 508631 - protein, 10 aa, Influenza virus
PMISKCKTKE

SEQ ID NO: 508632 - protein, 10 aa, Influenza virus
PMISKCRTKE

SEQ ID NO: 508633 - protein, 10 aa, Influenza virus
PMISKCRTRE

SEQ ID NO: 508634 - protein, 10 aa, Influenza virus
PMISKSRTKE

SEQ ID NO: 508635 - protein, 10 aa, Influenza virus
PMMWEINGPE

SEQ ID NO: 508636 - protein, 10 aa, Influenza virus
PMRTPIAFLT

SEQ ID NO: 508637 - protein, 10 aa, Influenza virus
PNAGKDPKKT

SEQ ID NO: 508638 - protein, 10 aa, Influenza virus
PNALLKHRFE

SEQ ID NO: 508639 - protein, 10 aa, Influenza virus
PNALTDDKSK

SEQ ID NO: 508640 - protein, 10 aa, Influenza virus
PNALTDDRSK

SEQ ID NO: 508641 - protein, 10 aa, Influenza virus
PNALTDDRST

SEQ ID NO: 508642 - protein, 10 aa, Influenza virus
PNALTDNRSK

SEQ ID NO: 508643 - protein, 10 aa, Influenza virus
PNALTNDRSK

SEQ ID NO: 508644 - protein, 10 aa, Influenza virus
PNAPHKLCFP

SEQ ID NO: 508645 - protein, 10 aa, Influenza virus
PNAPHKLCYP

SEQ ID NO: 508646 - protein, 10 aa, Influenza virus
PNAPNKFCYP

SEQ ID NO: 508647 - protein, 10 aa, Influenza virus
PNAPNKLCFP

SEQ ID NO: 508648 - protein, 10 aa, Influenza virus
PNAPNKLCYP

SEQ ID NO: 508649 - protein, 10 aa, Influenza virus
PNAYQAKFES

SEQ ID NO: 508650 - protein, 10 aa, Influenza virus
PNAYQARFES

SEQ ID NO: 508651 - protein, 10 aa, Influenza virus
PNDERGNPGV

SEQ ID NO: 508652 - protein, 10 aa, Influenza virus
PNDGKVECVC

SEQ ID NO: 508653 - protein, 10 aa, Influenza virus
PNDGQVLYFL

SEQ ID NO: 508654 - protein, 10 aa, Influenza virus
PNDKPFQNVN

SEQ ID NO: 508655 - protein, 10 aa, Influenza virus
PNDNASAVVW

SEQ ID NO: 508656 - protein, 10 aa, Influenza virus
PNECRFYALS

SEQ ID NO: 508657 - protein, 10 aa, Influenza virus
PNEERGNPGV

SEQ ID NO: 508658 - protein, 10 aa, Influenza virus
PNEERGSPGV

SEQ ID NO: 508659 - protein, 10 aa, Influenza virus
PNEGKVECIC

SEQ ID NO: 508660 - protein, 10 aa, Influenza virus
PNEGKVECVC

SEQ ID NO: 508661 - protein, 10 aa, Influenza virus
PNEKPFQNVN

SEQ ID NO: 508662 - protein, 10 aa, Influenza virus
PNENPAHKSQ

SEQ ID NO: 508663 - protein, 10 aa, Influenza virus
PNENPVHKSQ

SEQ ID NO: 508664 - protein, 10 aa, Influenza virus
PNEVGAKILT

SEQ ID NO: 508665 - protein, 10 aa, Influenza virus
PNEVGARIIT

SEQ ID NO: 508666 - protein, 10 aa, Influenza virus
PNEVGARILT

SEQ ID NO: 508667 - protein, 10 aa, Influenza virus
PNFHYEECSC

SEQ ID NO: 508668 - protein, 10 aa, Influenza virus
PNFYYEECSC

SEQ ID NO: 508669 - protein, 10 aa, Influenza virus
PNGCIEGKLS

SEQ ID NO: 508670 - protein, 10 aa, Influenza virus
PNGCIESKLS

SEQ ID NO: 508671 - protein, 10 aa, Influenza virus
PNGKPFQNVN

SEQ ID NO: 508672 - protein, 10 aa, Influenza virus
PNGSIPNDKP

SEQ ID NO: 508673 - protein, 10 aa, Influenza virus
PNGSIPNEKP

SEQ ID NO: 508674 - protein, 10 aa, Influenza virus
PNGSIPNGKP

SEQ ID NO: 508675 - protein, 10 aa, Influenza virus
PNGSIPNNKP

SEQ ID NO: 508676 - protein, 10 aa, Influenza virus
PNGSISNDKP

SEQ ID NO: 508677 - protein, 10 aa, Influenza virus
PNGTIVKTIT

SEQ ID NO: 508678 - protein, 10 aa, Influenza virus
PNGTIVKTLT

SEQ ID NO: 508679 - protein, 10 aa, Influenza virus
PNGTIVRTIT

SEQ ID NO: 508680 - protein, 10 aa, Influenza virus
PNGTKVNTLT

SEQ ID NO: 508681 - protein, 10 aa, Influenza virus
PNGTLVKTIT

SEQ ID NO: 508682 - protein, 10 aa, Influenza virus
PNGTMVKTIT

SEQ ID NO: 508683 - protein, 10 aa, Influenza virus
PNGTVVKTIT

SEQ ID NO: 508684 - protein, 10 aa, Influenza virus
PNGYIEGKLS

SEQ ID NO: 508685 - protein, 10 aa, Influenza virus
PNHEGEGIPL

SEQ ID NO: 508686 - protein, 10 aa, Influenza virus
PNIGPRALVR

SEQ ID NO: 508687 - protein, 10 aa, Influenza virus
PNIGPRPFVR

SEQ ID NO: 508688 - protein, 10 aa, Influenza virus
PNIGPRPLIR

SEQ ID NO: 508689 - protein, 10 aa, Influenza virus
PNIGPRPLVM

SEQ ID NO: 508690 - protein, 10 aa, Influenza virus
PNIGPRPLVR

SEQ ID NO: 508691 - protein, 10 aa, Influenza virus
PNIGSRPRVR

SEQ ID NO: 508692 - protein, 10 aa, Influenza virus
PNKWGDILDG

SEQ ID NO: 508693 - protein, 10 aa, Influenza virus
PNKWGNVLDG

SEQ ID NO: 508694 - protein, 10 aa, Influenza virus
PNLGIVECVC

SEQ ID NO: 508695 - protein, 10 aa, Influenza virus
PNLGKVECVC

SEQ ID NO: 508696 - protein, 10 aa, Influenza virus
PNLGQVECVC

SEQ ID NO: 508697 - protein, 10 aa, Influenza virus
PNLYNIRNLH

SEQ ID NO: 508698 - protein, 10 aa, Influenza virus
PNMGKVECVC

SEQ ID NO: 508699 - protein, 10 aa, Influenza virus
PNNEKGNPGV

SEQ ID NO: 508700 - protein, 10 aa, Influenza virus
PNNEKGNQGV

SEQ ID NO: 508701 - protein, 10 aa, Influenza virus
PNNERGNHGV

SEQ ID NO: 508702 - protein, 10 aa, Influenza virus
PNNERGNPGV

SEQ ID NO: 508703 - protein, 10 aa, Influenza virus
PNNERGNQGV

SEQ ID NO: 508704 - protein, 10 aa, Influenza virus
PNNERGTQGV

SEQ ID NO: 508705 - protein, 10 aa, Influenza virus
PNNGKVECIC

SEQ ID NO: 508706 - protein, 10 aa, Influenza virus
PNNIDRAVKL

SEQ ID NO: 508707 - protein, 10 aa, Influenza virus
PNNKPFQNVN

SEQ ID NO: 508708 - protein, 10 aa, Influenza virus
PNNMARAVKL

SEQ ID NO: 508709 - protein, 10 aa, Influenza virus
PNNMDKAVKL

SEQ ID NO: 508710 - protein, 10 aa, Influenza virus
PNNMDRAVKL

SEQ ID NO: 508711 - protein, 10 aa, Influenza virus
PNNNASAIVW

SEQ ID NO: 508712 - protein, 10 aa, Influenza virus
PNNNASAVIW

SEQ ID NO: 508713 - protein, 10 aa, Influenza virus
PNNNASAVVW

SEQ ID NO: 508714 - protein, 10 aa, Influenza virus
PNNNASTVIW

SEQ ID NO: 508715 - protein, 10 aa, Influenza virus
PNQKIICISA

SEQ ID NO: 508716 - protein, 10 aa, Influenza virus
PNQKIICIST

SEQ ID NO: 508717 - protein, 10 aa, Influenza virus
PNQKIITIDS

SEQ ID NO: 508718 - protein, 10 aa, Influenza virus
PNQKIITIGF

SEQ ID NO: 508719 - protein, 10 aa, Influenza virus
PNQKIITIGS

SEQ ID NO: 508720 - protein, 10 aa, Influenza virus
PNQKIITMGS

SEQ ID NO: 508721 - protein, 10 aa, Influenza virus
PNQKILCASA

SEQ ID NO: 508722 - protein, 10 aa, Influenza virus
PNQKILCTSA

SEQ ID NO: 508723 - protein, 10 aa, Influenza virus
PNQKILFASA

SEQ ID NO: 508724 - protein, 10 aa, Influenza virus
PNQKIMCISA

SEQ ID NO: 508725 - protein, 10 aa, Influenza virus
PNQKITCISA

SEQ ID NO: 508726 - protein, 10 aa, Influenza virus
PNQKIVTIGS

SEQ ID NO: 508727 - protein, 10 aa, Influenza virus
PNQKLFALSG

SEQ ID NO: 508728 - protein, 10 aa, Influenza virus
PNQKLFASSG

SEQ ID NO: 508729 - protein, 10 aa, Influenza virus
PNQKLFTLSG

SEQ ID NO: 508730 - protein, 10 aa, Influenza virus
PNQKTITIGS

SEQ ID NO: 508731 - protein, 10 aa, Influenza virus
PNQRILCTSA

SEQ ID NO: 508732 - protein, 10 aa, Influenza virus
PNQSIITIGS

SEQ ID NO: 508733 - protein, 10 aa, Influenza virus
PNSGKVECVC

SEQ ID NO: 508734 - protein, 10 aa, Influenza virus
PNSHYEECSC

SEQ ID NO: 508735 - protein, 10 aa, Influenza virus
PNTLLKHRFE

SEQ ID NO: 508736 - protein, 10 aa, Influenza virus
PNVLLKHRFE

SEQ ID NO: 508737 - protein, 10 aa, Influenza virus
PNVRCVCRDN

SEQ ID NO: 508738 - protein, 10 aa, Influenza virus
PNVYQAKFEA

SEQ ID NO: 508739 - protein, 10 aa, Influenza virus
PNVYQAKFES

SEQ ID NO: 508740 - protein, 10 aa, Influenza virus
PNVYQARFEA

SEQ ID NO: 508741 - protein, 10 aa, Influenza virus
PNVYQARFES

SEQ ID NO: 508742 - protein, 10 aa, Influenza virus
PNVYQSRFEA

SEQ ID NO: 508743 - protein, 10 aa, Influenza virus
PNWSGYSGSF

SEQ ID NO: 508744 - protein, 10 aa, Influenza virus
PNYHYEECSC

SEQ ID NO: 508745 - protein, 10 aa, Influenza virus
PNYQSLRSIL

SEQ ID NO: 508746 - protein, 10 aa, Influenza virus
PNYYYEECSC

SEQ ID NO: 508747 - protein, 10 aa, Influenza virus
PPEQSKMQFS

SEQ ID NO: 508748 - protein, 10 aa, Influenza virus
PPEQSRMQFS

SEQ ID NO: 508749 - protein, 10 aa, Influenza virus
PPHCDQFLEF

SEQ ID NO: 508750 - protein, 10 aa, Influenza virus
PPKQSRMQFS

SEQ ID NO: 508751 - protein, 10 aa, Influenza virus
PPLELGDCSI

SEQ ID NO: 508752 - protein, 10 aa, Influenza virus
PPLELRDCSI

SEQ ID NO: 508753 - protein, 10 aa, Influenza virus
PPLVLGDCSI

SEQ ID NO: 508754 - protein, 10 aa, Influenza virus
PPQCDKFLEF

SEQ ID NO: 508755 - protein, 10 aa, Influenza virus
PPQCDLFLEF

SEQ ID NO: 508756 - protein, 10 aa, Influenza virus
PPQCDLHLEF

SEQ ID NO: 508757 - protein, 10 aa, Influenza virus
PPQCDQFLEF

SEQ ID NO: 508758 - protein, 10 aa, Influenza virus
PPQCDRFLEF

SEQ ID NO: 508759 - protein, 10 aa, Influenza virus
PPQCDSHLKF

SEQ ID NO: 508760 - protein, 10 aa, Influenza virus
PPVNGQSGRI

SEQ ID NO: 508761 - protein, 10 aa, Influenza virus
PPVQSKMQFS

SEQ ID NO: 508762 - protein, 10 aa, Influenza virus
PPVQSRMQFS

SEQ ID NO: 508763 - protein, 10 aa, Influenza virus
PPYSHGTGTG

SEQ ID NO: 508764 - protein, 10 aa, Influenza virus
PQAQDRGLFG

SEQ ID NO: 508765 - protein, 10 aa, Influenza virus
PQAQNRGLFG

SEQ ID NO: 508766 - protein, 10 aa, Influenza virus
PQCDLHLEFK

SEQ ID NO: 508767 - protein, 10 aa, Influenza virus
PQCDSHLKFK

SEQ ID NO: 508768 - protein, 10 aa, Influenza virus
PQCEITGFAP

SEQ ID NO: 508769 - protein, 10 aa, Influenza virus
PQCKITGFAP

SEQ ID NO: 508770 - protein, 10 aa, Influenza virus
PQCQIAGFAP

SEQ ID NO: 508771 - protein, 10 aa, Influenza virus
PQCQITGFAP

SEQ ID NO: 508772 - protein, 10 aa, Influenza virus
PQCQVTGFAP

SEQ ID NO: 508773 - protein, 10 aa, Influenza virus
PQEARVWWTS

SEQ ID NO: 508774 - protein, 10 aa, Influenza virus
PQENRVWWTS

SEQ ID NO: 508775 - protein, 10 aa, Influenza virus
PQETGVWWTS

SEQ ID NO: 508776 - protein, 10 aa, Influenza virus
PQETRVWWTS

SEQ ID NO: 508777 - protein, 10 aa, Influenza virus
PQIEARGLFG

SEQ ID NO: 508778 - protein, 10 aa, Influenza virus
PQIEPRGLFG

SEQ ID NO: 508779 - protein, 10 aa, Influenza virus
PQIESRGLFG

SEQ ID NO: 508780 - protein, 10 aa, Influenza virus
PQINGQSGRI

SEQ ID NO: 508781 - protein, 10 aa, Influenza virus
PQIQNRGLFG

SEQ ID NO: 508782 - protein, 10 aa, Influenza virus
PQLEGFSAES

SEQ ID NO: 508783 - protein, 10 aa, Influenza virus
PQLNPIDGPL

SEQ ID NO: 508784 - protein, 10 aa, Influenza virus
PQLNQTYRNN

SEQ ID NO: 508785 - protein, 10 aa, Influenza virus
PQLNQTYRNT

SEQ ID NO: 508786 - protein, 10 aa, Influenza virus
PQMESRGLFG

SEQ ID NO: 508787 - protein, 10 aa, Influenza virus
PQMNGQSGRI

SEQ ID NO: 508788 - protein, 10 aa, Influenza virus
PQSGRIVVDY

SEQ ID NO: 508789 - protein, 10 aa, Influenza virus
PQSSPPTVYN

SEQ ID NO: 508790 - protein, 10 aa, Influenza virus
PQTANTYRNT

SEQ ID NO: 508791 - protein, 10 aa, Influenza virus
PQTESRGLFG

SEQ ID NO: 508792 - protein, 10 aa, Influenza virus
PQTTNTYRNT

SEQ ID NO: 508793 - protein, 10 aa, Influenza virus
PQVNGQFGRI

SEQ ID NO: 508794 - protein, 10 aa, Influenza virus
PQVNGQSGRI

SEQ ID NO: 508795 - protein, 10 aa, Influenza virus
PQVNGQSGRV

SEQ ID NO: 508796 - protein, 10 aa, Influenza virus
PQVQDRGLFG

SEQ ID NO: 508797 - protein, 10 aa, Influenza virus
PQVQNRGLFG

SEQ ID NO: 508798 - protein, 10 aa, Influenza virus
PQYPNVRCVC

SEQ ID NO: 508799 - protein, 10 aa, Influenza virus
PRALVRGQQG

SEQ ID NO: 508800 - protein, 10 aa, Influenza virus
PRFLPDLYDY

SEQ ID NO: 508801 - protein, 10 aa, Influenza virus
PRGHYKISKS

SEQ ID NO: 508802 - protein, 10 aa, Influenza virus
PRGLFGAIAG

SEQ ID NO: 508803 - protein, 10 aa, Influenza virus
PRGLLEVGTR

SEQ ID NO: 508804 - protein, 10 aa, Influenza virus
PRIFLAMITY

SEQ ID NO: 508805 - protein, 10 aa, Influenza virus
PRLLQNSQVF

SEQ ID NO: 508806 - protein, 10 aa, Influenza virus
PRLRSGFEML

SEQ ID NO: 508807 - protein, 10 aa, Influenza virus
PRMCSLMQGS

SEQ ID NO: 508808 - protein, 10 aa, Influenza virus
PRMFLAMITY

SEQ ID NO: 508809 - protein, 10 aa, Influenza virus
PRNDDSSSNS

SEQ ID NO: 508810 - protein, 10 aa, Influenza virus
PRNDDSSSSS

SEQ ID NO: 508811 - protein, 10 aa, Influenza virus
PRNEDGSSSS

SEQ ID NO: 508812 - protein, 10 aa, Influenza virus
PRNEDSSSNS

SEQ ID NO: 508813 - protein, 10 aa, Influenza virus
PRNEDSSSSS

SEQ ID NO: 508814 - protein, 10 aa, Influenza virus
PRPADGTGSC

SEQ ID NO: 508815 - protein, 10 aa, Influenza virus
PRPFVRGQQG

SEQ ID NO: 508816 - protein, 10 aa, Influenza virus
PRPLIRGQQG

SEQ ID NO: 508817 - protein, 10 aa, Influenza virus
PRPLVMGQQG

SEQ ID NO: 508818 - protein, 10 aa, Influenza virus
PRPLVREQQG

SEQ ID NO: 508819 - protein, 10 aa, Influenza virus
PRPLVRGQQG

SEQ ID NO: 508820 - protein, 10 aa, Influenza virus
PRPMDSTGSC

SEQ ID NO: 508821 - protein, 10 aa, Influenza virus
PRPRRGLFGA

SEQ ID NO: 508822 - protein, 10 aa, Influenza virus
PRPVDGIGSC

SEQ ID NO: 508823 - protein, 10 aa, Influenza virus
PRPVDGTGSC

SEQ ID NO: 508824 - protein, 10 aa, Influenza virus
PRRGLFGAIA

SEQ ID NO: 508825 - protein, 10 aa, Influenza virus
PRRSGAAGAA

SEQ ID NO: 508826 - protein, 10 aa, Influenza virus
PRSRNGFEML

SEQ ID NO: 508827 - protein, 10 aa, Influenza virus
PRSRSGFEML

SEQ ID NO: 508828 - protein, 10 aa, Influenza virus
PRSRSGFEVL

SEQ ID NO: 508829 - protein, 10 aa, Influenza virus
PRSVDGTGSC

SEQ ID NO: 508830 - protein, 10 aa, Influenza virus
PRTTNTYRNT

SEQ ID NO: 508831 - protein, 10 aa, Influenza virus
PRTVGQCPKY

SEQ ID NO: 508832 - protein, 10 aa, Influenza virus
PRVFLAMITY

SEQ ID NO: 508833 - protein, 10 aa, Influenza virus
PRVFLTMITY

SEQ ID NO: 508834 - protein, 10 aa, Influenza virus
PRVRNQSGRI

SEQ ID NO: 508835 - protein, 10 aa, Influenza virus
PRYGYIIEEY

SEQ ID NO: 508836 - protein, 10 aa, Influenza virus
PRYGYIIEKY

SEQ ID NO: 508837 - protein, 10 aa, Influenza virus
PRYIPSGSLK

SEQ ID NO: 508838 - protein, 10 aa, Influenza virus
PRYLPDLYDY

SEQ ID NO: 508839 - protein, 10 aa, Influenza virus
PRYNGQRSWM

SEQ ID NO: 508840 - protein, 10 aa, Influenza virus
PRYPDVRCVC

SEQ ID NO: 508841 - protein, 10 aa, Influenza virus
PRYPNVRCVC

SEQ ID NO: 508842 - protein, 10 aa, Influenza virus
PRYVKQGSLK

SEQ ID NO: 508843 - protein, 10 aa, Influenza virus
PRYVKQSSLP

SEQ ID NO: 508844 - protein, 10 aa, Influenza virus
PSAGKDPKKT

SEQ ID NO: 508845 - protein, 10 aa, Influenza virus
PSAGRDPKKT

SEQ ID NO: 508846 - protein, 10 aa, Influenza virus
PSAIDQITGK

SEQ ID NO: 508847 - protein, 10 aa, Influenza virus
PSAPEGMCYP

SEQ ID NO: 508848 - protein, 10 aa, Influenza virus
PSAPGVKGFG

SEQ ID NO: 508849 - protein, 10 aa, Influenza virus
PSAPHGLCYP

SEQ ID NO: 508850 - protein, 10 aa, Influenza virus
PSAPHRLCYP

SEQ ID NO: 508851 - protein, 10 aa, Influenza virus
PSCASNINIR

SEQ ID NO: 508852 - protein, 10 aa, Influenza virus
PSCATNINIR

SEQ ID NO: 508853 - protein, 10 aa, Influenza virus
PSDAQAFYKI

SEQ ID NO: 508854 - protein, 10 aa, Influenza virus
PSDAQAFYKL

SEQ ID NO: 508855 - protein, 10 aa, Influenza virus
PSDTPRGEDA

SEQ ID NO: 508856 - protein, 10 aa, Influenza virus
PSDTPRGEDG

SEQ ID NO: 508857 - protein, 10 aa, Influenza virus
PSDTPRGEDN

SEQ ID NO: 508858 - protein, 10 aa, Influenza virus
PSDTPRGEDS

SEQ ID NO: 508859 - protein, 10 aa, Influenza virus
PSECRTFFLT

SEQ ID NO: 508860 - protein, 10 aa, Influenza virus
PSERGLQRRR

SEQ ID NO: 508861 - protein, 10 aa, Influenza virus
PSFFRNMIWL

SEQ ID NO: 508862 - protein, 10 aa, Influenza virus
PSFFRNMVWL

SEQ ID NO: 508863 - protein, 10 aa, Influenza virus
PSFFRNVVWL

SEQ ID NO: 508864 - protein, 10 aa, Influenza virus
PSFGVSGINE

SEQ ID NO: 508865 - protein, 10 aa, Influenza virus
PSFGVSGVNE

SEQ ID NO: 508866 - protein, 10 aa, Influenza virus
PSFYAEMKWL

SEQ ID NO: 508867 - protein, 10 aa, Influenza virus
PSFYRNLLWI

SEQ ID NO: 508868 - protein, 10 aa, Influenza virus
PSGCKMYALH

SEQ ID NO: 508869 - protein, 10 aa, Influenza virus
PSGIEYNGKS

SEQ ID NO: 508870 - protein, 10 aa, Influenza virus
PSGPLKAEIA

SEQ ID NO: 508871 - protein, 10 aa, Influenza virus
PSGSLKLAIG

SEQ ID NO: 508872 - protein, 10 aa, Influenza virus
PSGVEYNGKS

SEQ ID NO: 508873 - protein, 10 aa, Influenza virus
PSGYAQTDCV

SEQ ID NO: 508874 - protein, 10 aa, Influenza virus
PSHEGEGIPL

SEQ ID NO: 508875 - protein, 10 aa, Influenza virus
PSIDPKGLFG

SEQ ID NO: 508876 - protein, 10 aa, Influenza virus
PSIEPKGLFG

SEQ ID NO: 508877 - protein, 10 aa, Influenza virus
PSIEPRGLFG

SEQ ID NO: 508878 - protein, 10 aa, Influenza virus
PSIMSCDSPS

SEQ ID NO: 508879 - protein, 10 aa, Influenza virus
PSIQSRGLFG

SEQ ID NO: 508880 - protein, 10 aa, Influenza virus
PSKWGDILEG

SEQ ID NO: 508881 - protein, 10 aa, Influenza virus
PSKWGDVLDG

SEQ ID NO: 508882 - protein, 10 aa, Influenza virus
PSKWGNVLDG

SEQ ID NO: 508883 - protein, 10 aa, Influenza virus
PSLRMKWMMA

SEQ ID NO: 508884 - protein, 10 aa, Influenza virus
PSNAQAFYKI

SEQ ID NO: 508885 - protein, 10 aa, Influenza virus
PSNMDRAVKL

SEQ ID NO: 508886 - protein, 10 aa, Influenza virus
PSNSLKLAIG

SEQ ID NO: 508887 - protein, 10 aa, Influenza virus
PSNSRFESVA

SEQ ID NO: 508888 - protein, 10 aa, Influenza virus
PSPGARPKVN

SEQ ID NO: 508889 - protein, 10 aa, Influenza virus
PSPGDRPKVN

SEQ ID NO: 508890 - protein, 10 aa, Influenza virus
PSPLKLVDGQ

SEQ ID NO: 508891 - protein, 10 aa, Influenza virus
PSPSNSRFES

SEQ ID NO: 508892 - protein, 10 aa, Influenza virus
PSPYNSKFES

SEQ ID NO: 508893 - protein, 10 aa, Influenza virus
PSPYNSRFES

SEQ ID NO: 508894 - protein, 10 aa, Influenza virus
PSQKLFALSG

SEQ ID NO: 508895 - protein, 10 aa, Influenza virus
PSQTLRVRSN

SEQ ID NO: 508896 - protein, 10 aa, Influenza virus
PSRSLKLAIG

SEQ ID NO: 508897 - protein, 10 aa, Influenza virus
PSSAQEKNDL

SEQ ID NO: 508898 - protein, 10 aa, Influenza virus
PSSDNEQTDL

SEQ ID NO: 508899 - protein, 10 aa, Influenza virus
PSSSYRRPIG

SEQ ID NO: 508900 - protein, 10 aa, Influenza virus
PSSSYRRPVG

SEQ ID NO: 508901 - protein, 10 aa, Influenza virus
PSSTKEKNDL

SEQ ID NO: 508902 - protein, 10 aa, Influenza virus
PSSTKEKNEL

SEQ ID NO: 508903 - protein, 10 aa, Influenza virus
PSSTQEKNDL

SEQ ID NO: 508904 - protein, 10 aa, Influenza virus
PSSTQERNDL

SEQ ID NO: 508905 - protein, 10 aa, Influenza virus
PSTGKDPKKT

SEQ ID NO: 508906 - protein, 10 aa, Influenza virus
PSTGNHGSLV

SEQ ID NO: 508907 - protein, 10 aa, Influenza virus
PSTISCDSPS

SEQ ID NO: 508908 - protein, 10 aa, Influenza virus
PSTMSCDSPS

SEQ ID NO: 508909 - protein, 10 aa, Influenza virus
PSTVSCDSPS

SEQ ID NO: 508910 - protein, 10 aa, Influenza virus
PSVEPKGLFG

SEQ ID NO: 508911 - protein, 10 aa, Influenza virus
PSVEPRGLFG

SEQ ID NO: 508912 - protein, 10 aa, Influenza virus
PSVKLPMGAI

SEQ ID NO: 508913 - protein, 10 aa, Influenza virus
PSVQSRGLFG

SEQ ID NO: 508914 - protein, 10 aa, Influenza virus
PSVVSCDSPS

SEQ ID NO: 508915 - protein, 10 aa, Influenza virus
PSWAGNILRT

SEQ ID NO: 508916 - protein, 10 aa, Influenza virus
PSWAGNVLRT

SEQ ID NO: 508917 - protein, 10 aa, Influenza virus
PSWEGNILRT

SEQ ID NO: 508918 - protein, 10 aa, Influenza virus
PTAPHGLCYP

SEQ ID NO: 508919 - protein, 10 aa, Influenza virus
PTAVDTCYPF

SEQ ID NO: 508920 - protein, 10 aa, Influenza virus
PTDTPRGEDS

SEQ ID NO: 508921 - protein, 10 aa, Influenza virus
PTDTPRIQDS

SEQ ID NO: 508922 - protein, 10 aa, Influenza virus
PTDTPRVQDD

SEQ ID NO: 508923 - protein, 10 aa, Influenza virus
PTDTPRVQDG

SEQ ID NO: 508924 - protein, 10 aa, Influenza virus
PTDTPRVQDN

SEQ ID NO: 508925 - protein, 10 aa, Influenza virus
PTDTPRVQDS

SEQ ID NO: 508926 - protein, 10 aa, Influenza virus
PTDVIRSWRK

SEQ ID NO: 508927 - protein, 10 aa, Influenza virus
PTDVVRSWKK

SEQ ID NO: 508928 - protein, 10 aa, Influenza virus
PTDVVRSWRK

SEQ ID NO: 508929 - protein, 10 aa, Influenza virus
PTDVVRSWRR

SEQ ID NO: 508930 - protein, 10 aa, Influenza virus
PTECRTFFLT

SEQ ID NO: 508931 - protein, 10 aa, Influenza virus
PTEEQAVDIC

SEQ ID NO: 508932 - protein, 10 aa, Influenza virus
PTEEQAVGIC

SEQ ID NO: 508933 - protein, 10 aa, Influenza virus
PTEEQAVNIC

SEQ ID NO: 508934 - protein, 10 aa, Influenza virus
PTFDSLNITA

SEQ ID NO: 508935 - protein, 10 aa, Influenza virus
PTFSVQRNLP

SEQ ID NO: 508936 - protein, 10 aa, Influenza virus
PTFSVQRSLP

SEQ ID NO: 508937 - protein, 10 aa, Influenza virus
PTGCKMYALH

SEQ ID NO: 508938 - protein, 10 aa, Influenza virus
PTGYAQTDCV

SEQ ID NO: 508939 - protein, 10 aa, Influenza virus
PTKSYFANLK

SEQ ID NO: 508940 - protein, 10 aa, Influenza virus
PTTEINTWAR

SEQ ID NO: 508941 - protein, 10 aa, Influenza virus
PTTTIKTWAR

SEQ ID NO: 508942 - protein, 10 aa, Influenza virus
PVAEINTWAR

SEQ ID NO: 508943 - protein, 10 aa, Influenza virus
PVAKAGFIEN

SEQ ID NO: 508944 - protein, 10 aa, Influenza virus
PVELSSGYKD

SEQ ID NO: 508945 - protein, 10 aa, Influenza virus
PVGEAPSPYN

SEQ ID NO: 508946 - protein, 10 aa, Influenza virus
PVGGNEKKAK

SEQ ID NO: 508947 - protein, 10 aa, Influenza virus
PVGISSMGEA

SEQ ID NO: 508948 - protein, 10 aa, Influenza virus
PVGISSMMEA

SEQ ID NO: 508949 - protein, 10 aa, Influenza virus
PVGISSMVEA

SEQ ID NO: 508950 - protein, 10 aa, Influenza virus
PVGPGSFPDG

SEQ ID NO: 508951 - protein, 10 aa, Influenza virus
PVGSGSFPDG

SEQ ID NO: 508952 - protein, 10 aa, Influenza virus
PVGTAPVLGN

SEQ ID NO: 508953 - protein, 10 aa, Influenza virus
PVGVAPSPSN

SEQ ID NO: 508954 - protein, 10 aa, Influenza virus
PVHFQNQVKI

SEQ ID NO: 508955 - protein, 10 aa, Influenza virus
PVHFRNQIKI

SEQ ID NO: 508956 - protein, 10 aa, Influenza virus
PVHFRNQVKI

SEQ ID NO: 508957 - protein, 10 aa, Influenza virus
PVHFRSQVKI

SEQ ID NO: 508958 - protein, 10 aa, Influenza virus
PVHKSQLIWM

SEQ ID NO: 508959 - protein, 10 aa, Influenza virus
PVHKSQLVWM

SEQ ID NO: 508960 - protein, 10 aa, Influenza virus
PVHLGDCNFE

SEQ ID NO: 508961 - protein, 10 aa, Influenza virus
PVHLGDCRFE

SEQ ID NO: 508962 - protein, 10 aa, Influenza virus
PVHLGDCSFE

SEQ ID NO: 508963 - protein, 10 aa, Influenza virus
PVICLGHHAV

SEQ ID NO: 508964 - protein, 10 aa, Influenza virus
PVICLGHHSV

SEQ ID NO: 508965 - protein, 10 aa, Influenza virus
PVICMGHHAV

SEQ ID NO: 508966 - protein, 10 aa, Influenza virus
PVIGARPQVN

SEQ ID NO: 508967 - protein, 10 aa, Influenza virus
PVIMTDGPAN

SEQ ID NO: 508968 - protein, 10 aa, Influenza virus
PVKGWAPLSK

SEQ ID NO: 508969 - protein, 10 aa, Influenza virus
PVKLNSGYKD

SEQ ID NO: 508970 - protein, 10 aa, Influenza virus
PVKLSGGYKD

SEQ ID NO: 508971 - protein, 10 aa, Influenza virus
PVKLSNGYKD

SEQ ID NO: 508972 - protein, 10 aa, Influenza virus
PVKLSSGYKD

SEQ ID NO: 508973 - protein, 10 aa, Influenza virus
PVKLSSGYKE

SEQ ID NO: 508974 - protein, 10 aa, Influenza virus
PVLGNYKEIC

SEQ ID NO: 508975 - protein, 10 aa, Influenza virus
PVLGNYKEMC

SEQ ID NO: 508976 - protein, 10 aa, Influenza virus
PVLGNYREIC

SEQ ID NO: 508977 - protein, 10 aa, Influenza virus
PVLGNYREVC

SEQ ID NO: 508978 - protein, 10 aa, Influenza virus
PVLTDNPRPN

SEQ ID NO: 508979 - protein, 10 aa, Influenza virus
PVMGARPQVN

SEQ ID NO: 508980 - protein, 10 aa, Influenza virus
PVNGQSGRID

SEQ ID NO: 508981 - protein, 10 aa, Influenza virus
PVNNGKGRYG

SEQ ID NO: 508982 - protein, 10 aa, Influenza virus
PVPVGSGSFP

SEQ ID NO: 508983 - protein, 10 aa, Influenza virus
PVQNAISTTF

SEQ ID NO: 508984 - protein, 10 aa, Influenza virus
PVQSKMQFSS

SEQ ID NO: 508985 - protein, 10 aa, Influenza virus
PVQSRMQFSS

SEQ ID NO: 508986 - protein, 10 aa, Influenza virus
PVQTDEYKNT

SEQ ID NO: 508987 - protein, 10 aa, Influenza virus
PVRLSSGYKD

SEQ ID NO: 508988 - protein, 10 aa, Influenza virus
PVSVGSGSFP

SEQ ID NO: 508989 - protein, 10 aa, Influenza virus
PVTEINTWAR

SEQ ID NO: 508990 - protein, 10 aa, Influenza virus
PVTIGECPKY

SEQ ID NO: 508991 - protein, 10 aa, Influenza virus
PVTIGKCPKY

SEQ ID NO: 508992 - protein, 10 aa, Influenza virus
PVTLSSGYKD

SEQ ID NO: 508993 - protein, 10 aa, Influenza virus
PVTLTMGYKD

SEQ ID NO: 508994 - protein, 10 aa, Influenza virus
PVTQAMELVE

SEQ ID NO: 508995 - protein, 10 aa, Influenza virus
PVTQTMELVE

SEQ ID NO: 508996 - protein, 10 aa, Influenza virus
PVTQVEELVH

SEQ ID NO: 508997 - protein, 10 aa, Influenza virus
PVTSSIDLIE

SEQ ID NO: 508998 - protein, 10 aa, Influenza virus
PVTSSIDLVE

SEQ ID NO: 508999 - protein, 10 aa, Influenza virus
PVTSSVDLIE

SEQ ID NO: 509000 - protein, 10 aa, Influenza virus
PVTSSVDLVE

SEQ ID NO: 509001 - protein, 10 aa, Influenza virus
PVTSTIDLIE

SEQ ID NO: 509002 - protein, 10 aa, Influenza virus
PVVFTDGSAT

SEQ ID NO: 509003 - protein, 10 aa, Influenza virus
PVVGARPKVN

SEQ ID NO: 509004 - protein, 10 aa, Influenza virus
PVVGARPQVN

SEQ ID NO: 509005 - protein, 10 aa, Influenza virus
PVVMTDGPAD

SEQ ID NO: 509006 - protein, 10 aa, Influenza virus
PVVMTDGPAN

SEQ ID NO: 509007 - protein, 10 aa, Influenza virus
PVVMTDGPAS

SEQ ID NO: 509008 - protein, 10 aa, Influenza virus
PVVPSFDMSN

SEQ ID NO: 509009 - protein, 10 aa, Influenza virus
PVVRARPQVN

SEQ ID NO: 509010 - protein, 10 aa, Influenza virus
PWARNILRTQ

SEQ ID NO: 509011 - protein, 10 aa, Influenza virus
PWIRFNSDLD

SEQ ID NO: 509012 - protein, 10 aa, Influenza virus
PWIRFNSDLN

SEQ ID NO: 509013 - protein, 10 aa, Influenza virus
PWIRFNSNLD

SEQ ID NO: 509014 - protein, 10 aa, Influenza virus
PWIRINNETI

SEQ ID NO: 509015 - protein, 10 aa, Influenza virus
PWMRINNETI

SEQ ID NO: 509016 - protein, 10 aa, Influenza virus
PWMRISNETI

SEQ ID NO: 509017 - protein, 10 aa, Influenza virus
PWVLLNASWF

SEQ ID NO: 509018 - protein, 10 aa, Influenza virus
PWVRFNSDLD

SEQ ID NO: 509019 - protein, 10 aa, Influenza virus
PWVRINNETI

SEQ ID NO: 509020 - protein, 10 aa, Influenza virus
PWVRMNNETI

SEQ ID NO: 509021 - protein, 10 aa, Influenza virus
PYIGKCPKYI

SEQ ID NO: 509022 - protein, 10 aa, Influenza virus
PYLNGREWSY

SEQ ID NO: 509023 - protein, 10 aa, Influenza virus
PYNSKFESVA

SEQ ID NO: 509024 - protein, 10 aa, Influenza virus
PYNSRFESVA

SEQ ID NO: 509025 - protein, 10 aa, Influenza virus
PYPGNNNGVK

SEQ ID NO: 509026 - protein, 10 aa, Influenza virus
PYPGNNNNGV

SEQ ID NO: 509027 - protein, 10 aa, Influenza virus
PYPGNSNNGV

SEQ ID NO: 509028 - protein, 10 aa, Influenza virus
PYPGSNNNGV

SEQ ID NO: 509029 - protein, 10 aa, Influenza virus
PYRALISWEM

SEQ ID NO: 509030 - protein, 10 aa, Influenza virus
PYRALMSVPL

SEQ ID NO: 509031 - protein, 10 aa, Influenza virus
PYRALMSVPM

SEQ ID NO: 509032 - protein, 10 aa, Influenza virus
PYRSLIQFPI

SEQ ID NO: 509033 - protein, 10 aa, Influenza virus
PYRSLIQFPM

SEQ ID NO: 509034 - protein, 10 aa, Influenza virus
PYRSLIRFPI

SEQ ID NO: 509035 - protein, 10 aa, Influenza virus
PYRSLIRFPV

SEQ ID NO: 509036 - protein, 10 aa, Influenza virus
PYRTLLMNEL

SEQ ID NO: 509037 - protein, 10 aa, Influenza virus
PYRTLLMSEL

SEQ ID NO: 509038 - protein, 10 aa, Influenza virus
PYSHGTGTGY

SEQ ID NO: 509039 - protein, 10 aa, Influenza virus
PYTGDPPYSH

SEQ ID NO: 509040 - protein, 10 aa, Influenza virus
PYTLVSTGSW

SEQ ID NO: 509041 - protein, 10 aa, Influenza virus
PYTLVSTKEW

SEQ ID NO: 509042 - protein, 10 aa, Influenza virus
PYTLVSTKSW

SEQ ID NO: 509043 - protein, 10 aa, Influenza virus
PYTLVSTRSW

SEQ ID NO: 509044 - protein, 10 aa, Influenza virus
PYTLVSTSSW

SEQ ID NO: 509045 - protein, 10 aa, Influenza virus
PYTLVTTSSW

SEQ ID NO: 509046 - protein, 10 aa, Influenza virus
PYVSCDPDEC

SEQ ID NO: 509047 - protein, 10 aa, Influenza virus
PYVSCDPDGC

SEQ ID NO: 509048 - protein, 10 aa, Influenza virus
PYVSCDPLGC

SEQ ID NO: 509049 - protein, 10 aa, Influenza virus
PYVSCDPNEC

SEQ ID NO: 509050 - protein, 10 aa, Influenza virus
PYVSCDPSGC

SEQ ID NO: 509051 - protein, 10 aa, Influenza virus
PYVSCDPTGC

SEQ ID NO: 509052 - protein, 10 aa, Influenza virus
PYVSCEPDEC

SEQ ID NO: 509053 - protein, 10 aa, Influenza virus
QAADLKSTQA

SEQ ID NO: 509054 - protein, 10 aa, Influenza virus
QAADLKSTQT

SEQ ID NO: 509055 - protein, 10 aa, Influenza virus
QAADYESTQA

SEQ ID NO: 509056 - protein, 10 aa, Influenza virus
QAADYKSTQA

SEQ ID NO: 509057 - protein, 10 aa, Influenza virus
QAADYKSTQK

SEQ ID NO: 509058 - protein, 10 aa, Influenza virus
QAADYKSTQT

SEQ ID NO: 509059 - protein, 10 aa, Influenza virus
QAAIDQINGK

SEQ ID NO: 509060 - protein, 10 aa, Influenza virus
QAAIDQISGK

SEQ ID NO: 509061 - protein, 10 aa, Influenza virus
QAAIDQITGK

SEQ ID NO: 509062 - protein, 10 aa, Influenza virus
QAAIDQVNGK

SEQ ID NO: 509063 - protein, 10 aa, Influenza virus
QAAVDQITGK

SEQ ID NO: 509064 - protein, 10 aa, Influenza virus
QADEICIGYL

SEQ ID NO: 509065 - protein, 10 aa, Influenza virus
QADEICIGYM

SEQ ID NO: 509066 - protein, 10 aa, Influenza virus
QADSEMNKLY

SEQ ID NO: 509067 - protein, 10 aa, Influenza virus
QAELLIAMEN

SEQ ID NO: 509068 - protein, 10 aa, Influenza virus
QAELLVAMEN

SEQ ID NO: 509069 - protein, 10 aa, Influenza virus
QAFRDNLEPG

SEQ ID NO: 509070 - protein, 10 aa, Influenza virus
QAFYKILKIK

SEQ ID NO: 509071 - protein, 10 aa, Influenza virus
QAFYKILKIR

SEQ ID NO: 509072 - protein, 10 aa, Influenza virus
QAFYRSINWL

SEQ ID NO: 509073 - protein, 10 aa, Influenza virus
QAGRIDFHWM

SEQ ID NO: 509074 - protein, 10 aa, Influenza virus
QAGRMTFYWA

SEQ ID NO: 509075 - protein, 10 aa, Influenza virus
QAGRMTFYWK

SEQ ID NO: 509076 - protein, 10 aa, Influenza virus
QAGRMTFYWT

SEQ ID NO: 509077 - protein, 10 aa, Influenza virus
QAGVDRFYRI

SEQ ID NO: 509078 - protein, 10 aa, Influenza virus
QAGVDRFYRT

SEQ ID NO: 509079 - protein, 10 aa, Influenza virus
QAGVNRFYRT

SEQ ID NO: 509080 - protein, 10 aa, Influenza virus
QAHTKVLYFH

SEQ ID NO: 509081 - protein, 10 aa, Influenza virus
QAKFEAVAWS

SEQ ID NO: 509082 - protein, 10 aa, Influenza virus
QAKFESVAWS

SEQ ID NO: 509083 - protein, 10 aa, Influenza virus
QAKGLFGAIA

SEQ ID NO: 509084 - protein, 10 aa, Influenza virus
QALKDNLEPG

SEQ ID NO: 509085 - protein, 10 aa, Influenza virus
QALQLLFEVE

SEQ ID NO: 509086 - protein, 10 aa, Influenza virus
QALQLLLEVE

SEQ ID NO: 509087 - protein, 10 aa, Influenza virus
QALRDNLEPG

SEQ ID NO: 509088 - protein, 10 aa, Influenza virus
QALRDSLEPG

SEQ ID NO: 509089 - protein, 10 aa, Influenza virus
QAMELVEAEK

SEQ ID NO: 509090 - protein, 10 aa, Influenza virus
QANLCRFLET

SEQ ID NO: 509091 - protein, 10 aa, Influenza virus
QAQDRGLFGA

SEQ ID NO: 509092 - protein, 10 aa, Influenza virus
QAQNRGLFGA

SEQ ID NO: 509093 - protein, 10 aa, Influenza virus
QARFEAVAWS

SEQ ID NO: 509094 - protein, 10 aa, Influenza virus
QARFESVAWS

SEQ ID NO: 509095 - protein, 10 aa, Influenza virus
QASPSCLVVR

SEQ ID NO: 509096 - protein, 10 aa, Influenza virus
QASYKIFKSH

SEQ ID NO: 509097 - protein, 10 aa, Influenza virus
QASYKIFKSQ

SEQ ID NO: 509098 - protein, 10 aa, Influenza virus
QASYKIFKSR

SEQ ID NO: 509099 - protein, 10 aa, Influenza virus
QASYKIFKSY

SEQ ID NO: 509100 - protein, 10 aa, Influenza virus
QASYRIFKSH

SEQ ID NO: 509101 - protein, 10 aa, Influenza virus
QATIDQITGK

SEQ ID NO: 509102 - protein, 10 aa, Influenza virus
QAVDICKAAI

SEQ ID NO: 509103 - protein, 10 aa, Influenza virus
QAVDICKAAL

SEQ ID NO: 509104 - protein, 10 aa, Influenza virus
QAVDICKAAM

SEQ ID NO: 509105 - protein, 10 aa, Influenza virus
QAVGICKAAM

SEQ ID NO: 509106 - protein, 10 aa, Influenza virus
QAVNICKAAM

SEQ ID NO: 509107 - protein, 10 aa, Influenza virus
QAWSYIVERP

SEQ ID NO: 509108 - protein, 10 aa, Influenza virus
QAYQKRMGLQ

SEQ ID NO: 509109 - protein, 10 aa, Influenza virus
QAYQKRMGVQ

SEQ ID NO: 509110 - protein, 10 aa, Influenza virus
QAYTKILYFH

SEQ ID NO: 509111 - protein, 10 aa, Influenza virus
QAYTKIMYFH

SEQ ID NO: 509112 - protein, 10 aa, Influenza virus
QAYTKVLYFH

SEQ ID NO: 509113 - protein, 10 aa, Influenza virus
QAYTKVMYFH

SEQ ID NO: 509114 - protein, 10 aa, Influenza virus
QCDLHLEFKA

SEQ ID NO: 509115 - protein, 10 aa, Influenza virus
QCDNNCIESI

SEQ ID NO: 509116 - protein, 10 aa, Influenza virus
QCDSHLKFKA

SEQ ID NO: 509117 - protein, 10 aa, Influenza virus
QCEITGFAPF

SEQ ID NO: 509118 - protein, 10 aa, Influenza virus
QCFNPMIAEL

SEQ ID NO: 509119 - protein, 10 aa, Influenza virus
QCFNPMIIEL

SEQ ID NO: 509120 - protein, 10 aa, Influenza virus
QCFNPMIVEL

SEQ ID NO: 509121 - protein, 10 aa, Influenza virus
QCFNPMTVEL

SEQ ID NO: 509122 - protein, 10 aa, Influenza virus
QCFNPMVVEL

SEQ ID NO: 509123 - protein, 10 aa, Influenza virus
QCKITGFAPF

SEQ ID NO: 509124 - protein, 10 aa, Influenza virus
QCMESIRNNT

SEQ ID NO: 509125 - protein, 10 aa, Influenza virus
QCQIAGFAPF

SEQ ID NO: 509126 - protein, 10 aa, Influenza virus
QCQITGFAPF

SEQ ID NO: 509127 - protein, 10 aa, Influenza virus
QCQTPLGAIN

SEQ ID NO: 509128 - protein, 10 aa, Influenza virus
QCQVTGFAPF

SEQ ID NO: 509129 - protein, 10 aa, Influenza virus
QCRICIDFRD

SEQ ID NO: 509130 - protein, 10 aa, Influenza virus
QCRICILDQN

SEQ ID NO: 509131 - protein, 10 aa, Influenza virus
QCRICIRADG

SEQ ID NO: 509132 - protein, 10 aa, Influenza virus
QDAMTEVWSY

SEQ ID NO: 509133 - protein, 10 aa, Influenza virus
QDCDLINGAL

SEQ ID NO: 509134 - protein, 10 aa, Influenza virus
QDEFCYTLIT

SEQ ID NO: 509135 - protein, 10 aa, Influenza virus
QDEFCYTLMT

SEQ ID NO: 509136 - protein, 10 aa, Influenza virus
QDEFCYTLVT

SEQ ID NO: 509137 - protein, 10 aa, Influenza virus
QDGKSSACKR

SEQ ID NO: 509138 - protein, 10 aa, Influenza virus
QDIIDNDNWS

SEQ ID NO: 509139 - protein, 10 aa, Influenza virus
QDIIDNNNWS

SEQ ID NO: 509140 - protein, 10 aa, Influenza virus
QDILEKTHNG

SEQ ID NO: 509141 - protein, 10 aa, Influenza virus
QDIWAYNAEL

SEQ ID NO: 509142 - protein, 10 aa, Influenza virus
QDLEEYVEDT

SEQ ID NO: 509143 - protein, 10 aa, Influenza virus
QDLEKYVEDT

SEQ ID NO: 509144 - protein, 10 aa, Influenza virus
QDLERYVEDT

SEQ ID NO: 509145 - protein, 10 aa, Influenza virus
QDLWAYNAEL

SEQ ID NO: 509146 - protein, 10 aa, Influenza virus
QDNAIRFGES

SEQ ID NO: 509147 - protein, 10 aa, Influenza virus
QDNAKDEGNG

SEQ ID NO: 509148 - protein, 10 aa, Influenza virus
QDRGLFGAIA

SEQ ID NO: 509149 - protein, 10 aa, Influenza virus
QDRGLFGAKA

SEQ ID NO: 509150 - protein, 10 aa, Influenza virus
QDSECVSHNG

SEQ ID NO: 509151 - protein, 10 aa, Influenza virus
QDSFYRSMKW

SEQ ID NO: 509152 - protein, 10 aa, Influenza virus
QDTEISFTIT

SEQ ID NO: 509153 - protein, 10 aa, Influenza virus
QDTELSFTIT

SEQ ID NO: 509154 - protein, 10 aa, Influenza virus
QDTELSFTVT

SEQ ID NO: 509155 - protein, 10 aa, Influenza virus
QDTEVSFTIT

SEQ ID NO: 509156 - protein, 10 aa, Influenza virus
QDTTWDVFIE

SEQ ID NO: 509157 - protein, 10 aa, Influenza virus
QDVIMEVVFP

SEQ ID NO: 509158 - protein, 10 aa, Influenza virus
QDVWAYNAEL

SEQ ID NO: 509159 - protein, 10 aa, Influenza virus
QDWSGYSGAF

SEQ ID NO: 509160 - protein, 10 aa, Influenza virus
QDWSYIVERP

SEQ ID NO: 509161 - protein, 10 aa, Influenza virus
QEAIDKITNK

SEQ ID NO: 509162 - protein, 10 aa, Influenza virus
QEAIEKITNK

SEQ ID NO: 509163 - protein, 10 aa, Influenza virus
QEAIGKITNK

SEQ ID NO: 509164 - protein, 10 aa, Influenza virus
QEAINKITNK

SEQ ID NO: 509165 - protein, 10 aa, Influenza virus
QEALQNRIMI

SEQ ID NO: 509166 - protein, 10 aa, Influenza virus
QEARVWWTSN

SEQ ID NO: 509167 - protein, 10 aa, Influenza virus
QEDCMIKAVR

SEQ ID NO: 509168 - protein, 10 aa, Influenza virus
QEDCMMKAVR

SEQ ID NO: 509169 - protein, 10 aa, Influenza virus
QEDCMVKAVR

SEQ ID NO: 509170 - protein, 10 aa, Influenza virus
QEDRMIKAVR

SEQ ID NO: 509171 - protein, 10 aa, Influenza virus
QEECMIKAVR

SEQ ID NO: 509172 - protein, 10 aa, Influenza virus
QEELKSLFSS

SEQ ID NO: 509173 - protein, 10 aa, Influenza virus
QEELRFLFSS

SEQ ID NO: 509174 - protein, 10 aa, Influenza virus
QEELRSLFSS

SEQ ID NO: 509175 - protein, 10 aa, Influenza virus
QEEVTNATET

SEQ ID NO: 509176 - protein, 10 aa, Influenza virus
QEFKMNPNKK

SEQ ID NO: 509177 - protein, 10 aa, Influenza virus
QEFKMNPNQK

SEQ ID NO: 509178 - protein, 10 aa, Influenza virus
QEIDGIKLKS

SEQ ID NO: 509179 - protein, 10 aa, Influenza virus
QEIEGIKLES

SEQ ID NO: 509180 - protein, 10 aa, Influenza virus
QEIEGIKLKS

SEQ ID NO: 509181 - protein, 10 aa, Influenza virus
QEIEGIKLKT

SEQ ID NO: 509182 - protein, 10 aa, Influenza virus
QEIEGIRLKS

SEQ ID NO: 509183 - protein, 10 aa, Influenza virus
QEIGNGCFEF

SEQ ID NO: 509184 - protein, 10 aa, Influenza virus
QEIKMNPNQK

SEQ ID NO: 509185 - protein, 10 aa, Influenza virus
QEINGIKLKS

SEQ ID NO: 509186 - protein, 10 aa, Influenza virus
QEIVDNKNWS

SEQ ID NO: 509187 - protein, 10 aa, Influenza virus
QEIVDNNNWS

SEQ ID NO: 509188 - protein, 10 aa, Influenza virus
QEIVDNSNWS

SEQ ID NO: 509189 - protein, 10 aa, Influenza virus
QEIVGNDNWS

SEQ ID NO: 509190 - protein, 10 aa, Influenza virus
QEIVSNDNWS

SEQ ID NO: 509191 - protein, 10 aa, Influenza virus
QEKNDLYGAQ

SEQ ID NO: 509192 - protein, 10 aa, Influenza virus
QEKNDLYGTQ

SEQ ID NO: 509193 - protein, 10 aa, Influenza virus
QEKNPALRMK

SEQ ID NO: 509194 - protein, 10 aa, Influenza virus
QEKNPSLRMK

SEQ ID NO: 509195 - protein, 10 aa, Influenza virus
QELGDAPFLD

SEQ ID NO: 509196 - protein, 10 aa, Influenza virus
QENRVWWTSN

SEQ ID NO: 509197 - protein, 10 aa, Influenza virus
QERGLFGAIA

SEQ ID NO: 509198 - protein, 10 aa, Influenza virus
QERNDLYGTQ

SEQ ID NO: 509199 - protein, 10 aa, Influenza virus
QESECACANG

SEQ ID NO: 509200 - protein, 10 aa, Influenza virus
QESECACING

SEQ ID NO: 509201 - protein, 10 aa, Influenza virus
QESECACVNG

SEQ ID NO: 509202 - protein, 10 aa, Influenza virus
QESECICING

SEQ ID NO: 509203 - protein, 10 aa, Influenza virus
QESECICINR

SEQ ID NO: 509204 - protein, 10 aa, Influenza virus
QESECLCIDG

SEQ ID NO: 509205 - protein, 10 aa, Influenza virus
QESECQCIDG

SEQ ID NO: 509206 - protein, 10 aa, Influenza virus
QESECQCIGG

SEQ ID NO: 509207 - protein, 10 aa, Influenza virus
QESECQCISG

SEQ ID NO: 509208 - protein, 10 aa, Influenza virus
QESECQRIDG

SEQ ID NO: 509209 - protein, 10 aa, Influenza virus
QESECVCHDG

SEQ ID NO: 509210 - protein, 10 aa, Influenza virus
QESECVCHKG

SEQ ID NO: 509211 - protein, 10 aa, Influenza virus
QESECVCHNG

SEQ ID NO: 509212 - protein, 10 aa, Influenza virus
QESECVCHNS

SEQ ID NO: 509213 - protein, 10 aa, Influenza virus
QESECVCHSG

SEQ ID NO: 509214 - protein, 10 aa, Influenza virus
QESECVCING

SEQ ID NO: 509215 - protein, 10 aa, Influenza virus
QESECVCISG

SEQ ID NO: 509216 - protein, 10 aa, Influenza virus
QESECVCMNG

SEQ ID NO: 509217 - protein, 10 aa, Influenza virus
QESECVCQDE

SEQ ID NO: 509218 - protein, 10 aa, Influenza virus
QESECVCVNG

SEQ ID NO: 509219 - protein, 10 aa, Influenza virus
QESECVRHNG

SEQ ID NO: 509220 - protein, 10 aa, Influenza virus
QESLLLATGM

SEQ ID NO: 509221 - protein, 10 aa, Influenza virus
QESLMLATGM

SEQ ID NO: 509222 - protein, 10 aa, Influenza virus
QESSCTCIKG

SEQ ID NO: 509223 - protein, 10 aa, Influenza virus
QESSCTCILG

SEQ ID NO: 509224 - protein, 10 aa, Influenza virus
QESSCTCIQG

SEQ ID NO: 509225 - protein, 10 aa, Influenza virus
QESSCTCIRG

SEQ ID NO: 509226 - protein, 10 aa, Influenza virus
QESSCVCIKG

SEQ ID NO: 509227 - protein, 10 aa, Influenza virus
QESSCVCMKG

SEQ ID NO: 509228 - protein, 10 aa, Influenza virus
QESSCVCMNG

SEQ ID NO: 509229 - protein, 10 aa, Influenza virus
QESSCVCVKG

SEQ ID NO: 509230 - protein, 10 aa, Influenza virus
QETRVWWTSN

SEQ ID NO: 509231 - protein, 10 aa, Influenza virus
QFALGHGTTL

SEQ ID NO: 509232 - protein, 10 aa, Influenza virus
QFALGQGATL

SEQ ID NO: 509233 - protein, 10 aa, Influenza virus
QFALGQGTTL

SEQ ID NO: 509234 - protein, 10 aa, Influenza virus
QFEAIGREFN

SEQ ID NO: 509235 - protein, 10 aa, Influenza virus
QFEAVGKEFN

SEQ ID NO: 509236 - protein, 10 aa, Influenza virus
QFEAVGREFN

SEQ ID NO: 509237 - protein, 10 aa, Influenza virus
QFEAVGREFS

SEQ ID NO: 509238 - protein, 10 aa, Influenza virus
QFELIDNEFN

SEQ ID NO: 509239 - protein, 10 aa, Influenza virus
QFELIDNEFS

SEQ ID NO: 509240 - protein, 10 aa, Influenza virus
QFELIDNEFT

SEQ ID NO: 509241 - protein, 10 aa, Influenza virus
QFELIDNKFN

SEQ ID NO: 509242 - protein, 10 aa, Influenza virus
QFEMIDNEFN

SEQ ID NO: 509243 - protein, 10 aa, Influenza virus
QFGRIDFHWL

SEQ ID NO: 509244 - protein, 10 aa, Influenza virus
QFGRINFHWL

SEQ ID NO: 509245 - protein, 10 aa, Influenza virus
QFPVQTDEYK

SEQ ID NO: 509246 - protein, 10 aa, Influenza virus
QFRALISWEM

SEQ ID NO: 509247 - protein, 10 aa, Influenza virus
QFSSLAVNVR

SEQ ID NO: 509248 - protein, 10 aa, Influenza virus
QFSSLTVNVR

SEQ ID NO: 509249 - protein, 10 aa, Influenza virus
QFSSLTVSVR

SEQ ID NO: 509250 - protein, 10 aa, Influenza virus
QFTAVGKEFN

SEQ ID NO: 509251 - protein, 10 aa, Influenza virus
QFTAVGKEFS

SEQ ID NO: 509252 - protein, 10 aa, Influenza virus
QFTSVGKEFN

SEQ ID NO: 509253 - protein, 10 aa, Influenza virus
QFTWNGVKVD

SEQ ID NO: 509254 - protein, 10 aa, Influenza virus
QGACWEQLYT

SEQ ID NO: 509255 - protein, 10 aa, Influenza virus
QGAGYAADKE

SEQ ID NO: 509256 - protein, 10 aa, Influenza virus
QGALLGTKHS

SEQ ID NO: 509257 - protein, 10 aa, Influenza virus
QGALLGTNHS

SEQ ID NO: 509258 - protein, 10 aa, Influenza virus
QGALLGTRHS

SEQ ID NO: 509259 - protein, 10 aa, Influenza virus
QGALLNDKHS

SEQ ID NO: 509260 - protein, 10 aa, Influenza virus
QGALLNDRHS

SEQ ID NO: 509261 - protein, 10 aa, Influenza virus
QGALVGTKHS

SEQ ID NO: 509262 - protein, 10 aa, Influenza virus
QGANRPIIEI

SEQ ID NO: 509263 - protein, 10 aa, Influenza virus
QGANRPVIEI

SEQ ID NO: 509264 - protein, 10 aa, Influenza virus
QGANRPVIKI

SEQ ID NO: 509265 - protein, 10 aa, Influenza virus
QGDIVLVMKR

SEQ ID NO: 509266 - protein, 10 aa, Influenza virus
QGDNENATAT

SEQ ID NO: 509267 - protein, 10 aa, Influenza virus
QGDVVLVMKR

SEQ ID NO: 509268 - protein, 10 aa, Influenza virus
QGEGIAADYK

SEQ ID NO: 509269 - protein, 10 aa, Influenza virus
QGEGTAADYK

SEQ ID NO: 509270 - protein, 10 aa, Influenza virus
QGFAPFSKDN

SEQ ID NO: 509271 - protein, 10 aa, Influenza virus
QGFFPFHKDN

SEQ ID NO: 509272 - protein, 10 aa, Influenza virus
QGGHIEECSC

SEQ ID NO: 509273 - protein, 10 aa, Influenza virus
QGIGQAADYK

SEQ ID NO: 509274 - protein, 10 aa, Influenza virus
QGIKLTQGYK

SEQ ID NO: 509275 - protein, 10 aa, Influenza virus
QGKTKATKME

SEQ ID NO: 509276 - protein, 10 aa, Influenza virus
QGKTKATKMK

SEQ ID NO: 509277 - protein, 10 aa, Influenza virus
QGLIDGWYGF

SEQ ID NO: 509278 - protein, 10 aa, Influenza virus
QGLVDGWYGY

SEQ ID NO: 509279 - protein, 10 aa, Influenza virus
QGMGMAADKE

SEQ ID NO: 509280 - protein, 10 aa, Influenza virus
QGMIDGWYGY

SEQ ID NO: 509281 - protein, 10 aa, Influenza virus
QGMVDGWYGF

SEQ ID NO: 509282 - protein, 10 aa, Influenza virus
QGMVDGWYGY

SEQ ID NO: 509283 - protein, 10 aa, Influenza virus
QGNGCFEIFH

SEQ ID NO: 509284 - protein, 10 aa, Influenza virus
QGNILLSPEE

SEQ ID NO: 509285 - protein, 10 aa, Influenza virus
QGNNDNATAT

SEQ ID NO: 509286 - protein, 10 aa, Influenza virus
QGNNENATAT

SEQ ID NO: 509287 - protein, 10 aa, Influenza virus
QGNNKNATAT

SEQ ID NO: 509288 - protein, 10 aa, Influenza virus
QGNNNNATAT

SEQ ID NO: 509289 - protein, 10 aa, Influenza virus
QGNSVWAGRT

SEQ ID NO: 509290 - protein, 10 aa, Influenza virus
QGNVLLSPEE

SEQ ID NO: 509291 - protein, 10 aa, Influenza virus
QGQGTAADYK

SEQ ID NO: 509292 - protein, 10 aa, Influenza virus
QGQIIVLNTD

SEQ ID NO: 509293 - protein, 10 aa, Influenza virus
QGQTIVLNTD

SEQ ID NO: 509294 - protein, 10 aa, Influenza virus
QGQTIVLTTD

SEQ ID NO: 509295 - protein, 10 aa, Influenza virus
QGQTVVLNTD

SEQ ID NO: 509296 - protein, 10 aa, Influenza virus
QGRGLFGAIA

SEQ ID NO: 509297 - protein, 10 aa, Influenza virus
QGRGLFGAKA

SEQ ID NO: 509298 - protein, 10 aa, Influenza virus
QGRGVFEFSD

SEQ ID NO: 509299 - protein, 10 aa, Influenza virus
QGRGVFELSD

SEQ ID NO: 509300 - protein, 10 aa, Influenza virus
QGRLCNPLNP

SEQ ID NO: 509301 - protein, 10 aa, Influenza virus
QGRLCNPMNP

SEQ ID NO: 509302 - protein, 10 aa, Influenza virus
QGRMDYYWAI

SEQ ID NO: 509303 - protein, 10 aa, Influenza virus
QGRMDYYWAV

SEQ ID NO: 509304 - protein, 10 aa, Influenza virus
QGRMDYYWGI

SEQ ID NO: 509305 - protein, 10 aa, Influenza virus
QGRQTFDWTL

SEQ ID NO: 509306 - protein, 10 aa, Influenza virus
QGRQTYDWTL

SEQ ID NO: 509307 - protein, 10 aa, Influenza virus
QGSARHIEEC

SEQ ID NO: 509308 - protein, 10 aa, Influenza virus
QGSFYRNMRW

SEQ ID NO: 509309 - protein, 10 aa, Influenza virus
QGSFYRSIRW

SEQ ID NO: 509310 - protein, 10 aa, Influenza virus
QGSFYRSMRW

SEQ ID NO: 509311 - protein, 10 aa, Influenza virus
QGSGYAADKA

SEQ ID NO: 509312 - protein, 10 aa, Influenza virus
QGSGYAADKE

SEQ ID NO: 509313 - protein, 10 aa, Influenza virus
QGSGYAADKK

SEQ ID NO: 509314 - protein, 10 aa, Influenza virus
QGSGYAADLK

SEQ ID NO: 509315 - protein, 10 aa, Influenza virus
QGSGYAADQE

SEQ ID NO: 509316 - protein, 10 aa, Influenza virus
QGSGYAADQK

SEQ ID NO: 509317 - protein, 10 aa, Influenza virus
QGSGYAADRE

SEQ ID NO: 509318 - protein, 10 aa, Influenza virus
QGSGYAADRK

SEQ ID NO: 509319 - protein, 10 aa, Influenza virus
QGSLKLATGM

SEQ ID NO: 509320 - protein, 10 aa, Influenza virus
QGSLLNDKHF

SEQ ID NO: 509321 - protein, 10 aa, Influenza virus
QGSLLNDKHS

SEQ ID NO: 509322 - protein, 10 aa, Influenza virus
QGSLLNDRHS

SEQ ID NO: 509323 - protein, 10 aa, Influenza virus
QGSLMLATGM

SEQ ID NO: 509324 - protein, 10 aa, Influenza virus
QGSLRLATGM

SEQ ID NO: 509325 - protein, 10 aa, Influenza virus
QGSNRPVIQI

SEQ ID NO: 509326 - protein, 10 aa, Influenza virus
QGSNRPVIRI

SEQ ID NO: 509327 - protein, 10 aa, Influenza virus
QGSTLPRRSG

SEQ ID NO: 509328 - protein, 10 aa, Influenza virus
QGSYNNTSGE

SEQ ID NO: 509329 - protein, 10 aa, Influenza virus
QGTAADYKST

SEQ ID NO: 509330 - protein, 10 aa, Influenza virus
QGTCWEQLYT

SEQ ID NO: 509331 - protein, 10 aa, Influenza virus
QGTCWEQMYT

SEQ ID NO: 509332 - protein, 10 aa, Influenza virus
QGTGIAADKA

SEQ ID NO: 509333 - protein, 10 aa, Influenza virus
QGTGIAADKE

SEQ ID NO: 509334 - protein, 10 aa, Influenza virus
QGTGIAADKT

SEQ ID NO: 509335 - protein, 10 aa, Influenza virus
QGTGIAADKV

SEQ ID NO: 509336 - protein, 10 aa, Influenza virus
QGTGIAAEKE

SEQ ID NO: 509337 - protein, 10 aa, Influenza virus
QGTGQAADYE

SEQ ID NO: 509338 - protein, 10 aa, Influenza virus
QGTGQAADYK

SEQ ID NO: 509339 - protein, 10 aa, Influenza virus
QGTKRSHEQM

SEQ ID NO: 509340 - protein, 10 aa, Influenza virus
QGTKRSYEQM

SEQ ID NO: 509341 - protein, 10 aa, Influenza virus
QGTMDYYWGI

SEQ ID NO: 509342 - protein, 10 aa, Influenza virus
QGTSVWAGRT

SEQ ID NO: 509343 - protein, 10 aa, Influenza virus
QGTTIRGKHS

SEQ ID NO: 509344 - protein, 10 aa, Influenza virus
QGTTIRGRHS

SEQ ID NO: 509345 - protein, 10 aa, Influenza virus
QGTTIRNKHS

SEQ ID NO: 509346 - protein, 10 aa, Influenza virus
QGTTIRNRHS

SEQ ID NO: 509347 - protein, 10 aa, Influenza virus
QGTTLDNEHS

SEQ ID NO: 509348 - protein, 10 aa, Influenza virus
QGTTLDNKHS

SEQ ID NO: 509349 - protein, 10 aa, Influenza virus
QGTTLENKHS

SEQ ID NO: 509350 - protein, 10 aa, Influenza virus
QGTTLKGRHA

SEQ ID NO: 509351 - protein, 10 aa, Influenza virus
QGTTLNNKHS

SEQ ID NO: 509352 - protein, 10 aa, Influenza virus
QGTTLRGQHA

SEQ ID NO: 509353 - protein, 10 aa, Influenza virus
QGTTLRGRHA

SEQ ID NO: 509354 - protein, 10 aa, Influenza virus
QGTTLYNKHS

SEQ ID NO: 509355 - protein, 10 aa, Influenza virus
QGVGIAADKE

SEQ ID NO: 509356 - protein, 10 aa, Influenza virus
QGVGMAADKE

SEQ ID NO: 509357 - protein, 10 aa, Influenza virus
QGVKGWAFDN

SEQ ID NO: 509358 - protein, 10 aa, Influenza virus
QGVKLAQGYK

SEQ ID NO: 509359 - protein, 10 aa, Influenza virus
QGVKLIQGYK

SEQ ID NO: 509360 - protein, 10 aa, Influenza virus
QGVKLTQGYK

SEQ ID NO: 509361 - protein, 10 aa, Influenza virus
QGVLLGTKHS

SEQ ID NO: 509362 - protein, 10 aa, Influenza virus
QGVRLTQGYK

SEQ ID NO: 509363 - protein, 10 aa, Influenza virus
QGWMDYYWGI

SEQ ID NO: 509364 - protein, 10 aa, Influenza virus
QGWSYIVERP

SEQ ID NO: 509365 - protein, 10 aa, Influenza virus
QGYGVKGFGF

SEQ ID NO: 509366 - protein, 10 aa, Influenza virus
QGYKDIILWF

SEQ ID NO: 509367 - protein, 10 aa, Influenza virus
QGYKDIILWI

SEQ ID NO: 509368 - protein, 10 aa, Influenza virus
QGYKDIILWV

SEQ ID NO: 509369 - protein, 10 aa, Influenza virus
QHANGTIHDR

SEQ ID NO: 509370 - protein, 10 aa, Influenza virus
QHIEECSCYG

SEQ ID NO: 509371 - protein, 10 aa, Influenza virus
QHIEECSCYP

SEQ ID NO: 509372 - protein, 10 aa, Influenza virus
QHIIDLADSE

SEQ ID NO: 509373 - protein, 10 aa, Influenza virus
QHIIDVTDSE

SEQ ID NO: 509374 - protein, 10 aa, Influenza virus
QHLEECSCYM

SEQ ID NO: 509375 - protein, 10 aa, Influenza virus
QHLEECSCYT

SEQ ID NO: 509376 - protein, 10 aa, Influenza virus
QHLEECSCYV

SEQ ID NO: 509377 - protein, 10 aa, Influenza virus
QHPELTGLDC

SEQ ID NO: 509378 - protein, 10 aa, Influenza virus
QHPELTGLNC

SEQ ID NO: 509379 - protein, 10 aa, Influenza virus
QHPELTGMDC

SEQ ID NO: 509380 - protein, 10 aa, Influenza virus
QHPELTGMNC

SEQ ID NO: 509381 - protein, 10 aa, Influenza virus
QHPELTGVDC

SEQ ID NO: 509382 - protein, 10 aa, Influenza virus
QHPEMTGLDC

SEQ ID NO: 509383 - protein, 10 aa, Influenza virus
QHQNAEGIGI

SEQ ID NO: 509384 - protein, 10 aa, Influenza virus
QHQNAEGTGI

SEQ ID NO: 509385 - protein, 10 aa, Influenza virus
QHQNAEGTGM

SEQ ID NO: 509386 - protein, 10 aa, Influenza virus
QHQNEQGMGM

SEQ ID NO: 509387 - protein, 10 aa, Influenza virus
QHQNEQGTGI

SEQ ID NO: 509388 - protein, 10 aa, Influenza virus
QHQNEQGVGI

SEQ ID NO: 509389 - protein, 10 aa, Influenza virus
QHQNEQGVGM

SEQ ID NO: 509390 - protein, 10 aa, Influenza virus
QHQNSEGTGI

SEQ ID NO: 509391 - protein, 10 aa, Influenza virus
QHRDEEGTGI

SEQ ID NO: 509392 - protein, 10 aa, Influenza virus
QHRNEEGTGI

SEQ ID NO: 509393 - protein, 10 aa, Influenza virus
QHRNEEGTGV

SEQ ID NO: 509394 - protein, 10 aa, Influenza virus
QHSEECSCYV

SEQ ID NO: 509395 - protein, 10 aa, Influenza virus
QHTIDLADSE

SEQ ID NO: 509396 - protein, 10 aa, Influenza virus
QHTIDLTDAE

SEQ ID NO: 509397 - protein, 10 aa, Influenza virus
QHTIDLTDSE

SEQ ID NO: 509398 - protein, 10 aa, Influenza virus
QHTIDLTNSE

SEQ ID NO: 509399 - protein, 10 aa, Influenza virus
QHTIDMADSE

SEQ ID NO: 509400 - protein, 10 aa, Influenza virus
QHTIDMADST

SEQ ID NO: 509401 - protein, 10 aa, Influenza virus
QHTIDMTDSE

SEQ ID NO: 509402 - protein, 10 aa, Influenza virus
QHTIDSTDSE

SEQ ID NO: 509403 - protein, 10 aa, Influenza virus
QHTIDVTDSE

SEQ ID NO: 509404 - protein, 10 aa, Influenza virus
QHTIEMTDSE

SEQ ID NO: 509405 - protein, 10 aa, Influenza virus
QHTIHLTDSE

SEQ ID NO: 509406 - protein, 10 aa, Influenza virus
QHVEECSCYP

SEQ ID NO: 509407 - protein, 10 aa, Influenza virus
QIADAQHRSH

SEQ ID NO: 509408 - protein, 10 aa, Influenza virus
QIADSHHRSH

SEQ ID NO: 509409 - protein, 10 aa, Influenza virus
QIADSQHKSH

SEQ ID NO: 509410 - protein, 10 aa, Influenza virus
QIADSQHRSH

SEQ ID NO: 509411 - protein, 10 aa, Influenza virus
QIAGFAPFSK

SEQ ID NO: 509412 - protein, 10 aa, Influenza virus
QIAGSSEQAA

SEQ ID NO: 509413 - protein, 10 aa, Influenza virus
QIAILAATVT

SEQ ID NO: 509414 - protein, 10 aa, Influenza virus
QIAILATTIT

SEQ ID NO: 509415 - protein, 10 aa, Influenza virus
QIAILATTVT

SEQ ID NO: 509416 - protein, 10 aa, Influenza virus
QIAILVTTVT

SEQ ID NO: 509417 - protein, 10 aa, Influenza virus
QICIGHHANN

SEQ ID NO: 509418 - protein, 10 aa, Influenza virus
QICIGYHANN

SEQ ID NO: 509419 - protein, 10 aa, Influenza virus
QICIGYHSNN

SEQ ID NO: 509420 - protein, 10 aa, Influenza virus
QICVGYHANN

SEQ ID NO: 509421 - protein, 10 aa, Influenza virus
QICVGYHSNN

SEQ ID NO: 509422 - protein, 10 aa, Influenza virus
QIDESCEGEC

SEQ ID NO: 509423 - protein, 10 aa, Influenza virus
QIDPVKLSGG

SEQ ID NO: 509424 - protein, 10 aa, Influenza virus
QIDPVKLSSG

SEQ ID NO: 509425 - protein, 10 aa, Influenza virus
QIDQVKLSSG

SEQ ID NO: 509426 - protein, 10 aa, Influenza virus
QIDSVKLSSG

SEQ ID NO: 509427 - protein, 10 aa, Influenza virus
QIDTIMEKNV

SEQ ID NO: 509428 - protein, 10 aa, Influenza virus
QIEARGLFGA

SEQ ID NO: 509429 - protein, 10 aa, Influenza virus
QIEDLWAYNA

SEQ ID NO: 509430 - protein, 10 aa, Influenza virus
QIEELWAYNA

SEQ ID NO: 509431 - protein, 10 aa, Influenza virus
QIEGLWAYNA

SEQ ID NO: 509432 - protein, 10 aa, Influenza virus
QIEGRIQDLE

SEQ ID NO: 509433 - protein, 10 aa, Influenza virus
QIEKEFEQVE

SEQ ID NO: 509434 - protein, 10 aa, Influenza virus
QIEKEFGQVE

SEQ ID NO: 509435 - protein, 10 aa, Influenza virus
QIEKEFSEIE

SEQ ID NO: 509436 - protein, 10 aa, Influenza virus
QIEKEFSEVE

SEQ ID NO: 509437 - protein, 10 aa, Influenza virus
QIENLWAYNA

SEQ ID NO: 509438 - protein, 10 aa, Influenza virus
QIEPRGLFGA

SEQ ID NO: 509439 - protein, 10 aa, Influenza virus
QIESIIEAES

SEQ ID NO: 509440 - protein, 10 aa, Influenza virus
QIESMIEAES

SEQ ID NO: 509441 - protein, 10 aa, Influenza virus
QIESMVEAES

SEQ ID NO: 509442 - protein, 10 aa, Influenza virus
QIESRGLFGA

SEQ ID NO: 509443 - protein, 10 aa, Influenza virus
QIEVTNATEL

SEQ ID NO: 509444 - protein, 10 aa, Influenza virus
QIGNVINWTK

SEQ ID NO: 509445 - protein, 10 aa, Influenza virus
QIGNVINWTQ

SEQ ID NO: 509446 - protein, 10 aa, Influenza virus
QIGNVINWTR

SEQ ID NO: 509447 - protein, 10 aa, Influenza virus
QIGYICSGVF

SEQ ID NO: 509448 - protein, 10 aa, Influenza virus
QIGYVCSGIF

SEQ ID NO: 509449 - protein, 10 aa, Influenza virus
QIGYVCSGVF

SEQ ID NO: 509450 - protein, 10 aa, Influenza virus
QIIDIWAYNA

SEQ ID NO: 509451 - protein, 10 aa, Influenza virus
QIIKLLPFAA

SEQ ID NO: 509452 - protein, 10 aa, Influenza virus
QIIKLLPFAS

SEQ ID NO: 509453 - protein, 10 aa, Influenza virus
QIIRESGGID

SEQ ID NO: 509454 - protein, 10 aa, Influenza virus
QIISLCSIWF

SEQ ID NO: 509455 - protein, 10 aa, Influenza virus
QIIVILVLGL

SEQ ID NO: 509456 - protein, 10 aa, Influenza virus
QIIVLNTDWS

SEQ ID NO: 509457 - protein, 10 aa, Influenza virus
QIIVTREPYV

SEQ ID NO: 509458 - protein, 10 aa, Influenza virus
QIKIRRRVDI

SEQ ID NO: 509459 - protein, 10 aa, Influenza virus
QILAIYATVA

SEQ ID NO: 509460 - protein, 10 aa, Influenza virus
QILAIYSTAA

SEQ ID NO: 509461 - protein, 10 aa, Influenza virus
QILAIYSTIS

SEQ ID NO: 509462 - protein, 10 aa, Influenza virus
QILAIYSTVA

SEQ ID NO: 509463 - protein, 10 aa, Influenza virus
QILAIYSTVS

SEQ ID NO: 509464 - protein, 10 aa, Influenza virus
QILRTQESEC

SEQ ID NO: 509465 - protein, 10 aa, Influenza virus
QILRTQESSC

SEQ ID NO: 509466 - protein, 10 aa, Influenza virus
QILSIYSTAA

SEQ ID NO: 509467 - protein, 10 aa, Influenza virus
QILSIYSTVA

SEQ ID NO: 509468 - protein, 10 aa, Influenza virus
QILSIYSTVT

SEQ ID NO: 509469 - protein, 10 aa, Influenza virus
QILSIYSTVV

SEQ ID NO: 509470 - protein, 10 aa, Influenza virus
QILSLYSTVA

SEQ ID NO: 509471 - protein, 10 aa, Influenza virus
QILVIYATVA

SEQ ID NO: 509472 - protein, 10 aa, Influenza virus
QINGKLNRLI

SEQ ID NO: 509473 - protein, 10 aa, Influenza virus
QINGQSGRID

SEQ ID NO: 509474 - protein, 10 aa, Influenza virus
QINPVKLSSG

SEQ ID NO: 509475 - protein, 10 aa, Influenza virus
QIQDIWAYNA

SEQ ID NO: 509476 - protein, 10 aa, Influenza virus
QIQDLWAYNA

SEQ ID NO: 509477 - protein, 10 aa, Influenza virus
QIQDVWAYNA

SEQ ID NO: 509478 - protein, 10 aa, Influenza virus
QIQGIKLTQG

SEQ ID NO: 509479 - protein, 10 aa, Influenza virus
QIQGVKLAQG

SEQ ID NO: 509480 - protein, 10 aa, Influenza virus
QIQGVKLIQG

SEQ ID NO: 509481 - protein, 10 aa, Influenza virus
QIQGVKLTQG

SEQ ID NO: 509482 - protein, 10 aa, Influenza virus
QIQGVRLTQG

SEQ ID NO: 509483 - protein, 10 aa, Influenza virus
QIQNIWAYNA

SEQ ID NO: 509484 - protein, 10 aa, Influenza virus
QIQNRGLFGA

SEQ ID NO: 509485 - protein, 10 aa, Influenza virus
QIRGFVHFVE

SEQ ID NO: 509486 - protein, 10 aa, Influenza virus
QIRGFVYFVE

SEQ ID NO: 509487 - protein, 10 aa, Influenza virus
QISGKLNRLI

SEQ ID NO: 509488 - protein, 10 aa, Influenza virus
QISIVPNIGS

SEQ ID NO: 509489 - protein, 10 aa, Influenza virus
QITDIWAYNA

SEQ ID NO: 509490 - protein, 10 aa, Influenza virus
QITFIQALQL

SEQ ID NO: 509491 - protein, 10 aa, Influenza virus
QITFLQALQL

SEQ ID NO: 509492 - protein, 10 aa, Influenza virus
QITFMQALQL

SEQ ID NO: 509493 - protein, 10 aa, Influenza virus
QITGFAPFSK

SEQ ID NO: 509494 - protein, 10 aa, Influenza virus
QITGKLNHLI

SEQ ID NO: 509495 - protein, 10 aa, Influenza virus
QITGKLNRII

SEQ ID NO: 509496 - protein, 10 aa, Influenza virus
QITGKLNRLI

SEQ ID NO: 509497 - protein, 10 aa, Influenza virus
QITGTLNRLI

SEQ ID NO: 509498 - protein, 10 aa, Influenza virus
QITNGTTGNP

SEQ ID NO: 509499 - protein, 10 aa, Influenza virus
QITSLCSIWF

SEQ ID NO: 509500 - protein, 10 aa, Influenza virus
QITTKINNII

SEQ ID NO: 509501 - protein, 10 aa, Influenza virus
QIVVTREPYV

SEQ ID NO: 509502 - protein, 10 aa, Influenza virus
QKAIDEITTK

SEQ ID NO: 509503 - protein, 10 aa, Influenza virus
QKAIDGITNK

SEQ ID NO: 509504 - protein, 10 aa, Influenza virus
QKAIDGVTNK

SEQ ID NO: 509505 - protein, 10 aa, Influenza virus
QKAIDIMQNK

SEQ ID NO: 509506 - protein, 10 aa, Influenza virus
QKAIDNMQNK

SEQ ID NO: 509507 - protein, 10 aa, Influenza virus
QKAIDNMQNR

SEQ ID NO: 509508 - protein, 10 aa, Influenza virus
QKAIDQITTK

SEQ ID NO: 509509 - protein, 10 aa, Influenza virus
QKAIDRITTK

SEQ ID NO: 509510 - protein, 10 aa, Influenza virus
QKAINEITTK

SEQ ID NO: 509511 - protein, 10 aa, Influenza virus
QKAINGVTNK

SEQ ID NO: 509512 - protein, 10 aa, Influenza virus
QKALNEITTK

SEQ ID NO: 509513 - protein, 10 aa, Influenza virus
QKAMMDQVRE

SEQ ID NO: 509514 - protein, 10 aa, Influenza virus
QKAQGEGTAA

SEQ ID NO: 509515 - protein, 10 aa, Influenza virus
QKCCNLFEKF

SEQ ID NO: 509516 - protein, 10 aa, Influenza virus
QKCCSLFEKF

SEQ ID NO: 509517 - protein, 10 aa, Influenza virus
QKCCTLFEKF

SEQ ID NO: 509518 - protein, 10 aa, Influenza virus
QKGILEDEQM

SEQ ID NO: 509519 - protein, 10 aa, Influenza virus
QKGNIKCNIC

SEQ ID NO: 509520 - protein, 10 aa, Influenza virus
QKGNIRCDIC

SEQ ID NO: 509521 - protein, 10 aa, Influenza virus
QKGNIRCNIC

SEQ ID NO: 509522 - protein, 10 aa, Influenza virus
QKIITIDSVS

SEQ ID NO: 509523 - protein, 10 aa, Influenza virus
QKIITIGSAS

SEQ ID NO: 509524 - protein, 10 aa, Influenza virus
QKIITIGSIS

SEQ ID NO: 509525 - protein, 10 aa, Influenza virus
QKIITIGSMS

SEQ ID NO: 509526 - protein, 10 aa, Influenza virus
QKIITIGSVS

SEQ ID NO: 509527 - protein, 10 aa, Influenza virus
QKIITMGSVS

SEQ ID NO: 509528 - protein, 10 aa, Influenza virus
QKILCASATA

SEQ ID NO: 509529 - protein, 10 aa, Influenza virus
QKILCTSAIA

SEQ ID NO: 509530 - protein, 10 aa, Influenza virus
QKILCTSATA

SEQ ID NO: 509531 - protein, 10 aa, Influenza virus
QKILDEHDSN

SEQ ID NO: 509532 - protein, 10 aa, Influenza virus
QKILFASATA

SEQ ID NO: 509533 - protein, 10 aa, Influenza virus
QKIMESGGID

SEQ ID NO: 509534 - protein, 10 aa, Influenza virus
QKIMESGGIS

SEQ ID NO: 509535 - protein, 10 aa, Influenza virus
QKINGVKLEE

SEQ ID NO: 509536 - protein, 10 aa, Influenza virus
QKISGVKLEE

SEQ ID NO: 509537 - protein, 10 aa, Influenza virus
QKITCVCRDN

SEQ ID NO: 509538 - protein, 10 aa, Influenza virus
QKKDKRYGPA

SEQ ID NO: 509539 - protein, 10 aa, Influenza virus
QKLEDVFAGK

SEQ ID NO: 509540 - protein, 10 aa, Influenza virus
QKLFALSEVA

SEQ ID NO: 509541 - protein, 10 aa, Influenza virus
QKLFALSGVA

SEQ ID NO: 509542 - protein, 10 aa, Influenza virus
QKLFASSGIA

SEQ ID NO: 509543 - protein, 10 aa, Influenza virus
QKLFTLSGVA

SEQ ID NO: 509544 - protein, 10 aa, Influenza virus
QKQEFKMNPN

SEQ ID NO: 509545 - protein, 10 aa, Influenza virus
QKQEIKMNPN

SEQ ID NO: 509546 - protein, 10 aa, Influenza virus
QKQMTRGLFG

SEQ ID NO: 509547 - protein, 10 aa, Influenza virus
QKRGLFGAIA

SEQ ID NO: 509548 - protein, 10 aa, Influenza virus
QKRMGLQMQR

SEQ ID NO: 509549 - protein, 10 aa, Influenza virus
QKRMGVQIQR

SEQ ID NO: 509550 - protein, 10 aa, Influenza virus
QKRMGVQLQR

SEQ ID NO: 509551 - protein, 10 aa, Influenza virus
QKRMGVQMHR

SEQ ID NO: 509552 - protein, 10 aa, Influenza virus
QKRMGVQMQR

SEQ ID NO: 509553 - protein, 10 aa, Influenza virus
QKRMTRGLFG

SEQ ID NO: 509554 - protein, 10 aa, Influenza virus
QKSLIWLWLV

SEQ ID NO: 509555 - protein, 10 aa, Influenza virus
QKSLLLATGM

SEQ ID NO: 509556 - protein, 10 aa, Influenza virus
QKSLRGRGST

SEQ ID NO: 509557 - protein, 10 aa, Influenza virus
QKSTQEAIDK

SEQ ID NO: 509558 - protein, 10 aa, Influenza virus
QKSTQEAIEK

SEQ ID NO: 509559 - protein, 10 aa, Influenza virus
QKSTQEAIGK

SEQ ID NO: 509560 - protein, 10 aa, Influenza virus
QKSTQEAINK

SEQ ID NO: 509561 - protein, 10 aa, Influenza virus
QKTIDQVTGK

SEQ ID NO: 509562 - protein, 10 aa, Influenza virus
QKTITIGSVS

SEQ ID NO: 509563 - protein, 10 aa, Influenza virus
QKTLDEHDAN

SEQ ID NO: 509564 - protein, 10 aa, Influenza virus
QKTLDEHDSN

SEQ ID NO: 509565 - protein, 10 aa, Influenza virus
QKTLDKHDSN

SEQ ID NO: 509566 - protein, 10 aa, Influenza virus
QKTLKLATGM

SEQ ID NO: 509567 - protein, 10 aa, Influenza virus
QKVNGVKLEE

SEQ ID NO: 509568 - protein, 10 aa, Influenza virus
QKVPVTQTME

SEQ ID NO: 509569 - protein, 10 aa, Influenza virus
QKVTCVCRDN

SEQ ID NO: 509570 - protein, 10 aa, Influenza virus
QKWSGYSGAF

SEQ ID NO: 509571 - protein, 10 aa, Influenza virus
QKWWVWLWLV

SEQ ID NO: 509572 - protein, 10 aa, Influenza virus
QLEGFSAESR

SEQ ID NO: 509573 - protein, 10 aa, Influenza virus
QLFIKDYRYT

SEQ ID NO: 509574 - protein, 10 aa, Influenza virus
QLFLVCVSLL

SEQ ID NO: 509575 - protein, 10 aa, Influenza virus
QLGNVINWTR

SEQ ID NO: 509576 - protein, 10 aa, Influenza virus
QLGSWSWHDG

SEQ ID NO: 509577 - protein, 10 aa, Influenza virus
QLIPMISKCK

SEQ ID NO: 509578 - protein, 10 aa, Influenza virus
QLIPMISKCR

SEQ ID NO: 509579 - protein, 10 aa, Influenza virus
QLIWMACHSA

SEQ ID NO: 509580 - protein, 10 aa, Influenza virus
QLKDNAKELG

SEQ ID NO: 509581 - protein, 10 aa, Influenza virus
QLKDNAKEVG

SEQ ID NO: 509582 - protein, 10 aa, Influenza virus
QLKDNARELG

SEQ ID NO: 509583 - protein, 10 aa, Influenza virus
QLKKQEIEGI

SEQ ID NO: 509584 - protein, 10 aa, Influenza virus
QLKLATGLKN

SEQ ID NO: 509585 - protein, 10 aa, Influenza virus
QLKLATGLRN

SEQ ID NO: 509586 - protein, 10 aa, Influenza virus
QLKRQEIEGI

SEQ ID NO: 509587 - protein, 10 aa, Influenza virus
QLLRHFQKDA

SEQ ID NO: 509588 - protein, 10 aa, Influenza virus
QLLRHFQKNA

SEQ ID NO: 509589 - protein, 10 aa, Influenza virus
QLLVLLENEK

SEQ ID NO: 509590 - protein, 10 aa, Influenza virus
QLLVWLENEK

SEQ ID NO: 509591 - protein, 10 aa, Influenza virus
QLNEGIMNTS

SEQ ID NO: 509592 - protein, 10 aa, Influenza virus
QLNEGVINTS

SEQ ID NO: 509593 - protein, 10 aa, Influenza virus
QLNEGVMNTS

SEQ ID NO: 509594 - protein, 10 aa, Influenza virus
QLNPIDGPLP

SEQ ID NO: 509595 - protein, 10 aa, Influenza virus
QLNQTYRNNR

SEQ ID NO: 509596 - protein, 10 aa, Influenza virus
QLNQTYRNTR

SEQ ID NO: 509597 - protein, 10 aa, Influenza virus
QLRDNAKEIG

SEQ ID NO: 509598 - protein, 10 aa, Influenza virus
QLRDNAKELG

SEQ ID NO: 509599 - protein, 10 aa, Influenza virus
QLRDNAKETG

SEQ ID NO: 509600 - protein, 10 aa, Influenza virus
QLRDNVKELG

SEQ ID NO: 509601 - protein, 10 aa, Influenza virus
QLRENAEDIG

SEQ ID NO: 509602 - protein, 10 aa, Influenza virus
QLRENAEDKG

SEQ ID NO: 509603 - protein, 10 aa, Influenza virus
QLRENAEDLG

SEQ ID NO: 509604 - protein, 10 aa, Influenza virus
QLRENAEDMG

SEQ ID NO: 509605 - protein, 10 aa, Influenza virus
QLRENAEDQG

SEQ ID NO: 509606 - protein, 10 aa, Influenza virus
QLRENAEDRG

SEQ ID NO: 509607 - protein, 10 aa, Influenza virus
QLRENAEEDC

SEQ ID NO: 509608 - protein, 10 aa, Influenza virus
QLRENAEEDG

SEQ ID NO: 509609 - protein, 10 aa, Influenza virus
QLRENAEEMG

SEQ ID NO: 509610 - protein, 10 aa, Influenza virus
QLRMATGLRN

SEQ ID NO: 509611 - protein, 10 aa, Influenza virus
QLRQNAEEDG

SEQ ID NO: 509612 - protein, 10 aa, Influenza virus
QLSQKFEEIR

SEQ ID NO: 509613 - protein, 10 aa, Influenza virus
QLSSVSSFEK

SEQ ID NO: 509614 - protein, 10 aa, Influenza virus
QLSSVSSFER

SEQ ID NO: 509615 - protein, 10 aa, Influenza virus
QLSSVSSFKR

SEQ ID NO: 509616 - protein, 10 aa, Influenza virus
QLSTVSSFER

SEQ ID NO: 509617 - protein, 10 aa, Influenza virus
QLTEVETYVL

SEQ ID NO: 509618 - protein, 10 aa, Influenza virus
QLTHHMRKKR

SEQ ID NO: 509619 - protein, 10 aa, Influenza virus
QLVWMACHSA

SEQ ID NO: 509620 - protein, 10 aa, Influenza virus
QLVWMACNSA

SEQ ID NO: 509621 - protein, 10 aa, Influenza virus
QMAGSSEQAA

SEQ ID NO: 509622 - protein, 10 aa, Influenza virus
QMAIDNMQNK

SEQ ID NO: 509623 - protein, 10 aa, Influenza virus
QMALQLFIKD

SEQ ID NO: 509624 - protein, 10 aa, Influenza virus
QMCTELKLND

SEQ ID NO: 509625 - protein, 10 aa, Influenza virus
QMCTELKLSD

SEQ ID NO: 509626 - protein, 10 aa, Influenza virus
QMCTELKLSE

SEQ ID NO: 509627 - protein, 10 aa, Influenza virus
QMCTELQLSD

SEQ ID NO: 509628 - protein, 10 aa, Influenza virus
QMEKIVLLFA

SEQ ID NO: 509629 - protein, 10 aa, Influenza virus
QMESRGLFGA

SEQ ID NO: 509630 - protein, 10 aa, Influenza virus
QMNGQSGRID

SEQ ID NO: 509631 - protein, 10 aa, Influenza virus
QMQRFRRPDS

SEQ ID NO: 509632 - protein, 10 aa, Influenza virus
QMRDILGTFD

SEQ ID NO: 509633 - protein, 10 aa, Influenza virus
QMRDVIGTFD

SEQ ID NO: 509634 - protein, 10 aa, Influenza virus
QMRDVLGTFD

SEQ ID NO: 509635 - protein, 10 aa, Influenza virus
QMTRGLFGAI

SEQ ID NO: 509636 - protein, 10 aa, Influenza virus
QMYQKCCNLF

SEQ ID NO: 509637 - protein, 10 aa, Influenza virus
QMYQKCCSLF

SEQ ID NO: 509638 - protein, 10 aa, Influenza virus
QMYQKCCTLF

SEQ ID NO: 509639 - protein, 10 aa, Influenza virus
QMYQRCCNLF

SEQ ID NO: 509640 - protein, 10 aa, Influenza virus
QNAEEDGKGC

SEQ ID NO: 509641 - protein, 10 aa, Influenza virus
QNAEEDGRGC

SEQ ID NO: 509642 - protein, 10 aa, Influenza virus
QNAEGIGIAA

SEQ ID NO: 509643 - protein, 10 aa, Influenza virus
QNAEGTGIAA

SEQ ID NO: 509644 - protein, 10 aa, Influenza virus
QNAEGTGMAA

SEQ ID NO: 509645 - protein, 10 aa, Influenza virus
QNAEGTGTAA

SEQ ID NO: 509646 - protein, 10 aa, Influenza virus
QNAISTTFPY

SEQ ID NO: 509647 - protein, 10 aa, Influenza virus
QNALNGNGDP

SEQ ID NO: 509648 - protein, 10 aa, Influenza virus
QNALSGNGDP

SEQ ID NO: 509649 - protein, 10 aa, Influenza virus
QNAQGEGIAA

SEQ ID NO: 509650 - protein, 10 aa, Influenza virus
QNAQGEGTAA

SEQ ID NO: 509651 - protein, 10 aa, Influenza virus
QNAQGIGQAA

SEQ ID NO: 509652 - protein, 10 aa, Influenza virus
QNAQGQGTAA

SEQ ID NO: 509653 - protein, 10 aa, Influenza virus
QNAQGSGYAA

SEQ ID NO: 509654 - protein, 10 aa, Influenza virus
QNAQGTGLAA

SEQ ID NO: 509655 - protein, 10 aa, Influenza virus
QNAQGTGQAA

SEQ ID NO: 509656 - protein, 10 aa, Influenza virus
QNASRHHMGE

SEQ ID NO: 509657 - protein, 10 aa, Influenza virus
QNASRHYMGE

SEQ ID NO: 509658 - protein, 10 aa, Influenza virus
QNASRYYMGE

SEQ ID NO: 509659 - protein, 10 aa, Influenza virus
QNDVWLGRTI

SEQ ID NO: 509660 - protein, 10 aa, Influenza virus
QNEDIPIENC

SEQ ID NO: 509661 - protein, 10 aa, Influenza virus
QNEDIPIGNC

SEQ ID NO: 509662 - protein, 10 aa, Influenza virus
QNEDIPIGSC

SEQ ID NO: 509663 - protein, 10 aa, Influenza virus
QNEFNKACEL

SEQ ID NO: 509664 - protein, 10 aa, Influenza virus
QNEQGMGMAA

SEQ ID NO: 509665 - protein, 10 aa, Influenza virus
QNEQGSGYAA

SEQ ID NO: 509666 - protein, 10 aa, Influenza virus
QNEQGTGIAA

SEQ ID NO: 509667 - protein, 10 aa, Influenza virus
QNEQGVGIAA

SEQ ID NO: 509668 - protein, 10 aa, Influenza virus
QNEQGVGMAA

SEQ ID NO: 509669 - protein, 10 aa, Influenza virus
QNFPQTANTY

SEQ ID NO: 509670 - protein, 10 aa, Influenza virus
QNFPQTTNTY

SEQ ID NO: 509671 - protein, 10 aa, Influenza virus
QNFPRTTNTY

SEQ ID NO: 509672 - protein, 10 aa, Influenza virus
QNGKSGACKR

SEQ ID NO: 509673 - protein, 10 aa, Influenza virus
QNGKSSACKR

SEQ ID NO: 509674 - protein, 10 aa, Influenza virus
QNGNIRCQIC

SEQ ID NO: 509675 - protein, 10 aa, Influenza virus
QNGNIRCTFC

SEQ ID NO: 509676 - protein, 10 aa, Influenza virus
QNGNLRCQIC

SEQ ID NO: 509677 - protein, 10 aa, Influenza virus
QNGNVRCQIC

SEQ ID NO: 509678 - protein, 10 aa, Influenza virus
QNGNVRCTFC

SEQ ID NO: 509679 - protein, 10 aa, Influenza virus
QNGQGSGYAA

SEQ ID NO: 509680 - protein, 10 aa, Influenza virus
QNGSCRCMFC

SEQ ID NO: 509681 - protein, 10 aa, Influenza virus
QNGSYRCMFC

SEQ ID NO: 509682 - protein, 10 aa, Influenza virus
QNGVCPVVFT

SEQ ID NO: 509683 - protein, 10 aa, Influenza virus
QNHGICAVAT

SEQ ID NO: 509684 - protein, 10 aa, Influenza virus
QNICKPYIGK

SEQ ID NO: 509685 - protein, 10 aa, Influenza virus
QNIDKNALGD

SEQ ID NO: 509686 - protein, 10 aa, Influenza virus
QNIDKNALGE

SEQ ID NO: 509687 - protein, 10 aa, Influenza virus
QNIDRNAIGD

SEQ ID NO: 509688 - protein, 10 aa, Influenza virus
QNIDRNALGD

SEQ ID NO: 509689 - protein, 10 aa, Influenza virus
QNIDSRAVGK

SEQ ID NO: 509690 - protein, 10 aa, Influenza virus
QNIDSWAVGR

SEQ ID NO: 509691 - protein, 10 aa, Influenza virus
QNIEKNALGD

SEQ ID NO: 509692 - protein, 10 aa, Influenza virus
QNIERNALGD

SEQ ID NO: 509693 - protein, 10 aa, Influenza virus
QNIERNALGN

SEQ ID NO: 509694 - protein, 10 aa, Influenza virus
QNILEKTHNG

SEQ ID NO: 509695 - protein, 10 aa, Influenza virus
QNILRTHESE

SEQ ID NO: 509696 - protein, 10 aa, Influenza virus
QNILRTQESE

SEQ ID NO: 509697 - protein, 10 aa, Influenza virus
QNINRITYGA

SEQ ID NO: 509698 - protein, 10 aa, Influenza virus
QNIPVTQTME

SEQ ID NO: 509699 - protein, 10 aa, Influenza virus
QNIPVTQVEE

SEQ ID NO: 509700 - protein, 10 aa, Influenza virus
QNIWAYNAEL

SEQ ID NO: 509701 - protein, 10 aa, Influenza virus
QNKLNNVIDK

SEQ ID NO: 509702 - protein, 10 aa, Influenza virus
QNKLYGAGNK

SEQ ID NO: 509703 - protein, 10 aa, Influenza virus
QNKLYGTGNK

SEQ ID NO: 509704 - protein, 10 aa, Influenza virus
QNLFTLSGVA

SEQ ID NO: 509705 - protein, 10 aa, Influenza virus
QNLSPRTVGQ

SEQ ID NO: 509706 - protein, 10 aa, Influenza virus
QNLTKINNGD

SEQ ID NO: 509707 - protein, 10 aa, Influenza virus
QNLTKTNNGD

SEQ ID NO: 509708 - protein, 10 aa, Influenza virus
QNLTKVNNGD

SEQ ID NO: 509709 - protein, 10 aa, Influenza virus
QNLTKVNNGN

SEQ ID NO: 509710 - protein, 10 aa, Influenza virus
QNLTKVNSGD

SEQ ID NO: 509711 - protein, 10 aa, Influenza virus
QNNAIDEGDG

SEQ ID NO: 509712 - protein, 10 aa, Influenza virus
QNNFVPVIGA

SEQ ID NO: 509713 - protein, 10 aa, Influenza virus
QNNFVPVVGA

SEQ ID NO: 509714 - protein, 10 aa, Influenza virus
QNNTTLIENT

SEQ ID NO: 509715 - protein, 10 aa, Influenza virus
QNNTTVVENT

SEQ ID NO: 509716 - protein, 10 aa, Influenza virus
QNPRIFLAMI

SEQ ID NO: 509717 - protein, 10 aa, Influenza virus
QNPRMFLAMI

SEQ ID NO: 509718 - protein, 10 aa, Influenza virus
QNPRVFLAMI

SEQ ID NO: 509719 - protein, 10 aa, Influenza virus
QNPRVFLTMI

SEQ ID NO: 509720 - protein, 10 aa, Influenza virus
QNPTEEQAVD

SEQ ID NO: 509721 - protein, 10 aa, Influenza virus
QNPTEEQAVE

SEQ ID NO: 509722 - protein, 10 aa, Influenza virus
QNPTEEQAVG

SEQ ID NO: 509723 - protein, 10 aa, Influenza virus
QNPTEEQAVN

SEQ ID NO: 509724 - protein, 10 aa, Influenza virus
QNQNPRMFLA

SEQ ID NO: 509725 - protein, 10 aa, Influenza virus
QNQVKIRRRV

SEQ ID NO: 509726 - protein, 10 aa, Influenza virus
QNRGLFGAIA

SEQ ID NO: 509727 - protein, 10 aa, Influenza virus
QNRGLFGAKA

SEQ ID NO: 509728 - protein, 10 aa, Influenza virus
QNRIMINPVK

SEQ ID NO: 509729 - protein, 10 aa, Influenza virus
QNRIQIDPVK

SEQ ID NO: 509730 - protein, 10 aa, Influenza virus
QNRIQIDQVK

SEQ ID NO: 509731 - protein, 10 aa, Influenza virus
QNRIQIDSVK

SEQ ID NO: 509732 - protein, 10 aa, Influenza virus
QNRIQINPVK

SEQ ID NO: 509733 - protein, 10 aa, Influenza virus
QNRIRIDPVK

SEQ ID NO: 509734 - protein, 10 aa, Influenza virus
QNRLNNVIDK

SEQ ID NO: 509735 - protein, 10 aa, Influenza virus
QNRMQFSSLT

SEQ ID NO: 509736 - protein, 10 aa, Influenza virus
QNRMQINPVK

SEQ ID NO: 509737 - protein, 10 aa, Influenza virus
QNRVKIDPVK

SEQ ID NO: 509738 - protein, 10 aa, Influenza virus
QNSEGTGIAA

SEQ ID NO: 509739 - protein, 10 aa, Influenza virus
QNSEGTGIVA

SEQ ID NO: 509740 - protein, 10 aa, Influenza virus
QNSEGTGTAA

SEQ ID NO: 509741 - protein, 10 aa, Influenza virus
QNSFVPVVGA

SEQ ID NO: 509742 - protein, 10 aa, Influenza virus
QNSQGEGTAA

SEQ ID NO: 509743 - protein, 10 aa, Influenza virus
QNTIDLTDSE

SEQ ID NO: 509744 - protein, 10 aa, Influenza virus
QNTLKLATGM

SEQ ID NO: 509745 - protein, 10 aa, Influenza virus
QNTQGEGTAA

SEQ ID NO: 509746 - protein, 10 aa, Influenza virus
QNTSKHYIGK

SEQ ID NO: 509747 - protein, 10 aa, Influenza virus
QNTSRHYIGK

SEQ ID NO: 509748 - protein, 10 aa, Influenza virus
QNTSRHYMGE

SEQ ID NO: 509749 - protein, 10 aa, Influenza virus
QNVNKITYGA

SEQ ID NO: 509750 - protein, 10 aa, Influenza virus
QNVNRITYGA

SEQ ID NO: 509751 - protein, 10 aa, Influenza virus
QNVNRITYGP

SEQ ID NO: 509752 - protein, 10 aa, Influenza virus
QNVNRITYGV

SEQ ID NO: 509753 - protein, 10 aa, Influenza virus
QNVPVTQAME

SEQ ID NO: 509754 - protein, 10 aa, Influenza virus
QNVPVTQTME

SEQ ID NO: 509755 - protein, 10 aa, Influenza virus
QNVPVTQVEE

SEQ ID NO: 509756 - protein, 10 aa, Influenza virus
QNVSRIAIGN

SEQ ID NO: 509757 - protein, 10 aa, Influenza virus
QNWSGYSGAF

SEQ ID NO: 509758 - protein, 10 aa, Influenza virus
QNWSGYSGSF

SEQ ID NO: 509759 - protein, 10 aa, Influenza virus
QPAATALANT

SEQ ID NO: 509760 - protein, 10 aa, Influenza virus
QPAFSVQRNL

SEQ ID NO: 509761 - protein, 10 aa, Influenza virus
QPCFYIELIR

SEQ ID NO: 509762 - protein, 10 aa, Influenza virus
QPCFYVELIR

SEQ ID NO: 509763 - protein, 10 aa, Influenza virus
QPCFYVELTR

SEQ ID NO: 509764 - protein, 10 aa, Influenza virus
QPDWFRNVLS

SEQ ID NO: 509765 - protein, 10 aa, Influenza virus
QPEWFRNILS

SEQ ID NO: 509766 - protein, 10 aa, Influenza virus
QPEWFRNVLS

SEQ ID NO: 509767 - protein, 10 aa, Influenza virus
QPGDNIIFSH

SEQ ID NO: 509768 - protein, 10 aa, Influenza virus
QPGDNITFSD

SEQ ID NO: 509769 - protein, 10 aa, Influenza virus
QPGDNITFSH

SEQ ID NO: 509770 - protein, 10 aa, Influenza virus
QPGWFRNVLS

SEQ ID NO: 509771 - protein, 10 aa, Influenza virus
QPISLGDCSF

SEQ ID NO: 509772 - protein, 10 aa, Influenza virus
QPKEKAIWTS

SEQ ID NO: 509773 - protein, 10 aa, Influenza virus
QPKEKTIWTS

SEQ ID NO: 509774 - protein, 10 aa, Influenza virus
QPKERTIWTS

SEQ ID NO: 509775 - protein, 10 aa, Influenza virus
QPKWFRNVLS

SEQ ID NO: 509776 - protein, 10 aa, Influenza virus
QPLSISVGSS

SEQ ID NO: 509777 - protein, 10 aa, Influenza virus
QPNDGQVLYF

SEQ ID NO: 509778 - protein, 10 aa, Influenza virus
QPNIGPRALV

SEQ ID NO: 509779 - protein, 10 aa, Influenza virus
QPNIGPRPLV

SEQ ID NO: 509780 - protein, 10 aa, Influenza virus
QPRTREILTK

SEQ ID NO: 509781 - protein, 10 aa, Influenza virus
QPTFSVQRNL

SEQ ID NO: 509782 - protein, 10 aa, Influenza virus
QPTFSVQRSL

SEQ ID NO: 509783 - protein, 10 aa, Influenza virus
QQETRVWWTS

SEQ ID NO: 509784 - protein, 10 aa, Influenza virus
QQFELIDNEF

SEQ ID NO: 509785 - protein, 10 aa, Influenza virus
QQFELIDNKF

SEQ ID NO: 509786 - protein, 10 aa, Influenza virus
QQFELIDSEF

SEQ ID NO: 509787 - protein, 10 aa, Influenza virus
QQFELINNEF

SEQ ID NO: 509788 - protein, 10 aa, Influenza virus
QQFEMIDNEF

SEQ ID NO: 509789 - protein, 10 aa, Influenza virus
QQFKLIDNEF

SEQ ID NO: 509790 - protein, 10 aa, Influenza virus
QQGRMDYYWA

SEQ ID NO: 509791 - protein, 10 aa, Influenza virus
QQGRMDYYWG

SEQ ID NO: 509792 - protein, 10 aa, Influenza virus
QQGTMDYYWG

SEQ ID NO: 509793 - protein, 10 aa, Influenza virus
QQGWMDYYWG

SEQ ID NO: 509794 - protein, 10 aa, Influenza virus
QQIESIIEAE

SEQ ID NO: 509795 - protein, 10 aa, Influenza virus
QQIESMIEAE

SEQ ID NO: 509796 - protein, 10 aa, Influenza virus
QQIESMVEAE

SEQ ID NO: 509797 - protein, 10 aa, Influenza virus
QQIGNVINWT

SEQ ID NO: 509798 - protein, 10 aa, Influenza virus
QQMRDILGTF

SEQ ID NO: 509799 - protein, 10 aa, Influenza virus
QQMRDVLGTF

SEQ ID NO: 509800 - protein, 10 aa, Influenza virus
QQSFSPSPGA

SEQ ID NO: 509801 - protein, 10 aa, Influenza virus
QQSFSPSPGD

SEQ ID NO: 509802 - protein, 10 aa, Influenza virus
QQTRVDKLTQ

SEQ ID NO: 509803 - protein, 10 aa, Influenza virus
QQTRVDRLTQ

SEQ ID NO: 509804 - protein, 10 aa, Influenza virus
QQVESMIEAE

SEQ ID NO: 509805 - protein, 10 aa, Influenza virus
QRAIDGVTNK

SEQ ID NO: 509806 - protein, 10 aa, Influenza virus
QRAIDNMQNK

SEQ ID NO: 509807 - protein, 10 aa, Influenza virus
QRAMMDQVRE

SEQ ID NO: 509808 - protein, 10 aa, Influenza virus
QRAMVDQVRE

SEQ ID NO: 509809 - protein, 10 aa, Influenza virus
QRCCNLFEKF

SEQ ID NO: 509810 - protein, 10 aa, Influenza virus
QRFELIDNEF

SEQ ID NO: 509811 - protein, 10 aa, Influenza virus
QRFRRPDSSW

SEQ ID NO: 509812 - protein, 10 aa, Influenza virus
QRGILEDEQM

SEQ ID NO: 509813 - protein, 10 aa, Influenza virus
QRGNIRCNIC

SEQ ID NO: 509814 - protein, 10 aa, Influenza virus
QRGVLEDEQM

SEQ ID NO: 509815 - protein, 10 aa, Influenza virus
QRINGVKLEE

SEQ ID NO: 509816 - protein, 10 aa, Influenza virus
QRINMLADRI

SEQ ID NO: 509817 - protein, 10 aa, Influenza virus
QRLEDVFAGK

SEQ ID NO: 509818 - protein, 10 aa, Influenza virus
QRLEGVFAGK

SEQ ID NO: 509819 - protein, 10 aa, Influenza virus
QRLENVFAGK

SEQ ID NO: 509820 - protein, 10 aa, Influenza virus
QRLESVFAGK

SEQ ID NO: 509821 - protein, 10 aa, Influenza virus
QRLNPMHQLL

SEQ ID NO: 509822 - protein, 10 aa, Influenza virus
QRLNTMHQLL

SEQ ID NO: 509823 - protein, 10 aa, Influenza virus
QRRRFIQNAL

SEQ ID NO: 509824 - protein, 10 aa, Influenza virus
QRRRFVQNAL

SEQ ID NO: 509825 - protein, 10 aa, Influenza virus
QRSKFLLMDA

SEQ ID NO: 509826 - protein, 10 aa, Influenza virus
QRSKFLLMDS

SEQ ID NO: 509827 - protein, 10 aa, Influenza virus
QRSWMKIYWH

SEQ ID NO: 509828 - protein, 10 aa, Influenza virus
QRSWMKLYWH

SEQ ID NO: 509829 - protein, 10 aa, Influenza virus
QRTRALVRSG

SEQ ID NO: 509830 - protein, 10 aa, Influenza virus
QRTRALVRTG

SEQ ID NO: 509831 - protein, 10 aa, Influenza virus
QSAIDQITGK

SEQ ID NO: 509832 - protein, 10 aa, Influenza virus
QSAIDQITGT

SEQ ID NO: 509833 - protein, 10 aa, Influenza virus
QSAIDQITRK

SEQ ID NO: 509834 - protein, 10 aa, Influenza virus
QSAIDQVTGK

SEQ ID NO: 509835 - protein, 10 aa, Influenza virus
QSAINQITGK

SEQ ID NO: 509836 - protein, 10 aa, Influenza virus
QSAVDQITGK

SEQ ID NO: 509837 - protein, 10 aa, Influenza virus
QSAVNQITGK

SEQ ID NO: 509838 - protein, 10 aa, Influenza virus
QSCFYVELIR

SEQ ID NO: 509839 - protein, 10 aa, Influenza virus
QSDAQIDESC

SEQ ID NO: 509840 - protein, 10 aa, Influenza virus
QSDKPFQNVS

SEQ ID NO: 509841 - protein, 10 aa, Influenza virus
QSEFNKACEL

SEQ ID NO: 509842 - protein, 10 aa, Influenza virus
QSERGEDTIE

SEQ ID NO: 509843 - protein, 10 aa, Influenza virus
QSERGEETIE

SEQ ID NO: 509844 - protein, 10 aa, Influenza virus
QSERGEETVE

SEQ ID NO: 509845 - protein, 10 aa, Influenza virus
QSFPQTTNTY

SEQ ID NO: 509846 - protein, 10 aa, Influenza virus
QSFSPSPGAR

SEQ ID NO: 509847 - protein, 10 aa, Influenza virus
QSFSPSPGDR

SEQ ID NO: 509848 - protein, 10 aa, Influenza virus
QSFTPSPGAR

SEQ ID NO: 509849 - protein, 10 aa, Influenza virus
QSFTPSPGTR

SEQ ID NO: 509850 - protein, 10 aa, Influenza virus
QSFVPSPGAR

SEQ ID NO: 509851 - protein, 10 aa, Influenza virus
QSFVPSPGSR

SEQ ID NO: 509852 - protein, 10 aa, Influenza virus
QSFVPSPGVR

SEQ ID NO: 509853 - protein, 10 aa, Influenza virus
QSFYRSINWL

SEQ ID NO: 509854 - protein, 10 aa, Influenza virus
QSGHIEECSC

SEQ ID NO: 509855 - protein, 10 aa, Influenza virus
QSGLPVGGNE

SEQ ID NO: 509856 - protein, 10 aa, Influenza virus
QSGRIDFHWA

SEQ ID NO: 509857 - protein, 10 aa, Influenza virus
QSGRIDFHWL

SEQ ID NO: 509858 - protein, 10 aa, Influenza virus
QSGRIDFHWM

SEQ ID NO: 509859 - protein, 10 aa, Influenza virus
QSGRIDFHWT

SEQ ID NO: 509860 - protein, 10 aa, Influenza virus
QSGRIDFYWL

SEQ ID NO: 509861 - protein, 10 aa, Influenza virus
QSGRINFHWL

SEQ ID NO: 509862 - protein, 10 aa, Influenza virus
QSGRINFHWT

SEQ ID NO: 509863 - protein, 10 aa, Influenza virus
QSGRISFYWT

SEQ ID NO: 509864 - protein, 10 aa, Influenza virus
QSGRISIYWT

SEQ ID NO: 509865 - protein, 10 aa, Influenza virus
QSGRVSFYWT

SEQ ID NO: 509866 - protein, 10 aa, Influenza virus
QSKGLFGAIA

SEQ ID NO: 509867 - protein, 10 aa, Influenza virus
QSKMQFSSLT

SEQ ID NO: 509868 - protein, 10 aa, Influenza virus
QSLIIAARNI

SEQ ID NO: 509869 - protein, 10 aa, Influenza virus
QSLIIAARSI

SEQ ID NO: 509870 - protein, 10 aa, Influenza virus
QSLQQIESII

SEQ ID NO: 509871 - protein, 10 aa, Influenza virus
QSLQQIESMI

SEQ ID NO: 509872 - protein, 10 aa, Influenza virus
QSLQQIESMV

SEQ ID NO: 509873 - protein, 10 aa, Influenza virus
QSLRSILANN

SEQ ID NO: 509874 - protein, 10 aa, Influenza virus
QSLRSILASS

SEQ ID NO: 509875 - protein, 10 aa, Influenza virus
QSLSISIGSS

SEQ ID NO: 509876 - protein, 10 aa, Influenza virus
QSLSISVESS

SEQ ID NO: 509877 - protein, 10 aa, Influenza virus
QSLSISVGSS

SEQ ID NO: 509878 - protein, 10 aa, Influenza virus
QSLVIAARNI

SEQ ID NO: 509879 - protein, 10 aa, Influenza virus
QSNNSTDTVD

SEQ ID NO: 509880 - protein, 10 aa, Influenza virus
QSNNSTDTVN

SEQ ID NO: 509881 - protein, 10 aa, Influenza virus
QSNNSTNTVN

SEQ ID NO: 509882 - protein, 10 aa, Influenza virus
QSPLGAINTT

SEQ ID NO: 509883 - protein, 10 aa, Influenza virus
QSPNVYQAKF

SEQ ID NO: 509884 - protein, 10 aa, Influenza virus
QSPNVYQARF

SEQ ID NO: 509885 - protein, 10 aa, Influenza virus
QSPNVYQSRF

SEQ ID NO: 509886 - protein, 10 aa, Influenza virus
QSPRMFLAMI

SEQ ID NO: 509887 - protein, 10 aa, Influenza virus
QSRFEAVAWS

SEQ ID NO: 509888 - protein, 10 aa, Influenza virus
QSRGLFGAIA

SEQ ID NO: 509889 - protein, 10 aa, Influenza virus
QSRMQFSSLA

SEQ ID NO: 509890 - protein, 10 aa, Influenza virus
QSRMQFSSLT

SEQ ID NO: 509891 - protein, 10 aa, Influenza virus
QSRTREILTK

SEQ ID NO: 509892 - protein, 10 aa, Influenza virus
QSRTREILTR

SEQ ID NO: 509893 - protein, 10 aa, Influenza virus
QSRTRGILTK

SEQ ID NO: 509894 - protein, 10 aa, Influenza virus
QSSDDFALIL

SEQ ID NO: 509895 - protein, 10 aa, Influenza virus
QSSDDFALIV

SEQ ID NO: 509896 - protein, 10 aa, Influenza virus
QSSLPLALGM

SEQ ID NO: 509897 - protein, 10 aa, Influenza virus
QSSPPTVYNS

SEQ ID NO: 509898 - protein, 10 aa, Influenza virus
QSTLKLATGM

SEQ ID NO: 509899 - protein, 10 aa, Influenza virus
QSWSYIVERP

SEQ ID NO: 509900 - protein, 10 aa, Influenza virus
QSYFQLFLVC

SEQ ID NO: 509901 - protein, 10 aa, Influenza virus
QTAAQKAMMD

SEQ ID NO: 509902 - protein, 10 aa, Influenza virus
QTAAQRAMMD

SEQ ID NO: 509903 - protein, 10 aa, Influenza virus
QTAAQRAMVD

SEQ ID NO: 509904 - protein, 10 aa, Influenza virus
QTAIDQINGK

SEQ ID NO: 509905 - protein, 10 aa, Influenza virus
QTAIDQITGK

SEQ ID NO: 509906 - protein, 10 aa, Influenza virus
QTALYKNANT

SEQ ID NO: 509907 - protein, 10 aa, Influenza virus
QTANTYRNTD

SEQ ID NO: 509908 - protein, 10 aa, Influenza virus
QTATKRIRMA

SEQ ID NO: 509909 - protein, 10 aa, Influenza virus
QTATKRLRMA

SEQ ID NO: 509910 - protein, 10 aa, Influenza virus
QTDCVLEAMA

SEQ ID NO: 509911 - protein, 10 aa, Influenza virus
QTDEYKNTGD

SEQ ID NO: 509912 - protein, 10 aa, Influenza virus
QTDEYKNTRD

SEQ ID NO: 509913 - protein, 10 aa, Influenza virus
QTDLYKVATG

SEQ ID NO: 509914 - protein, 10 aa, Influenza virus
QTESRGLFGA

SEQ ID NO: 509915 - protein, 10 aa, Influenza virus
QTFDWTLNRN

SEQ ID NO: 509916 - protein, 10 aa, Influenza virus
QTGRIDFHWL

SEQ ID NO: 509917 - protein, 10 aa, Influenza virus
QTGRMTFYWT

SEQ ID NO: 509918 - protein, 10 aa, Influenza virus
QTIINNYHNE

SEQ ID NO: 509919 - protein, 10 aa, Influenza virus
QTIINNYYND

SEQ ID NO: 509920 - protein, 10 aa, Influenza virus
QTIINNYYNE

SEQ ID NO: 509921 - protein, 10 aa, Influenza virus
QTIINNYYNK

SEQ ID NO: 509922 - protein, 10 aa, Influenza virus
QTIVLNTDWS

SEQ ID NO: 509923 - protein, 10 aa, Influenza virus
QTIVLTTDWS

SEQ ID NO: 509924 - protein, 10 aa, Influenza virus
QTKKMTITFL

SEQ ID NO: 509925 - protein, 10 aa, Influenza virus
QTKLYGNGNK

SEQ ID NO: 509926 - protein, 10 aa, Influenza virus
QTKLYGSGNK

SEQ ID NO: 509927 - protein, 10 aa, Influenza virus
QTKLYGSGSK

SEQ ID NO: 509928 - protein, 10 aa, Influenza virus
QTKLYKNTNT

SEQ ID NO: 509929 - protein, 10 aa, Influenza virus
QTKTMTITFL

SEQ ID NO: 509930 - protein, 10 aa, Influenza virus
QTLRIISNGN

SEQ ID NO: 509931 - protein, 10 aa, Influenza virus
QTLRIRSNGN

SEQ ID NO: 509932 - protein, 10 aa, Influenza virus
QTLRVKSNGN

SEQ ID NO: 509933 - protein, 10 aa, Influenza virus
QTLRVRSDGN

SEQ ID NO: 509934 - protein, 10 aa, Influenza virus
QTLRVRSNGN

SEQ ID NO: 509935 - protein, 10 aa, Influenza virus
QTLVANNDWS

SEQ ID NO: 509936 - protein, 10 aa, Influenza virus
QTLVSNDDWS

SEQ ID NO: 509937 - protein, 10 aa, Influenza virus
QTLVSNNDWS

SEQ ID NO: 509938 - protein, 10 aa, Influenza virus
QTLVSNSDWS

SEQ ID NO: 509939 - protein, 10 aa, Influenza virus
QTMELVEAEK

SEQ ID NO: 509940 - protein, 10 aa, Influenza virus
QTMELVETEK

SEQ ID NO: 509941 - protein, 10 aa, Influenza virus
QTMELVETKK

SEQ ID NO: 509942 - protein, 10 aa, Influenza virus
QTNGNLIAPE

SEQ ID NO: 509943 - protein, 10 aa, Influenza virus
QTNNSTDTVN

SEQ ID NO: 509944 - protein, 10 aa, Influenza virus
QTNNSTETVN

SEQ ID NO: 509945 - protein, 10 aa, Influenza virus
QTNTTLIENT

SEQ ID NO: 509946 - protein, 10 aa, Influenza virus
QTPLGAINTT

SEQ ID NO: 509947 - protein, 10 aa, Influenza virus
QTPLGALNTT

SEQ ID NO: 509948 - protein, 10 aa, Influenza virus
QTRGIFGAIA

SEQ ID NO: 509949 - protein, 10 aa, Influenza virus
QTRGLFGAIA

SEQ ID NO: 509950 - protein, 10 aa, Influenza virus
QTRVDKLTQG

SEQ ID NO: 509951 - protein, 10 aa, Influenza virus
QTRVDRLTQG

SEQ ID NO: 509952 - protein, 10 aa, Influenza virus
QTSGNLIAPE

SEQ ID NO: 509953 - protein, 10 aa, Influenza virus
QTSLLLATGM

SEQ ID NO: 509954 - protein, 10 aa, Influenza virus
QTSVGGIDTN

SEQ ID NO: 509955 - protein, 10 aa, Influenza virus
QTSVGGINTN

SEQ ID NO: 509956 - protein, 10 aa, Influenza virus
QTTLYKNANT

SEQ ID NO: 509957 - protein, 10 aa, Influenza virus
QTTNTYRNTD

SEQ ID NO: 509958 - protein, 10 aa, Influenza virus
QTVINNYYNE

SEQ ID NO: 509959 - protein, 10 aa, Influenza virus
QTVKIKTNGN

SEQ ID NO: 509960 - protein, 10 aa, Influenza virus
QTVKIQTNGN

SEQ ID NO: 509961 - protein, 10 aa, Influenza virus
QTVKIQTSGN

SEQ ID NO: 509962 - protein, 10 aa, Influenza virus
QTVVLNTDWS

SEQ ID NO: 509963 - protein, 10 aa, Influenza virus
QTYAGAINSS

SEQ ID NO: 509964 - protein, 10 aa, Influenza virus
QTYAGAVNSS

SEQ ID NO: 509965 - protein, 10 aa, Influenza virus
QTYDWTLNRN

SEQ ID NO: 509966 - protein, 10 aa, Influenza virus
QTYQKRMGVQ

SEQ ID NO: 509967 - protein, 10 aa, Influenza virus
QTYRNNRKEP

SEQ ID NO: 509968 - protein, 10 aa, Influenza virus
QTYRNTRKEP

SEQ ID NO: 509969 - protein, 10 aa, Influenza virus
QTYTGAINSS

SEQ ID NO: 509970 - protein, 10 aa, Influenza virus
QVAGSSEQAA

SEQ ID NO: 509971 - protein, 10 aa, Influenza virus
QVCAAWSSSS

SEQ ID NO: 509972 - protein, 10 aa, Influenza virus
QVCIAWSSAS

SEQ ID NO: 509973 - protein, 10 aa, Influenza virus
QVCIAWSSSS

SEQ ID NO: 509974 - protein, 10 aa, Influenza virus
QVCMAWSSSS

SEQ ID NO: 509975 - protein, 10 aa, Influenza virus
QVCVAWSSSS

SEQ ID NO: 509976 - protein, 10 aa, Influenza virus
QVDCFIWHIR

SEQ ID NO: 509977 - protein, 10 aa, Influenza virus
QVDCFLWHIR

SEQ ID NO: 509978 - protein, 10 aa, Influenza virus
QVDCFLWHVR

SEQ ID NO: 509979 - protein, 10 aa, Influenza virus
QVDCFLWYVR

SEQ ID NO: 509980 - protein, 10 aa, Influenza virus
QVDCYLWHIR

SEQ ID NO: 509981 - protein, 10 aa, Influenza virus
QVDTIMEKIV

SEQ ID NO: 509982 - protein, 10 aa, Influenza virus
QVDTIMEKNI

SEQ ID NO: 509983 - protein, 10 aa, Influenza virus
QVDTIMEKNV

SEQ ID NO: 509984 - protein, 10 aa, Influenza virus
QVDTIMERNV

SEQ ID NO: 509985 - protein, 10 aa, Influenza virus
QVDTIREKNV

SEQ ID NO: 509986 - protein, 10 aa, Influenza virus
QVECVCRDNW

SEQ ID NO: 509987 - protein, 10 aa, Influenza virus
QVEELVHGGI

SEQ ID NO: 509988 - protein, 10 aa, Influenza virus
QVEELVHGGV

SEQ ID NO: 509989 - protein, 10 aa, Influenza virus
QVEELVHGQV

SEQ ID NO: 509990 - protein, 10 aa, Influenza virus
QVEELVHRGI

SEQ ID NO: 509991 - protein, 10 aa, Influenza virus
QVEGRIQDLE

SEQ ID NO: 509992 - protein, 10 aa, Influenza virus
QVEGRIQNLE

SEQ ID NO: 509993 - protein, 10 aa, Influenza virus
QVEGRIQYLE

SEQ ID NO: 509994 - protein, 10 aa, Influenza virus
QVEGRTQDLE

SEQ ID NO: 509995 - protein, 10 aa, Influenza virus
QVEKRINMIA

SEQ ID NO: 509996 - protein, 10 aa, Influenza virus
QVEKRINMLA

SEQ ID NO: 509997 - protein, 10 aa, Influenza virus
QVENRINMLA

SEQ ID NO: 509998 - protein, 10 aa, Influenza virus
QVEQRINMLA

SEQ ID NO: 509999 - protein, 10 aa, Influenza virus
QVERRINMLA

SEQ ID NO: 510000 - protein, 10 aa, Influenza virus
QVESMIEAES

SEQ ID NO: 510001 - protein, 10 aa, Influenza virus
QVEVTNATEL

SEQ ID NO: 510002 - protein, 10 aa, Influenza virus
QVFPQLNQTY

SEQ ID NO: 510003 - protein, 10 aa, Influenza virus
QVIKLLPFAA

SEQ ID NO: 510004 - protein, 10 aa, Influenza virus
QVIVTREPYV

SEQ ID NO: 510005 - protein, 10 aa, Influenza virus
QVKIRRRVDI

SEQ ID NO: 510006 - protein, 10 aa, Influenza virus
QVKIRRRVDM

SEQ ID NO: 510007 - protein, 10 aa, Influenza virus
QVKIRRRVDT

SEQ ID NO: 510008 - protein, 10 aa, Influenza virus
QVKIRRRVDV

SEQ ID NO: 510009 - protein, 10 aa, Influenza virus
QVKLSSGYKD

SEQ ID NO: 510010 - protein, 10 aa, Influenza virus
QVNGQFGRID

SEQ ID NO: 510011 - protein, 10 aa, Influenza virus
QVNGQSGRID

SEQ ID NO: 510012 - protein, 10 aa, Influenza virus
QVNGQSGRIN

SEQ ID NO: 510013 - protein, 10 aa, Influenza virus
QVQDRGLFGA

SEQ ID NO: 510014 - protein, 10 aa, Influenza virus
QVQNRGLFGA

SEQ ID NO: 510015 - protein, 10 aa, Influenza virus
QVREGRNPGN

SEQ ID NO: 510016 - protein, 10 aa, Influenza virus
QVRESRNPGN

SEQ ID NO: 510017 - protein, 10 aa, Influenza virus
QVTDIWAYNA

SEQ ID NO: 510018 - protein, 10 aa, Influenza virus
QVTGKLNRLI

SEQ ID NO: 510019 - protein, 10 aa, Influenza virus
QWDWPDGAKI

SEQ ID NO: 510020 - protein, 10 aa, Influenza virus
QWNWPDGAEI

SEQ ID NO: 510021 - protein, 10 aa, Influenza virus
QWNWPDGAKI

SEQ ID NO: 510022 - protein, 10 aa, Influenza virus
QYICSPVLTD

SEQ ID NO: 510023 - protein, 10 aa, Influenza virus
QYLCTGILTD

SEQ ID NO: 510024 - protein, 10 aa, Influenza virus
QYLCTGVLTD

SEQ ID NO: 510025 - protein, 10 aa, Influenza virus
QYLEKYVEDT

SEQ ID NO: 510026 - protein, 10 aa, Influenza virus
QYLLFQDILM

SEQ ID NO: 510027 - protein, 10 aa, Influenza virus
QYPNVRCVCR

SEQ ID NO: 510028 - protein, 10 aa, Influenza virus
QYRAESLQNR

SEQ ID NO: 510029 - protein, 10 aa, Influenza virus
QYRALISWPL

SEQ ID NO: 510030 - protein, 10 aa, Influenza virus
QYRALISWPQ

SEQ ID NO: 510031 - protein, 10 aa, Influenza virus
QYRALVSWPL

SEQ ID NO: 510032 - protein, 10 aa, Influenza virus
QYREEALLNR

SEQ ID NO: 510033 - protein, 10 aa, Influenza virus
QYREESLLNR

SEQ ID NO: 510034 - protein, 10 aa, Influenza virus
QYRSLISWPL

SEQ ID NO: 510035 - protein, 10 aa, Influenza virus
QYRTESLQNR

SEQ ID NO: 510036 - protein, 10 aa, Influenza virus
QYRTGSLQNR

SEQ ID NO: 510037 - protein, 10 aa, Influenza virus
QYSGFVRTLF

SEQ ID NO: 510038 - protein, 10 aa, Influenza virus
RAAFRGLIST

SEQ ID NO: 510039 - protein, 10 aa, Influenza virus
RAAVSADPLA

SEQ ID NO: 510040 - protein, 10 aa, Influenza virus
RACFYVELIR

SEQ ID NO: 510041 - protein, 10 aa, Influenza virus
RADEICIGYL

SEQ ID NO: 510042 - protein, 10 aa, Influenza virus
RADKICIGYL

SEQ ID NO: 510043 - protein, 10 aa, Influenza virus
RAGYEMLKVP

SEQ ID NO: 510044 - protein, 10 aa, Influenza virus
RAIATPGMQI

SEQ ID NO: 510045 - protein, 10 aa, Influenza virus
RAIDNMQNKL

SEQ ID NO: 510046 - protein, 10 aa, Influenza virus
RAIVSADPLA

SEQ ID NO: 510047 - protein, 10 aa, Influenza virus
RALISWEMGQ

SEQ ID NO: 510048 - protein, 10 aa, Influenza virus
RALISWGMGQ

SEQ ID NO: 510049 - protein, 10 aa, Influenza virus
RALISWPLSS

SEQ ID NO: 510050 - protein, 10 aa, Influenza virus
RALISWPQSS

SEQ ID NO: 510051 - protein, 10 aa, Influenza virus
RALMSCPIGE

SEQ ID NO: 510052 - protein, 10 aa, Influenza virus
RALMSCPLGE

SEQ ID NO: 510053 - protein, 10 aa, Influenza virus
RALMSCPVGE

SEQ ID NO: 510054 - protein, 10 aa, Influenza virus
RALMSVLLGS

SEQ ID NO: 510055 - protein, 10 aa, Influenza virus
RALMSVPLGS

SEQ ID NO: 510056 - protein, 10 aa, Influenza virus
RALSIYSCIA

SEQ ID NO: 510057 - protein, 10 aa, Influenza virus
RALTLNTMTK

SEQ ID NO: 510058 - protein, 10 aa, Influenza virus
RALVRGQQGR

SEQ ID NO: 510059 - protein, 10 aa, Influenza virus
RALVRSGMDP

SEQ ID NO: 510060 - protein, 10 aa, Influenza virus
RALVRTGMDP

SEQ ID NO: 510061 - protein, 10 aa, Influenza virus
RALVSWEMGQ

SEQ ID NO: 510062 - protein, 10 aa, Influenza virus
RALVSWPLSS

SEQ ID NO: 510063 - protein, 10 aa, Influenza virus
RAMMDQVREG

SEQ ID NO: 510064 - protein, 10 aa, Influenza virus
RAMMDQVRES

SEQ ID NO: 510065 - protein, 10 aa, Influenza virus
RAMVDQVRES

SEQ ID NO: 510066 - protein, 10 aa, Influenza virus
RANQRLNPMH

SEQ ID NO: 510067 - protein, 10 aa, Influenza virus
RANQRLNTMH

SEQ ID NO: 510068 - protein, 10 aa, Influenza virus
RAPFISCSYL

SEQ ID NO: 510069 - protein, 10 aa, Influenza virus
RAPISLGDCS

SEQ ID NO: 510070 - protein, 10 aa, Influenza virus
RAPYRSLIRF

SEQ ID NO: 510071 - protein, 10 aa, Influenza virus
RARIDARIDF

SEQ ID NO: 510072 - protein, 10 aa, Influenza virus
RARIDARVDF

SEQ ID NO: 510073 - protein, 10 aa, Influenza virus
RARIDARVDS

SEQ ID NO: 510074 - protein, 10 aa, Influenza virus
RARIKTRLFT

SEQ ID NO: 510075 - protein, 10 aa, Influenza virus
RARPQVNGQS

SEQ ID NO: 510076 - protein, 10 aa, Influenza virus
RATEYIMKGV

SEQ ID NO: 510077 - protein, 10 aa, Influenza virus
RATEYMMKGV

SEQ ID NO: 510078 - protein, 10 aa, Influenza virus
RATFLRSNAP

SEQ ID NO: 510079 - protein, 10 aa, Influenza virus
RATVSADPLA

SEQ ID NO: 510080 - protein, 10 aa, Influenza virus
RATVSADPLL

SEQ ID NO: 510081 - protein, 10 aa, Influenza virus
RATVSADPLV

SEQ ID NO: 510082 - protein, 10 aa, Influenza virus
RAVDGTIAGF

SEQ ID NO: 510083 - protein, 10 aa, Influenza virus
RAVGKCPRYV

SEQ ID NO: 510084 - protein, 10 aa, Influenza virus
RAVKLYKKLK

SEQ ID NO: 510085 - protein, 10 aa, Influenza virus
RAVKLYRKLK

SEQ ID NO: 510086 - protein, 10 aa, Influenza virus
RAWLHVCVTG

SEQ ID NO: 510087 - protein, 10 aa, Influenza virus
RAYVDGFEPN

SEQ ID NO: 510088 - protein, 10 aa, Influenza virus
RAYVDGFKPN

SEQ ID NO: 510089 - protein, 10 aa, Influenza virus
RCCNLFEKFF

SEQ ID NO: 510090 - protein, 10 aa, Influenza virus
RCDDQCMESI

SEQ ID NO: 510091 - protein, 10 aa, Influenza virus
RCFYVELIRG

SEQ ID NO: 510092 - protein, 10 aa, Influenza virus
RCFYVELVRG

SEQ ID NO: 510093 - protein, 10 aa, Influenza virus
RCICEKLEQS

SEQ ID NO: 510094 - protein, 10 aa, Influenza virus
RCICKDNWKG

SEQ ID NO: 510095 - protein, 10 aa, Influenza virus
RCICRDNWKG

SEQ ID NO: 510096 - protein, 10 aa, Influenza virus
RCINRCFYVE

SEQ ID NO: 510097 - protein, 10 aa, Influenza virus
RCLLQSLQQI

SEQ ID NO: 510098 - protein, 10 aa, Influenza virus
RCNTKCQTSL

SEQ ID NO: 510099 - protein, 10 aa, Influenza virus
RCNTKCQTSV

SEQ ID NO: 510100 - protein, 10 aa, Influenza virus
RCNTRCQTSV

SEQ ID NO: 510101 - protein, 10 aa, Influenza virus
RCPRYVKQSS

SEQ ID NO: 510102 - protein, 10 aa, Influenza virus
RCQTPLGAIN

SEQ ID NO: 510103 - protein, 10 aa, Influenza virus
RCQTSVGGIN

SEQ ID NO: 510104 - protein, 10 aa, Influenza virus
RCRETRGLFG

SEQ ID NO: 510105 - protein, 10 aa, Influenza virus
RCRKTRGLFG

SEQ ID NO: 510106 - protein, 10 aa, Influenza virus
RCTISLVKTT

SEQ ID NO: 510107 - protein, 10 aa, Influenza virus
RCVCRDNWKG

SEQ ID NO: 510108 - protein, 10 aa, Influenza virus
RCVCRDNWMG

SEQ ID NO: 510109 - protein, 10 aa, Influenza virus
RCVCRDNWRG

SEQ ID NO: 510110 - protein, 10 aa, Influenza virus
RCYQFALGQG

SEQ ID NO: 510111 - protein, 10 aa, Influenza virus
RDAMTEIWSY

SEQ ID NO: 510112 - protein, 10 aa, Influenza virus
RDAMTEVWSY

SEQ ID NO: 510113 - protein, 10 aa, Influenza virus
RDCKIEAVIY

SEQ ID NO: 510114 - protein, 10 aa, Influenza virus
RDCKVEAVIY

SEQ ID NO: 510115 - protein, 10 aa, Influenza virus
RDCSIAGWLL

SEQ ID NO: 510116 - protein, 10 aa, Influenza virus
RDCSVAGWLL

SEQ ID NO: 510117 - protein, 10 aa, Influenza virus
RDDAINNRFQ

SEQ ID NO: 510118 - protein, 10 aa, Influenza virus
RDDLEPGTFD

SEQ ID NO: 510119 - protein, 10 aa, Influenza virus
RDEAINNRFQ

SEQ ID NO: 510120 - protein, 10 aa, Influenza virus
RDEAINNRIK

SEQ ID NO: 510121 - protein, 10 aa, Influenza virus
RDEAINSRFQ

SEQ ID NO: 510122 - protein, 10 aa, Influenza virus
RDEAISNRFQ

SEQ ID NO: 510123 - protein, 10 aa, Influenza virus
RDEALNNRFQ

SEQ ID NO: 510124 - protein, 10 aa, Influenza virus
RDEALNNRSQ

SEQ ID NO: 510125 - protein, 10 aa, Influenza virus
RDEALSNRFQ

SEQ ID NO: 510126 - protein, 10 aa, Influenza virus
RDEAVNNRFQ

SEQ ID NO: 510127 - protein, 10 aa, Influenza virus
RDEEGTGIAA

SEQ ID NO: 510128 - protein, 10 aa, Influenza virus
RDEGNGCFTF

SEQ ID NO: 510129 - protein, 10 aa, Influenza virus
RDILRTQESE

SEQ ID NO: 510130 - protein, 10 aa, Influenza virus
RDITIGSICM

SEQ ID NO: 510131 - protein, 10 aa, Influenza virus
RDLGNCHPIG

SEQ ID NO: 510132 - protein, 10 aa, Influenza virus
RDNAKDEGNG

SEQ ID NO: 510133 - protein, 10 aa, Influenza virus
RDNAKDLGNG

SEQ ID NO: 510134 - protein, 10 aa, Influenza virus
RDNAKEIGNG

SEQ ID NO: 510135 - protein, 10 aa, Influenza virus
RDNAKELGNG

SEQ ID NO: 510136 - protein, 10 aa, Influenza virus
RDNAMILGNG

SEQ ID NO: 510137 - protein, 10 aa, Influenza virus
RDNANDLGNG

SEQ ID NO: 510138 - protein, 10 aa, Influenza virus
RDNLEPGTFD

SEQ ID NO: 510139 - protein, 10 aa, Influenza virus
RDNVKELGDG

SEQ ID NO: 510140 - protein, 10 aa, Influenza virus
RDNVKELGNG

SEQ ID NO: 510141 - protein, 10 aa, Influenza virus
RDNWHASNRP

SEQ ID NO: 510142 - protein, 10 aa, Influenza virus
RDNWHGSNRP

SEQ ID NO: 510143 - protein, 10 aa, Influenza virus
RDNWKGANRP

SEQ ID NO: 510144 - protein, 10 aa, Influenza virus
RDNWKGSNRP

SEQ ID NO: 510145 - protein, 10 aa, Influenza virus
RDNWMGSNRP

SEQ ID NO: 510146 - protein, 10 aa, Influenza virus
RDNWNGMNRP

SEQ ID NO: 510147 - protein, 10 aa, Influenza virus
RDNWQGANRP

SEQ ID NO: 510148 - protein, 10 aa, Influenza virus
RDNWQGSNRP

SEQ ID NO: 510149 - protein, 10 aa, Influenza virus
RDNWRGANRP

SEQ ID NO: 510150 - protein, 10 aa, Influenza virus
RDNWRGSNRP

SEQ ID NO: 510151 - protein, 10 aa, Influenza virus
RDNWTGTNRP

SEQ ID NO: 510152 - protein, 10 aa, Influenza virus
RDQGWSYIVE

SEQ ID NO: 510153 - protein, 10 aa, Influenza virus
RDQKSLRGRG

SEQ ID NO: 510154 - protein, 10 aa, Influenza virus
RDRTPYRSLI

SEQ ID NO: 510155 - protein, 10 aa, Influenza virus
RDSIKSWRNN

SEQ ID NO: 510156 - protein, 10 aa, Influenza virus
RDSITELWSY

SEQ ID NO: 510157 - protein, 10 aa, Influenza virus
RDSITEVWSY

SEQ ID NO: 510158 - protein, 10 aa, Influenza virus
RDSLEPGTFD

SEQ ID NO: 510159 - protein, 10 aa, Influenza virus
RDSLTEIWSY

SEQ ID NO: 510160 - protein, 10 aa, Influenza virus
RDSMTEIWSY

SEQ ID NO: 510161 - protein, 10 aa, Influenza virus
RDSMTEVWSY

SEQ ID NO: 510162 - protein, 10 aa, Influenza virus
RDSRSGYETF

SEQ ID NO: 510163 - protein, 10 aa, Influenza virus
RDSSILTDSQ

SEQ ID NO: 510164 - protein, 10 aa, Influenza virus
RDSTQKAIDI

SEQ ID NO: 510165 - protein, 10 aa, Influenza virus
RDSTQKAIDN

SEQ ID NO: 510166 - protein, 10 aa, Influenza virus
RDSTQMAIDN

SEQ ID NO: 510167 - protein, 10 aa, Influenza virus
RDSTQRAIDN

SEQ ID NO: 510168 - protein, 10 aa, Influenza virus
RDSVTELWSY

SEQ ID NO: 510169 - protein, 10 aa, Influenza virus
RDVLVIWGIH

SEQ ID NO: 510170 - protein, 10 aa, Influenza virus
RDVLVLWGIH

SEQ ID NO: 510171 - protein, 10 aa, Influenza virus
RDVLVMWGIH

SEQ ID NO: 510172 - protein, 10 aa, Influenza virus
RDVLVMWGLH

SEQ ID NO: 510173 - protein, 10 aa, Influenza virus
RDWSKPQCQI

SEQ ID NO: 510174 - protein, 10 aa, Influenza virus
RDYEELKHLM

SEQ ID NO: 510175 - protein, 10 aa, Influenza virus
RECFNPCFYV

SEQ ID NO: 510176 - protein, 10 aa, Influenza virus
REDKRYGPAL

SEQ ID NO: 510177 - protein, 10 aa, Influenza virus
REEALLNRIN

SEQ ID NO: 510178 - protein, 10 aa, Influenza virus
REEALLNRLN

SEQ ID NO: 510179 - protein, 10 aa, Influenza virus
REEALLNRLS

SEQ ID NO: 510180 - protein, 10 aa, Influenza virus
REEAMQNRIQ

SEQ ID NO: 510181 - protein, 10 aa, Influenza virus
REESLLNRLS

SEQ ID NO: 510182 - protein, 10 aa, Influenza virus
REESQLKKQE

SEQ ID NO: 510183 - protein, 10 aa, Influenza virus
REESQLKRQE

SEQ ID NO: 510184 - protein, 10 aa, Influenza virus
REFEVMNHEF

SEQ ID NO: 510185 - protein, 10 aa, Influenza virus
REFEVVDHEF

SEQ ID NO: 510186 - protein, 10 aa, Influenza virus
REFEVVNHEF

SEQ ID NO: 510187 - protein, 10 aa, Influenza virus
REFGVVNHEF

SEQ ID NO: 510188 - protein, 10 aa, Influenza virus
REGKHIVERI

SEQ ID NO: 510189 - protein, 10 aa, Influenza virus
REGLILEYYF

SEQ ID NO: 510190 - protein, 10 aa, Influenza virus
REGRNPGNAE

SEQ ID NO: 510191 - protein, 10 aa, Influenza virus
REGRRKTNLY

SEQ ID NO: 510192 - protein, 10 aa, Influenza virus
REGYSLVGID

SEQ ID NO: 510193 - protein, 10 aa, Influenza virus
REHLSSVSSF

SEQ ID NO: 510194 - protein, 10 aa, Influenza virus
REIHIYYLEK

SEQ ID NO: 510195 - protein, 10 aa, Influenza virus
REILTKITVD

SEQ ID NO: 510196 - protein, 10 aa, Influenza virus
REILTKTTVD

SEQ ID NO: 510197 - protein, 10 aa, Influenza virus
REILTRTTVD

SEQ ID NO: 510198 - protein, 10 aa, Influenza virus
REITFHGAKE

SEQ ID NO: 510199 - protein, 10 aa, Influenza virus
REITFYGAKE

SEQ ID NO: 510200 - protein, 10 aa, Influenza virus
REKDMTKEFF

SEQ ID NO: 510201 - protein, 10 aa, Influenza virus
RELCTINSWH

SEQ ID NO: 510202 - protein, 10 aa, Influenza virus
RELGNGCFEF

SEQ ID NO: 510203 - protein, 10 aa, Influenza virus
RELVRKTRFL

SEQ ID NO: 510204 - protein, 10 aa, Influenza virus
RELWQCYYLL

SEQ ID NO: 510205 - protein, 10 aa, Influenza virus
REMTFHGAKE

SEQ ID NO: 510206 - protein, 10 aa, Influenza virus
RENAEDIGNG

SEQ ID NO: 510207 - protein, 10 aa, Influenza virus
RENAEDKGNG

SEQ ID NO: 510208 - protein, 10 aa, Influenza virus
RENAEDMGDG

SEQ ID NO: 510209 - protein, 10 aa, Influenza virus
RENAEDMGGG

SEQ ID NO: 510210 - protein, 10 aa, Influenza virus
RENAEDMGNG

SEQ ID NO: 510211 - protein, 10 aa, Influenza virus
RENAEDQGNG

SEQ ID NO: 510212 - protein, 10 aa, Influenza virus
RENAEDRGNG

SEQ ID NO: 510213 - protein, 10 aa, Influenza virus
RENAEEDCTG

SEQ ID NO: 510214 - protein, 10 aa, Influenza virus
RENAEEDGNG

SEQ ID NO: 510215 - protein, 10 aa, Influenza virus
RENAEEDGTA

SEQ ID NO: 510216 - protein, 10 aa, Influenza virus
RENAEEDGTG

SEQ ID NO: 510217 - protein, 10 aa, Influenza virus
RENAEEMGNG

SEQ ID NO: 510218 - protein, 10 aa, Influenza virus
REPFISCSHF

SEQ ID NO: 510219 - protein, 10 aa, Influenza virus
REPFISCSHL

SEQ ID NO: 510220 - protein, 10 aa, Influenza virus
REPFISCSHM

SEQ ID NO: 510221 - protein, 10 aa, Influenza virus
REPFISCSHS

SEQ ID NO: 510222 - protein, 10 aa, Influenza virus
REPFISCSPL

SEQ ID NO: 510223 - protein, 10 aa, Influenza virus
REPFISCSQL

SEQ ID NO: 510224 - protein, 10 aa, Influenza virus
REPFVACGPA

SEQ ID NO: 510225 - protein, 10 aa, Influenza virus
REPFVACGPS

SEQ ID NO: 510226 - protein, 10 aa, Influenza virus
REPFVACGPT

SEQ ID NO: 510227 - protein, 10 aa, Influenza virus
REPFVACSPS

SEQ ID NO: 510228 - protein, 10 aa, Influenza virus
REPFVSCGPS

SEQ ID NO: 510229 - protein, 10 aa, Influenza virus
REPFVSCSHL

SEQ ID NO: 510230 - protein, 10 aa, Influenza virus
REPYVSCDPD

SEQ ID NO: 510231 - protein, 10 aa, Influenza virus
REPYVSCDPI

SEQ ID NO: 510232 - protein, 10 aa, Influenza virus
REPYVSCDPK

SEQ ID NO: 510233 - protein, 10 aa, Influenza virus
REPYVSCDPL

SEQ ID NO: 510234 - protein, 10 aa, Influenza virus
REPYVSCDPN

SEQ ID NO: 510235 - protein, 10 aa, Influenza virus
REPYVSCDPS

SEQ ID NO: 510236 - protein, 10 aa, Influenza virus
REPYVSCDPT

SEQ ID NO: 510237 - protein, 10 aa, Influenza virus
REPYVSCEPD

SEQ ID NO: 510238 - protein, 10 aa, Influenza virus
REQKQEFKMN

SEQ ID NO: 510239 - protein, 10 aa, Influenza virus
REQLSQKFEE

SEQ ID NO: 510240 - protein, 10 aa, Influenza virus
REQLSSVSSF

SEQ ID NO: 510241 - protein, 10 aa, Influenza virus
REQLSTVSSF

SEQ ID NO: 510242 - protein, 10 aa, Influenza virus
REQQGRMDYY

SEQ ID NO: 510243 - protein, 10 aa, Influenza virus
REREGGRRRK

SEQ ID NO: 510244 - protein, 10 aa, Influenza virus
RERLGSWSWH

SEQ ID NO: 510245 - protein, 10 aa, Influenza virus
RESGGIDKEP

SEQ ID NO: 510246 - protein, 10 aa, Influenza virus
RESGGIDKES

SEQ ID NO: 510247 - protein, 10 aa, Influenza virus
RESRNPGNAE

SEQ ID NO: 510248 - protein, 10 aa, Influenza virus
RETRGLFGAI

SEQ ID NO: 510249 - protein, 10 aa, Influenza virus
REVEVVNATE

SEQ ID NO: 510250 - protein, 10 aa, Influenza virus
REVHIYYLEK

SEQ ID NO: 510251 - protein, 10 aa, Influenza virus
REVHMYYLEK

SEQ ID NO: 510252 - protein, 10 aa, Influenza virus
REVHTYYLEK

SEQ ID NO: 510253 - protein, 10 aa, Influenza virus
REVHVYYLEK

SEQ ID NO: 510254 - protein, 10 aa, Influenza virus
REWSYIVERP

SEQ ID NO: 510255 - protein, 10 aa, Influenza virus
REWSYIVERT

SEQ ID NO: 510256 - protein, 10 aa, Influenza virus
REWSYLIEDP

SEQ ID NO: 510257 - protein, 10 aa, Influenza virus
RFADQELGDA

SEQ ID NO: 510258 - protein, 10 aa, Influenza virus
RFEAVAWSAT

SEQ ID NO: 510259 - protein, 10 aa, Influenza virus
RFEGWIVGNP

SEQ ID NO: 510260 - protein, 10 aa, Influenza virus
RFEIIEGRDR

SEQ ID NO: 510261 - protein, 10 aa, Influenza virus
RFESVAWSAS

SEQ ID NO: 510262 - protein, 10 aa, Influenza virus
RFESVAWSAT

SEQ ID NO: 510263 - protein, 10 aa, Influenza virus
RFGEGEQIIV

SEQ ID NO: 510264 - protein, 10 aa, Influenza virus
RFGESEQIIV

SEQ ID NO: 510265 - protein, 10 aa, Influenza virus
RFGESEQIVV

SEQ ID NO: 510266 - protein, 10 aa, Influenza virus
RFGESEQVIV

SEQ ID NO: 510267 - protein, 10 aa, Influenza virus
RFIEIGVTRR

SEQ ID NO: 510268 - protein, 10 aa, Influenza virus
RFIEKTNQQF

SEQ ID NO: 510269 - protein, 10 aa, Influenza virus
RFIQNALNGN

SEQ ID NO: 510270 - protein, 10 aa, Influenza virus
RFLEIGVTRR

SEQ ID NO: 510271 - protein, 10 aa, Influenza virus
RFLFSSIKKY

SEQ ID NO: 510272 - protein, 10 aa, Influenza virus
RFLPDLYDYK

SEQ ID NO: 510273 - protein, 10 aa, Influenza virus
RFLPVAGGTG

SEQ ID NO: 510274 - protein, 10 aa, Influenza virus
RFLPVAGGTS

SEQ ID NO: 510275 - protein, 10 aa, Influenza virus
RFLPVSGGTS

SEQ ID NO: 510276 - protein, 10 aa, Influenza virus
RFLPVTGGTS

SEQ ID NO: 510277 - protein, 10 aa, Influenza virus
RFLRVKDQQG

SEQ ID NO: 510278 - protein, 10 aa, Influenza virus
RFLRVRDQLG

SEQ ID NO: 510279 - protein, 10 aa, Influenza virus
RFLRVRDQMG

SEQ ID NO: 510280 - protein, 10 aa, Influenza virus
RFLRVRDQQG

SEQ ID NO: 510281 - protein, 10 aa, Influenza virus
RFLRVRDQRG

SEQ ID NO: 510282 - protein, 10 aa, Influenza virus
RFNSDLDYQI

SEQ ID NO: 510283 - protein, 10 aa, Influenza virus
RFNSDPDYQI

SEQ ID NO: 510284 - protein, 10 aa, Influenza virus
RFNSNLDYQI

SEQ ID NO: 510285 - protein, 10 aa, Influenza virus
RFQIQGIKLT

SEQ ID NO: 510286 - protein, 10 aa, Influenza virus
RFQIQGVKLA

SEQ ID NO: 510287 - protein, 10 aa, Influenza virus
RFQIQGVKLI

SEQ ID NO: 510288 - protein, 10 aa, Influenza virus
RFQIQGVKLT

SEQ ID NO: 510289 - protein, 10 aa, Influenza virus
RFQIQGVRLT

SEQ ID NO: 510290 - protein, 10 aa, Influenza virus
RFRRPDSSWL

SEQ ID NO: 510291 - protein, 10 aa, Influenza virus
RFSYVFCLAL

SEQ ID NO: 510292 - protein, 10 aa, Influenza virus
RFTEIGVTRR

SEQ ID NO: 510293 - protein, 10 aa, Influenza virus
RFTNEEALRQ

SEQ ID NO: 510294 - protein, 10 aa, Influenza virus
RFTYSGIRTN

SEQ ID NO: 510295 - protein, 10 aa, Influenza virus
RFVEIGVTRR

SEQ ID NO: 510296 - protein, 10 aa, Influenza virus
RFVFSIAASY

SEQ ID NO: 510297 - protein, 10 aa, Influenza virus
RFVFSNAASY

SEQ ID NO: 510298 - protein, 10 aa, Influenza virus
RFVFSSAASY

SEQ ID NO: 510299 - protein, 10 aa, Influenza virus
RFVQNALNGN

SEQ ID NO: 510300 - protein, 10 aa, Influenza virus
RFVQNALSGN

SEQ ID NO: 510301 - protein, 10 aa, Influenza virus
RFYALSQGTT

SEQ ID NO: 510302 - protein, 10 aa, Influenza virus
RFYIQMCTEL

SEQ ID NO: 510303 - protein, 10 aa, Influenza virus
RFYRICKLVG

SEQ ID NO: 510304 - protein, 10 aa, Influenza virus
RFYRTCKLLG

SEQ ID NO: 510305 - protein, 10 aa, Influenza virus
RFYRTCKLVG

SEQ ID NO: 510306 - protein, 10 aa, Influenza virus
RFYVQMCTEL

SEQ ID NO: 510307 - protein, 10 aa, Influenza virus
RGANRPVITI

SEQ ID NO: 510308 - protein, 10 aa, Influenza virus
RGAYERMCNI

SEQ ID NO: 510309 - protein, 10 aa, Influenza virus
RGCFEIYHKC

SEQ ID NO: 510310 - protein, 10 aa, Influenza virus
RGDKICLGHH

SEQ ID NO: 510311 - protein, 10 aa, Influenza virus
RGDLNFVNRA

SEQ ID NO: 510312 - protein, 10 aa, Influenza virus
RGDQICIGYH

SEQ ID NO: 510313 - protein, 10 aa, Influenza virus
RGDQICVGYH

SEQ ID NO: 510314 - protein, 10 aa, Influenza virus
RGDYNNTTGR

SEQ ID NO: 510315 - protein, 10 aa, Influenza virus
RGEDTIEERF

SEQ ID NO: 510316 - protein, 10 aa, Influenza virus
RGEETIEEKF

SEQ ID NO: 510317 - protein, 10 aa, Influenza virus
RGEETIEERF

SEQ ID NO: 510318 - protein, 10 aa, Influenza virus
RGEETVEERF

SEQ ID NO: 510319 - protein, 10 aa, Influenza virus
RGEFNQVEKR

SEQ ID NO: 510320 - protein, 10 aa, Influenza virus
RGEFNQVENR

SEQ ID NO: 510321 - protein, 10 aa, Influenza virus
RGEFNQVEQR

SEQ ID NO: 510322 - protein, 10 aa, Influenza virus
RGEFSQVEQR

SEQ ID NO: 510323 - protein, 10 aa, Influenza virus
RGEFSQVERR

SEQ ID NO: 510324 - protein, 10 aa, Influenza virus
RGEKANVLIG

SEQ ID NO: 510325 - protein, 10 aa, Influenza virus
RGETLKIRTN

SEQ ID NO: 510326 - protein, 10 aa, Influenza virus
RGETTGRNCT

SEQ ID NO: 510327 - protein, 10 aa, Influenza virus
RGEVFVIREP

SEQ ID NO: 510328 - protein, 10 aa, Influenza virus
RGFAPFSKDN

SEQ ID NO: 510329 - protein, 10 aa, Influenza virus
RGFEMVWDAN

SEQ ID NO: 510330 - protein, 10 aa, Influenza virus
RGFFGAIAGF

SEQ ID NO: 510331 - protein, 10 aa, Influenza virus
RGFFPFHKDN

SEQ ID NO: 510332 - protein, 10 aa, Influenza virus
RGFLIIGKED

SEQ ID NO: 510333 - protein, 10 aa, Influenza virus
RGFLILGKED

SEQ ID NO: 510334 - protein, 10 aa, Influenza virus
RGFLILGKEN

SEQ ID NO: 510335 - protein, 10 aa, Influenza virus
RGFLILGRED

SEQ ID NO: 510336 - protein, 10 aa, Influenza virus
RGFVHFVEAL

SEQ ID NO: 510337 - protein, 10 aa, Influenza virus
RGFVYFVEAL

SEQ ID NO: 510338 - protein, 10 aa, Influenza virus
RGFVYFVEIL

SEQ ID NO: 510339 - protein, 10 aa, Influenza virus
RGFVYFVETL

SEQ ID NO: 510340 - protein, 10 aa, Influenza virus
RGGRNSFFSR

SEQ ID NO: 510341 - protein, 10 aa, Influenza virus
RGGSGIMKTE

SEQ ID NO: 510342 - protein, 10 aa, Influenza virus
RGGSINTKLP

SEQ ID NO: 510343 - protein, 10 aa, Influenza virus
RGGSINTRLP

SEQ ID NO: 510344 - protein, 10 aa, Influenza virus
RGHIFVIREP

SEQ ID NO: 510345 - protein, 10 aa, Influenza virus
RGHVFVIREP

SEQ ID NO: 510346 - protein, 10 aa, Influenza virus
RGHYKISKST

SEQ ID NO: 510347 - protein, 10 aa, Influenza virus
RGIEVVNATE

SEQ ID NO: 510348 - protein, 10 aa, Influenza virus
RGIFGAIAGF

SEQ ID NO: 510349 - protein, 10 aa, Influenza virus
RGILEDEQMY

SEQ ID NO: 510350 - protein, 10 aa, Influenza virus
RGINDRNFWR

SEQ ID NO: 510351 - protein, 10 aa, Influenza virus
RGIPPLELGD

SEQ ID NO: 510352 - protein, 10 aa, Influenza virus
RGIQIASNEN

SEQ ID NO: 510353 - protein, 10 aa, Influenza virus
RGKHSNGTIH

SEQ ID NO: 510354 - protein, 10 aa, Influenza virus
RGKLKRRAIA

SEQ ID NO: 510355 - protein, 10 aa, Influenza virus
RGLCKINSWH

SEQ ID NO: 510356 - protein, 10 aa, Influenza virus
RGLCTINSWH

SEQ ID NO: 510357 - protein, 10 aa, Influenza virus
RGLFGAIAGF

SEQ ID NO: 510358 - protein, 10 aa, Influenza virus
RGLFGAKAGF

SEQ ID NO: 510359 - protein, 10 aa, Influenza virus
RGLISTPLGS

SEQ ID NO: 510360 - protein, 10 aa, Influenza virus
RGLISTPLGT

SEQ ID NO: 510361 - protein, 10 aa, Influenza virus
RGLLEVGTRW

SEQ ID NO: 510362 - protein, 10 aa, Influenza virus
RGLLGAIAGF

SEQ ID NO: 510363 - protein, 10 aa, Influenza virus
RGLMSTPLGT

SEQ ID NO: 510364 - protein, 10 aa, Influenza virus
RGLQRRRFIQ

SEQ ID NO: 510365 - protein, 10 aa, Influenza virus
RGLQRRRFVQ

SEQ ID NO: 510366 - protein, 10 aa, Influenza virus
RGLSSRISFY

SEQ ID NO: 510367 - protein, 10 aa, Influenza virus
RGLWDPFRQS

SEQ ID NO: 510368 - protein, 10 aa, Influenza virus
RGLWDSFRQS

SEQ ID NO: 510369 - protein, 10 aa, Influenza virus
RGNGCFEIFH

SEQ ID NO: 510370 - protein, 10 aa, Influenza virus
RGNILLSPEE

SEQ ID NO: 510371 - protein, 10 aa, Influenza virus
RGNIRCNICI

SEQ ID NO: 510372 - protein, 10 aa, Influenza virus
RGNPGVKGWA

SEQ ID NO: 510373 - protein, 10 aa, Influenza virus
RGNQGVKGWA

SEQ ID NO: 510374 - protein, 10 aa, Influenza virus
RGNSPAFNYN

SEQ ID NO: 510375 - protein, 10 aa, Influenza virus
RGNSPIFNYN

SEQ ID NO: 510376 - protein, 10 aa, Influenza virus
RGNSPVFNYN

SEQ ID NO: 510377 - protein, 10 aa, Influenza virus
RGNVLLSPEE

SEQ ID NO: 510378 - protein, 10 aa, Influenza virus
RGQAADLKST

SEQ ID NO: 510379 - protein, 10 aa, Influenza virus
RGQHANGTIH

SEQ ID NO: 510380 - protein, 10 aa, Influenza virus
RGQPKEKAIW

SEQ ID NO: 510381 - protein, 10 aa, Influenza virus
RGQPKEKTIW

SEQ ID NO: 510382 - protein, 10 aa, Influenza virus
RGQPKERTIW

SEQ ID NO: 510383 - protein, 10 aa, Influenza virus
RGQQGRMDYY

SEQ ID NO: 510384 - protein, 10 aa, Influenza virus
RGQQGTMDYY

SEQ ID NO: 510385 - protein, 10 aa, Influenza virus
RGQQGWMDYY

SEQ ID NO: 510386 - protein, 10 aa, Influenza virus
RGQSGRISFY

SEQ ID NO: 510387 - protein, 10 aa, Influenza virus
RGQSGRVSFY

SEQ ID NO: 510388 - protein, 10 aa, Influenza virus
RGRGSTLGLD

SEQ ID NO: 510389 - protein, 10 aa, Influenza virus
RGRGVFELSD

SEQ ID NO: 510390 - protein, 10 aa, Influenza virus
RGRHANGTIH

SEQ ID NO: 510391 - protein, 10 aa, Influenza virus
RGRHANGTIN

SEQ ID NO: 510392 - protein, 10 aa, Influenza virus
RGRHANGTMH

SEQ ID NO: 510393 - protein, 10 aa, Influenza virus
RGRHSNGTIH

SEQ ID NO: 510394 - protein, 10 aa, Influenza virus
RGRIFQSRIR

SEQ ID NO: 510395 - protein, 10 aa, Influenza virus
RGRLCNPLNP

SEQ ID NO: 510396 - protein, 10 aa, Influenza virus
RGRPEEAKYV

SEQ ID NO: 510397 - protein, 10 aa, Influenza virus
RGRPEEVKYV

SEQ ID NO: 510398 - protein, 10 aa, Influenza virus
RGRPKEDEVW

SEQ ID NO: 510399 - protein, 10 aa, Influenza virus
RGRPKEDKVW

SEQ ID NO: 510400 - protein, 10 aa, Influenza virus
RGRPKEDRVW

SEQ ID NO: 510401 - protein, 10 aa, Influenza virus
RGRPKEEKVW

SEQ ID NO: 510402 - protein, 10 aa, Influenza virus
RGSARHIEEC

SEQ ID NO: 510403 - protein, 10 aa, Influenza virus
RGSFYRSMRW

SEQ ID NO: 510404 - protein, 10 aa, Influenza virus
RGSGLRILIR

SEQ ID NO: 510405 - protein, 10 aa, Influenza virus
RGSGLRILVR

SEQ ID NO: 510406 - protein, 10 aa, Influenza virus
RGSGMRILIR

SEQ ID NO: 510407 - protein, 10 aa, Influenza virus
RGSGMRILVR

SEQ ID NO: 510408 - protein, 10 aa, Influenza virus
RGSIAHKSCL

SEQ ID NO: 510409 - protein, 10 aa, Influenza virus
RGSNRPIVDI

SEQ ID NO: 510410 - protein, 10 aa, Influenza virus
RGSNRPWIRF

SEQ ID NO: 510411 - protein, 10 aa, Influenza virus
RGSNRPWVRF

SEQ ID NO: 510412 - protein, 10 aa, Influenza virus
RGSPGVKGWA

SEQ ID NO: 510413 - protein, 10 aa, Influenza virus
RGSSGIMKTE

SEQ ID NO: 510414 - protein, 10 aa, Influenza virus
RGSSGIMKTG

SEQ ID NO: 510415 - protein, 10 aa, Influenza virus
RGSSGVMKTE

SEQ ID NO: 510416 - protein, 10 aa, Influenza virus
RGSTLGLDIR

SEQ ID NO: 510417 - protein, 10 aa, Influenza virus
RGSTQKAIDN

SEQ ID NO: 510418 - protein, 10 aa, Influenza virus
RGSVAHKSCL

SEQ ID NO: 510419 - protein, 10 aa, Influenza virus
RGSYNNTSGE

SEQ ID NO: 510420 - protein, 10 aa, Influenza virus
RGTGMRILVR

SEQ ID NO: 510421 - protein, 10 aa, Influenza virus
RGTIVSSLPF

SEQ ID NO: 510422 - protein, 10 aa, Influenza virus
RGTNSFYRNL

SEQ ID NO: 510423 - protein, 10 aa, Influenza virus
RGTQGVKGWA

SEQ ID NO: 510424 - protein, 10 aa, Influenza virus
RGVEVVDATE

SEQ ID NO: 510425 - protein, 10 aa, Influenza virus
RGVEVVNATE

SEQ ID NO: 510426 - protein, 10 aa, Influenza virus
RGVFEFSDER

SEQ ID NO: 510427 - protein, 10 aa, Influenza virus
RGVFELSDEK

SEQ ID NO: 510428 - protein, 10 aa, Influenza virus
RGVFELSDER

SEQ ID NO: 510429 - protein, 10 aa, Influenza virus
RGVLEDEQMY

SEQ ID NO: 510430 - protein, 10 aa, Influenza virus
RGVNDRNFWR

SEQ ID NO: 510431 - protein, 10 aa, Influenza virus
RGVQIASNEN

SEQ ID NO: 510432 - protein, 10 aa, Influenza virus
RGVQVASNEN

SEQ ID NO: 510433 - protein, 10 aa, Influenza virus
RGWAPLSKDN

SEQ ID NO: 510434 - protein, 10 aa, Influenza virus
RGYKMNIQIL

SEQ ID NO: 510435 - protein, 10 aa, Influenza virus
RGYKMNNQIL

SEQ ID NO: 510436 - protein, 10 aa, Influenza virus
RGYKMNTKIL

SEQ ID NO: 510437 - protein, 10 aa, Influenza virus
RGYKMNTQIL

SEQ ID NO: 510438 - protein, 10 aa, Influenza virus
RGYKMNTRIL

SEQ ID NO: 510439 - protein, 10 aa, Influenza virus
RGYPGVKGWA

SEQ ID NO: 510440 - protein, 10 aa, Influenza virus
RHANGTIHDR

SEQ ID NO: 510441 - protein, 10 aa, Influenza virus
RHANGTINDR

SEQ ID NO: 510442 - protein, 10 aa, Influenza virus
RHANGTMHDR

SEQ ID NO: 510443 - protein, 10 aa, Influenza virus
RHCSKYHWNL

SEQ ID NO: 510444 - protein, 10 aa, Influenza virus
RHENRMVIAS

SEQ ID NO: 510445 - protein, 10 aa, Influenza virus
RHENRMVLAS

SEQ ID NO: 510446 - protein, 10 aa, Influenza virus
RHFQKDAKIL

SEQ ID NO: 510447 - protein, 10 aa, Influenza virus
RHFQKDAKML

SEQ ID NO: 510448 - protein, 10 aa, Influenza virus
RHFQKDAKVL

SEQ ID NO: 510449 - protein, 10 aa, Influenza virus
RHFQKDARVL

SEQ ID NO: 510450 - protein, 10 aa, Influenza virus
RHFQKNAKVL

SEQ ID NO: 510451 - protein, 10 aa, Influenza virus
RHHMGECPKY

SEQ ID NO: 510452 - protein, 10 aa, Influenza virus
RHHNSEGTGQ

SEQ ID NO: 510453 - protein, 10 aa, Influenza virus
RHIEECPCYG

SEQ ID NO: 510454 - protein, 10 aa, Influenza virus
RHIEECSCYG

SEQ ID NO: 510455 - protein, 10 aa, Influenza virus
RHIEEWSCYG

SEQ ID NO: 510456 - protein, 10 aa, Influenza virus
RHLEECSCYV

SEQ ID NO: 510457 - protein, 10 aa, Influenza virus
RHLFSGIKSF

SEQ ID NO: 510458 - protein, 10 aa, Influenza virus
RHLFSGIRSF

SEQ ID NO: 510459 - protein, 10 aa, Influenza virus
RHLFSGVNSF

SEQ ID NO: 510460 - protein, 10 aa, Influenza virus
RHQLRENAED

SEQ ID NO: 510461 - protein, 10 aa, Influenza virus
RHQNAEGTGT

SEQ ID NO: 510462 - protein, 10 aa, Influenza virus
RHQNAQGEGI

SEQ ID NO: 510463 - protein, 10 aa, Influenza virus
RHQNAQGEGT

SEQ ID NO: 510464 - protein, 10 aa, Influenza virus
RHQNAQGIGQ

SEQ ID NO: 510465 - protein, 10 aa, Influenza virus
RHQNAQGQGT

SEQ ID NO: 510466 - protein, 10 aa, Influenza virus
RHQNAQGTGQ

SEQ ID NO: 510467 - protein, 10 aa, Influenza virus
RHQNSEGIGQ

SEQ ID NO: 510468 - protein, 10 aa, Influenza virus
RHQNSEGMGQ

SEQ ID NO: 510469 - protein, 10 aa, Influenza virus
RHQNSEGRGQ

SEQ ID NO: 510470 - protein, 10 aa, Influenza virus
RHQNSEGTGQ

SEQ ID NO: 510471 - protein, 10 aa, Influenza virus
RHQNSEGTGT

SEQ ID NO: 510472 - protein, 10 aa, Influenza virus
RHQNSQGEGT

SEQ ID NO: 510473 - protein, 10 aa, Influenza virus
RHQNTQGEGT

SEQ ID NO: 510474 - protein, 10 aa, Influenza virus
RHRLKITENS

SEQ ID NO: 510475 - protein, 10 aa, Influenza virus
RHSNGTIHDR

SEQ ID NO: 510476 - protein, 10 aa, Influenza virus
RHSNGTVKDR

SEQ ID NO: 510477 - protein, 10 aa, Influenza virus
RHVEECSCYG

SEQ ID NO: 510478 - protein, 10 aa, Influenza virus
RHYIGKCPKY

SEQ ID NO: 510479 - protein, 10 aa, Influenza virus
RHYMGECPEY

SEQ ID NO: 510480 - protein, 10 aa, Influenza virus
RHYMGECPKY

SEQ ID NO: 510481 - protein, 10 aa, Influenza virus
RHYMGECPNY

SEQ ID NO: 510482 - protein, 10 aa, Influenza virus
RIAIGNCPKY

SEQ ID NO: 510483 - protein, 10 aa, Influenza virus
RIAWSSSSCF

SEQ ID NO: 510484 - protein, 10 aa, Influenza virus
RIAYERMCNI

SEQ ID NO: 510485 - protein, 10 aa, Influenza virus
RICEKLEQSG

SEQ ID NO: 510486 - protein, 10 aa, Influenza virus
RICIDFRDMR

SEQ ID NO: 510487 - protein, 10 aa, Influenza virus
RICIGYHANN

SEQ ID NO: 510488 - protein, 10 aa, Influenza virus
RICIGYLSTN

SEQ ID NO: 510489 - protein, 10 aa, Influenza virus
RICIGYQSNN

SEQ ID NO: 510490 - protein, 10 aa, Influenza virus
RICILDQNFR

SEQ ID NO: 510491 - protein, 10 aa, Influenza virus
RICKLVGINM

SEQ ID NO: 510492 - protein, 10 aa, Influenza virus
RICLGHHAVA

SEQ ID NO: 510493 - protein, 10 aa, Influenza virus
RICVGYHANN

SEQ ID NO: 510494 - protein, 10 aa, Influenza virus
RICVGYLSTN

SEQ ID NO: 510495 - protein, 10 aa, Influenza virus
RIDARIDFES

SEQ ID NO: 510496 - protein, 10 aa, Influenza virus
RIDARVDFES

SEQ ID NO: 510497 - protein, 10 aa, Influenza virus
RIDARVDSES

SEQ ID NO: 510498 - protein, 10 aa, Influenza virus
RIDDAVTDIW

SEQ ID NO: 510499 - protein, 10 aa, Influenza virus
RIDDAVTDVW

SEQ ID NO: 510500 - protein, 10 aa, Influenza virus
RIDFHWMLLD

SEQ ID NO: 510501 - protein, 10 aa, Influenza virus
RIECIGWSST

SEQ ID NO: 510502 - protein, 10 aa, Influenza virus
RIENLNKKID

SEQ ID NO: 510503 - protein, 10 aa, Influenza virus
RIENLNKKME

SEQ ID NO: 510504 - protein, 10 aa, Influenza virus
RIENLNKKVD

SEQ ID NO: 510505 - protein, 10 aa, Influenza virus
RIENLNRKME

SEQ ID NO: 510506 - protein, 10 aa, Influenza virus
RIENLNRKVD

SEQ ID NO: 510507 - protein, 10 aa, Influenza virus
RIESLNKKME

SEQ ID NO: 510508 - protein, 10 aa, Influenza virus
RIESLNNKVD

SEQ ID NO: 510509 - protein, 10 aa, Influenza virus
RIEVTNATEL

SEQ ID NO: 510510 - protein, 10 aa, Influenza virus
RIFLAMITYI

SEQ ID NO: 510511 - protein, 10 aa, Influenza virus
RIFQPNIGPR

SEQ ID NO: 510512 - protein, 10 aa, Influenza virus
RIFQSGIRMA

SEQ ID NO: 510513 - protein, 10 aa, Influenza virus
RIFQSGVRLA

SEQ ID NO: 510514 - protein, 10 aa, Influenza virus
RIFQSGVRMA

SEQ ID NO: 510515 - protein, 10 aa, Influenza virus
RIFQSGVRVA

SEQ ID NO: 510516 - protein, 10 aa, Influenza virus
RIFQSRIRMG

SEQ ID NO: 510517 - protein, 10 aa, Influenza virus
RIFRPNIGPR

SEQ ID NO: 510518 - protein, 10 aa, Influenza virus
RIGDGQRSWM

SEQ ID NO: 510519 - protein, 10 aa, Influenza virus
RIGEDSDILV

SEQ ID NO: 510520 - protein, 10 aa, Influenza virus
RIGEDSDVLV

SEQ ID NO: 510521 - protein, 10 aa, Influenza virus
RIGEGQRSWM

SEQ ID NO: 510522 - protein, 10 aa, Influenza virus
RIGEKSDVLV

SEQ ID NO: 510523 - protein, 10 aa, Influenza virus
RIGENSDVLV

SEQ ID NO: 510524 - protein, 10 aa, Influenza virus
RIGENSGVLV

SEQ ID NO: 510525 - protein, 10 aa, Influenza virus
RIGSCTSPCL

SEQ ID NO: 510526 - protein, 10 aa, Influenza virus
RIGSKGDIFV

SEQ ID NO: 510527 - protein, 10 aa, Influenza virus
RIGSKGDVFV

SEQ ID NO: 510528 - protein, 10 aa, Influenza virus
RIGSKGHVFV

SEQ ID NO: 510529 - protein, 10 aa, Influenza virus
RIGSRGDVFI

SEQ ID NO: 510530 - protein, 10 aa, Influenza virus
RIGSRGDVFV

SEQ ID NO: 510531 - protein, 10 aa, Influenza virus
RIGSRGEVFV

SEQ ID NO: 510532 - protein, 10 aa, Influenza virus
RIGSRGHIFV

SEQ ID NO: 510533 - protein, 10 aa, Influenza virus
RIGSRGHVFV

SEQ ID NO: 510534 - protein, 10 aa, Influenza virus
RIIEKTNQQF

SEQ ID NO: 510535 - protein, 10 aa, Influenza virus
RIIQNEDIPI

SEQ ID NO: 510536 - protein, 10 aa, Influenza virus
RIKINPVTLT

SEQ ID NO: 510537 - protein, 10 aa, Influenza virus
RIKTRLFTIR

SEQ ID NO: 510538 - protein, 10 aa, Influenza virus
RILDFHDSNV

SEQ ID NO: 510539 - protein, 10 aa, Influenza virus
RILEEESDEA

SEQ ID NO: 510540 - protein, 10 aa, Influenza virus
RILRTQESEC

SEQ ID NO: 510541 - protein, 10 aa, Influenza virus
RILSIYSTVA

SEQ ID NO: 510542 - protein, 10 aa, Influenza virus
RIMFESNGGL

SEQ ID NO: 510543 - protein, 10 aa, Influenza virus
RIMINPVKLS

SEQ ID NO: 510544 - protein, 10 aa, Influenza virus
RINGVKLEEN

SEQ ID NO: 510545 - protein, 10 aa, Influenza virus
RINMIADRVD

SEQ ID NO: 510546 - protein, 10 aa, Influenza virus
RINMINSKID

SEQ ID NO: 510547 - protein, 10 aa, Influenza virus
RINMINSKIE

SEQ ID NO: 510548 - protein, 10 aa, Influenza virus
RINMINSKIN

SEQ ID NO: 510549 - protein, 10 aa, Influenza virus
RINMINSQID

SEQ ID NO: 510550 - protein, 10 aa, Influenza virus
RINMLADRID

SEQ ID NO: 510551 - protein, 10 aa, Influenza virus
RINMLADRVD

SEQ ID NO: 510552 - protein, 10 aa, Influenza virus
RINMLADWVD

SEQ ID NO: 510553 - protein, 10 aa, Influenza virus
RINNETILET

SEQ ID NO: 510554 - protein, 10 aa, Influenza virus
RINTINSKID

SEQ ID NO: 510555 - protein, 10 aa, Influenza virus
RIPHRTLLMN

SEQ ID NO: 510556 - protein, 10 aa, Influenza virus
RIPHRTLLMS

SEQ ID NO: 510557 - protein, 10 aa, Influenza virus
RIQDIWAYNA

SEQ ID NO: 510558 - protein, 10 aa, Influenza virus
RIQDLEKYIE

SEQ ID NO: 510559 - protein, 10 aa, Influenza virus
RIQDLEKYVE

SEQ ID NO: 510560 - protein, 10 aa, Influenza virus
RIQDLERYVE

SEQ ID NO: 510561 - protein, 10 aa, Influenza virus
RIQHLEECSC

SEQ ID NO: 510562 - protein, 10 aa, Influenza virus
RIQIDPVKLS

SEQ ID NO: 510563 - protein, 10 aa, Influenza virus
RIQIDQVKLS

SEQ ID NO: 510564 - protein, 10 aa, Influenza virus
RIQIDSVKLS

SEQ ID NO: 510565 - protein, 10 aa, Influenza virus
RIRLFDYSGW

SEQ ID NO: 510566 - protein, 10 aa, Influenza virus
RIRLFDYSKW

SEQ ID NO: 510567 - protein, 10 aa, Influenza virus
RIRLFDYSRW

SEQ ID NO: 510568 - protein, 10 aa, Influenza virus
RIRMAINWGR

SEQ ID NO: 510569 - protein, 10 aa, Influenza virus
RIRMATNECR

SEQ ID NO: 510570 - protein, 10 aa, Influenza virus
RISFYWTIVD

SEQ ID NO: 510571 - protein, 10 aa, Influenza virus
RISFYWTIVE

SEQ ID NO: 510572 - protein, 10 aa, Influenza virus
RISFYWTIVK

SEQ ID NO: 510573 - protein, 10 aa, Influenza virus
RISHRTLLMN

SEQ ID NO: 510574 - protein, 10 aa, Influenza virus
RISIYWTLVN

SEQ ID NO: 510575 - protein, 10 aa, Influenza virus
RISKMGVDEY

SEQ ID NO: 510576 - protein, 10 aa, Influenza virus
RISKRGSSGI

SEQ ID NO: 510577 - protein, 10 aa, Influenza virus
RISNETILET

SEQ ID NO: 510578 - protein, 10 aa, Influenza virus
RISSSFSFGG

SEQ ID NO: 510579 - protein, 10 aa, Influenza virus
RITFESNGGL

SEQ ID NO: 510580 - protein, 10 aa, Influenza virus
RITFESSGGL

SEQ ID NO: 510581 - protein, 10 aa, Influenza virus
RITTKINNII

SEQ ID NO: 510582 - protein, 10 aa, Influenza virus
RIWRQANNGD

SEQ ID NO: 510583 - protein, 10 aa, Influenza virus
RIWRQANNGE

SEQ ID NO: 510584 - protein, 10 aa, Influenza virus
RIWSKPQCQI

SEQ ID NO: 510585 - protein, 10 aa, Influenza virus
RKASLRLAVG

SEQ ID NO: 510586 - protein, 10 aa, Influenza virus
RKDILRTQES

SEQ ID NO: 510587 - protein, 10 aa, Influenza virus
RKEPALIVWG

SEQ ID NO: 510588 - protein, 10 aa, Influenza virus
RKEYEEEAKL

SEQ ID NO: 510589 - protein, 10 aa, Influenza virus
RKGLILEYYS

SEQ ID NO: 510590 - protein, 10 aa, Influenza virus
RKKILRTQES

SEQ ID NO: 510591 - protein, 10 aa, Influenza virus
RKKRGLFGAI

SEQ ID NO: 510592 - protein, 10 aa, Influenza virus
RKKRGLFGAK

SEQ ID NO: 510593 - protein, 10 aa, Influenza virus
RKLKREITFH

SEQ ID NO: 510594 - protein, 10 aa, Influenza virus
RKLNRLIEKT

SEQ ID NO: 510595 - protein, 10 aa, Influenza virus
RKMEDGFLDV

SEQ ID NO: 510596 - protein, 10 aa, Influenza virus
RKMMTNSQDT

SEQ ID NO: 510597 - protein, 10 aa, Influenza virus
RKMMTNSRDT

SEQ ID NO: 510598 - protein, 10 aa, Influenza virus
RKMMTSSQDT

SEQ ID NO: 510599 - protein, 10 aa, Influenza virus
RKQILRTQES

SEQ ID NO: 510600 - protein, 10 aa, Influenza virus
RKQLRENAED

SEQ ID NO: 510601 - protein, 10 aa, Influenza virus
RKQLRENAEE

SEQ ID NO: 510602 - protein, 10 aa, Influenza virus
RKQLRQNAEE

SEQ ID NO: 510603 - protein, 10 aa, Influenza virus
RKRDSSILTD

SEQ ID NO: 510604 - protein, 10 aa, Influenza virus
RKRFADQELG

SEQ ID NO: 510605 - protein, 10 aa, Influenza virus
RKRGLFGAIA

SEQ ID NO: 510606 - protein, 10 aa, Influenza virus
RKRKRKTRGL

SEQ ID NO: 510607 - protein, 10 aa, Influenza virus
RKRKTRGLFG

SEQ ID NO: 510608 - protein, 10 aa, Influenza virus
RKRMTRGLFG

SEQ ID NO: 510609 - protein, 10 aa, Influenza virus
RKRNSSILTD

SEQ ID NO: 510610 - protein, 10 aa, Influenza virus
RKTNLYGFII

SEQ ID NO: 510611 - protein, 10 aa, Influenza virus
RKTNLYGFIV

SEQ ID NO: 510612 - protein, 10 aa, Influenza virus
RKTRFLPVAG

SEQ ID NO: 510613 - protein, 10 aa, Influenza virus
RKTRFLPVSG

SEQ ID NO: 510614 - protein, 10 aa, Influenza virus
RKTRFLPVTG

SEQ ID NO: 510615 - protein, 10 aa, Influenza virus
RKTRFLPVVG

SEQ ID NO: 510616 - protein, 10 aa, Influenza virus
RKTRGLFGAI

SEQ ID NO: 510617 - protein, 10 aa, Influenza virus
RLAAGGAIWV

SEQ ID NO: 510618 - protein, 10 aa, Influenza virus
RLAAGGDIWV

SEQ ID NO: 510619 - protein, 10 aa, Influenza virus
RLAIGLRNTP

SEQ ID NO: 510620 - protein, 10 aa, Influenza virus
RLAKCNTKCQ

SEQ ID NO: 510621 - protein, 10 aa, Influenza virus
RLALGLRNTP

SEQ ID NO: 510622 - protein, 10 aa, Influenza virus
RLATGLRNIP

SEQ ID NO: 510623 - protein, 10 aa, Influenza virus
RLATGLRNVP

SEQ ID NO: 510624 - protein, 10 aa, Influenza virus
RLATGMRNIP

SEQ ID NO: 510625 - protein, 10 aa, Influenza virus
RLAVGLRNTP

SEQ ID NO: 510626 - protein, 10 aa, Influenza virus
RLCNPLNPFV

SEQ ID NO: 510627 - protein, 10 aa, Influenza virus
RLCNPMNPFV

SEQ ID NO: 510628 - protein, 10 aa, Influenza virus
RLCTINSWHI

SEQ ID NO: 510629 - protein, 10 aa, Influenza virus
RLCYPGELDN

SEQ ID NO: 510630 - protein, 10 aa, Influenza virus
RLEENTTYKI

SEQ ID NO: 510631 - protein, 10 aa, Influenza virus
RLENLDKKME

SEQ ID NO: 510632 - protein, 10 aa, Influenza virus
RLENLNKKME

SEQ ID NO: 510633 - protein, 10 aa, Influenza virus
RLENLNKKVE

SEQ ID NO: 510634 - protein, 10 aa, Influenza virus
RLENLNKRME

SEQ ID NO: 510635 - protein, 10 aa, Influenza virus
RLFDYSGWNV

SEQ ID NO: 510636 - protein, 10 aa, Influenza virus
RLFDYSKWNV

SEQ ID NO: 510637 - protein, 10 aa, Influenza virus
RLFDYSRWNV

SEQ ID NO: 510638 - protein, 10 aa, Influenza virus
RLFERVRRQL

SEQ ID NO: 510639 - protein, 10 aa, Influenza virus
RLFTIRQELA

SEQ ID NO: 510640 - protein, 10 aa, Influenza virus
RLFTIRQEMA

SEQ ID NO: 510641 - protein, 10 aa, Influenza virus
RLGKGYMFES

SEQ ID NO: 510642 - protein, 10 aa, Influenza virus
RLGNLNKKME

SEQ ID NO: 510643 - protein, 10 aa, Influenza virus
RLGRGYMFES

SEQ ID NO: 510644 - protein, 10 aa, Influenza virus
RLGSSFYAEM

SEQ ID NO: 510645 - protein, 10 aa, Influenza virus
RLGSWSWHDG

SEQ ID NO: 510646 - protein, 10 aa, Influenza virus
RLGYETFKVI

SEQ ID NO: 510647 - protein, 10 aa, Influenza virus
RLGYETFKVV

SEQ ID NO: 510648 - protein, 10 aa, Influenza virus
RLIDFLKDVI

SEQ ID NO: 510649 - protein, 10 aa, Influenza virus
RLIDFLKDVM

SEQ ID NO: 510650 - protein, 10 aa, Influenza virus
RLIDFLKDVT

SEQ ID NO: 510651 - protein, 10 aa, Influenza virus
RLIDFLKDVV

SEQ ID NO: 510652 - protein, 10 aa, Influenza virus
RLIDKTNQQF

SEQ ID NO: 510653 - protein, 10 aa, Influenza virus
RLIDRTNHQF

SEQ ID NO: 510654 - protein, 10 aa, Influenza virus
RLIEKTNDKY

SEQ ID NO: 510655 - protein, 10 aa, Influenza virus
RLIEKTNEKY

SEQ ID NO: 510656 - protein, 10 aa, Influenza virus
RLIEKTNKQF

SEQ ID NO: 510657 - protein, 10 aa, Influenza virus
RLIEKTNQQF

SEQ ID NO: 510658 - protein, 10 aa, Influenza virus
RLIEKTNTEF

SEQ ID NO: 510659 - protein, 10 aa, Influenza virus
RLIEKTNTQF

SEQ ID NO: 510660 - protein, 10 aa, Influenza virus
RLIERTNEKY

SEQ ID NO: 510661 - protein, 10 aa, Influenza virus
RLIERTNQQF

SEQ ID NO: 510662 - protein, 10 aa, Influenza virus
RLIGKTNQQF

SEQ ID NO: 510663 - protein, 10 aa, Influenza virus
RLILATGLRN

SEQ ID NO: 510664 - protein, 10 aa, Influenza virus
RLIQNSITIE

SEQ ID NO: 510665 - protein, 10 aa, Influenza virus
RLIQNSLTIE

SEQ ID NO: 510666 - protein, 10 aa, Influenza virus
RLIQNSMTIE

SEQ ID NO: 510667 - protein, 10 aa, Influenza virus
RLISKTNQQF

SEQ ID NO: 510668 - protein, 10 aa, Influenza virus
RLKITENSFE

SEQ ID NO: 510669 - protein, 10 aa, Influenza virus
RLLRENAEED

SEQ ID NO: 510670 - protein, 10 aa, Influenza virus
RLLVLLENDK

SEQ ID NO: 510671 - protein, 10 aa, Influenza virus
RLMDFLKDVM

SEQ ID NO: 510672 - protein, 10 aa, Influenza virus
RLNINPVKLS

SEQ ID NO: 510673 - protein, 10 aa, Influenza virus
RLNINPVTLS

SEQ ID NO: 510674 - protein, 10 aa, Influenza virus
RLNINSVKLS

SEQ ID NO: 510675 - protein, 10 aa, Influenza virus
RLNNVIDKMN

SEQ ID NO: 510676 - protein, 10 aa, Influenza virus
RLNPMHQLLR

SEQ ID NO: 510677 - protein, 10 aa, Influenza virus
RLNRNEIKGI

SEQ ID NO: 510678 - protein, 10 aa, Influenza virus
RLNRNEIKGV

SEQ ID NO: 510679 - protein, 10 aa, Influenza virus
RLNTMHQLLR

SEQ ID NO: 510680 - protein, 10 aa, Influenza virus
RLNWLTKATN

SEQ ID NO: 510681 - protein, 10 aa, Influenza virus
RLNWLTKETN

SEQ ID NO: 510682 - protein, 10 aa, Influenza virus
RLPFQNLSPR

SEQ ID NO: 510683 - protein, 10 aa, Influenza virus
RLQDTTWDVF

SEQ ID NO: 510684 - protein, 10 aa, Influenza virus
RLQLKDNAKE

SEQ ID NO: 510685 - protein, 10 aa, Influenza virus
RLQLKDNARE

SEQ ID NO: 510686 - protein, 10 aa, Influenza virus
RLQLRDNAKE

SEQ ID NO: 510687 - protein, 10 aa, Influenza virus
RLQLRDNARE

SEQ ID NO: 510688 - protein, 10 aa, Influenza virus
RLRGIPPLEL

SEQ ID NO: 510689 - protein, 10 aa, Influenza virus
RLRMATGLRN

SEQ ID NO: 510690 - protein, 10 aa, Influenza virus
RLRRDQKSLR

SEQ ID NO: 510691 - protein, 10 aa, Influenza virus
RLRSGFEMLK

SEQ ID NO: 510692 - protein, 10 aa, Influenza virus
RLSADGDIWV

SEQ ID NO: 510693 - protein, 10 aa, Influenza virus
RLSAGGAIWV

SEQ ID NO: 510694 - protein, 10 aa, Influenza virus
RLSAGGAVWV

SEQ ID NO: 510695 - protein, 10 aa, Influenza virus
RLSAGGDIWI

SEQ ID NO: 510696 - protein, 10 aa, Influenza virus
RLSAGGDIWV

SEQ ID NO: 510697 - protein, 10 aa, Influenza virus
RLSAGGHIWV

SEQ ID NO: 510698 - protein, 10 aa, Influenza virus
RLSAGGNIWI

SEQ ID NO: 510699 - protein, 10 aa, Influenza virus
RLSASGDIWI

SEQ ID NO: 510700 - protein, 10 aa, Influenza virus
RLSASGDIWV

SEQ ID NO: 510701 - protein, 10 aa, Influenza virus
RLSASGDVWV

SEQ ID NO: 510702 - protein, 10 aa, Influenza virus
RLSGIPPLEL

SEQ ID NO: 510703 - protein, 10 aa, Influenza virus
RLSINPVKLS

SEQ ID NO: 510704 - protein, 10 aa, Influenza virus
RLSSGYKDII

SEQ ID NO: 510705 - protein, 10 aa, Influenza virus
RLTIIGKDAG

SEQ ID NO: 510706 - protein, 10 aa, Influenza virus
RLTILGKDAG

SEQ ID NO: 510707 - protein, 10 aa, Influenza virus
RLTITYSSSM

SEQ ID NO: 510708 - protein, 10 aa, Influenza virus
RLTQGRQTYD

SEQ ID NO: 510709 - protein, 10 aa, Influenza virus
RLTQGYKDII

SEQ ID NO: 510710 - protein, 10 aa, Influenza virus
RLTTTIKPWA

SEQ ID NO: 510711 - protein, 10 aa, Influenza virus
RLTTTIKTWA

SEQ ID NO: 510712 - protein, 10 aa, Influenza virus
RLTTTIRTWA

SEQ ID NO: 510713 - protein, 10 aa, Influenza virus
RLTTTVKTWA

SEQ ID NO: 510714 - protein, 10 aa, Influenza virus
RLTVLGKDAG

SEQ ID NO: 510715 - protein, 10 aa, Influenza virus
RLVLATGLRN

SEQ ID NO: 510716 - protein, 10 aa, Influenza virus
RLVQNSITIE

SEQ ID NO: 510717 - protein, 10 aa, Influenza virus
RLVRFRHQNS

SEQ ID NO: 510718 - protein, 10 aa, Influenza virus
RLYIWGVHHP

SEQ ID NO: 510719 - protein, 10 aa, Influenza virus
RLYLWGVHHP

SEQ ID NO: 510720 - protein, 10 aa, Influenza virus
RLYVNKNPYT

SEQ ID NO: 510721 - protein, 10 aa, Influenza virus
RMAINWGRIV

SEQ ID NO: 510722 - protein, 10 aa, Influenza virus
RMAKCNTKCQ

SEQ ID NO: 510723 - protein, 10 aa, Influenza virus
RMARCNTKCQ

SEQ ID NO: 510724 - protein, 10 aa, Influenza virus
RMATGLRNIP

SEQ ID NO: 510725 - protein, 10 aa, Influenza virus
RMATGLRNVP

SEQ ID NO: 510726 - protein, 10 aa, Influenza virus
RMATNECRII

SEQ ID NO: 510727 - protein, 10 aa, Influenza virus
RMCNILKGKF

SEQ ID NO: 510728 - protein, 10 aa, Influenza virus
RMCSLMQGST

SEQ ID NO: 510729 - protein, 10 aa, Influenza virus
RMDYYWAILK

SEQ ID NO: 510730 - protein, 10 aa, Influenza virus
RMDYYWAVLK

SEQ ID NO: 510731 - protein, 10 aa, Influenza virus
RMDYYWGILK

SEQ ID NO: 510732 - protein, 10 aa, Influenza virus
RMENLNKKVD

SEQ ID NO: 510733 - protein, 10 aa, Influenza virus
RMFALSQGTT

SEQ ID NO: 510734 - protein, 10 aa, Influenza virus
RMFLAMITYI

SEQ ID NO: 510735 - protein, 10 aa, Influenza virus
RMGKCNTKCQ

SEQ ID NO: 510736 - protein, 10 aa, Influenza virus
RMGLQMQRFK

SEQ ID NO: 510737 - protein, 10 aa, Influenza virus
RMGVQIQRFK

SEQ ID NO: 510738 - protein, 10 aa, Influenza virus
RMGVQLQRFK

SEQ ID NO: 510739 - protein, 10 aa, Influenza virus
RMGVQMHRFK

SEQ ID NO: 510740 - protein, 10 aa, Influenza virus
RMGVQMQRFK

SEQ ID NO: 510741 - protein, 10 aa, Influenza virus
RMIKAVRGDL

SEQ ID NO: 510742 - protein, 10 aa, Influenza virus
RMIKRGINDR

SEQ ID NO: 510743 - protein, 10 aa, Influenza virus
RMIKRGVNDR

SEQ ID NO: 510744 - protein, 10 aa, Influenza virus
RMKWMMAMKY

SEQ ID NO: 510745 - protein, 10 aa, Influenza virus
RMKWMMAMRY

SEQ ID NO: 510746 - protein, 10 aa, Influenza virus
RMNNETILET

SEQ ID NO: 510747 - protein, 10 aa, Influenza virus
RMQFSSLAVN

SEQ ID NO: 510748 - protein, 10 aa, Influenza virus
RMQFSSLTVN

SEQ ID NO: 510749 - protein, 10 aa, Influenza virus
RMQFSSLTVS

SEQ ID NO: 510750 - protein, 10 aa, Influenza virus
RMQLKDNAKE

SEQ ID NO: 510751 - protein, 10 aa, Influenza virus
RMQLRDNAKE

SEQ ID NO: 510752 - protein, 10 aa, Influenza virus
RMQLRDNVKE

SEQ ID NO: 510753 - protein, 10 aa, Influenza virus
RMSDSIKSWR

SEQ ID NO: 510754 - protein, 10 aa, Influenza virus
RMSICISGPN

SEQ ID NO: 510755 - protein, 10 aa, Influenza virus
RMSICMSGPN

SEQ ID NO: 510756 - protein, 10 aa, Influenza virus
RMSICVSGPN

SEQ ID NO: 510757 - protein, 10 aa, Influenza virus
RMSVCISGPN

SEQ ID NO: 510758 - protein, 10 aa, Influenza virus
RMSVCMSGPN

SEQ ID NO: 510759 - protein, 10 aa, Influenza virus
RMTDSIKSWR

SEQ ID NO: 510760 - protein, 10 aa, Influenza virus
RMTICIQGNN

SEQ ID NO: 510761 - protein, 10 aa, Influenza virus
RMTICVQGDN

SEQ ID NO: 510762 - protein, 10 aa, Influenza virus
RMTICVQGKN

SEQ ID NO: 510763 - protein, 10 aa, Influenza virus
RMTICVQGNN

SEQ ID NO: 510764 - protein, 10 aa, Influenza virus
RMTRGLFGAI

SEQ ID NO: 510765 - protein, 10 aa, Influenza virus
RMVIASTTAK

SEQ ID NO: 510766 - protein, 10 aa, Influenza virus
RMVKRGINDR

SEQ ID NO: 510767 - protein, 10 aa, Influenza virus
RMVLASTTAK

SEQ ID NO: 510768 - protein, 10 aa, Influenza virus
RMVLSAFDER

SEQ ID NO: 510769 - protein, 10 aa, Influenza virus
RMVTGLRNIP

SEQ ID NO: 510770 - protein, 10 aa, Influenza virus
RMYALHQGTT

SEQ ID NO: 510771 - protein, 10 aa, Influenza virus
RMYQKCCNLF

SEQ ID NO: 510772 - protein, 10 aa, Influenza virus
RNAFRGLIST

SEQ ID NO: 510773 - protein, 10 aa, Influenza virus
RNAHKMESRG

SEQ ID NO: 510774 - protein, 10 aa, Influenza virus
RNAIGDCPKY

SEQ ID NO: 510775 - protein, 10 aa, Influenza virus
RNALGDCPKY

SEQ ID NO: 510776 - protein, 10 aa, Influenza virus
RNALGNCPKY

SEQ ID NO: 510777 - protein, 10 aa, Influenza virus
RNALSIAPIM

SEQ ID NO: 510778 - protein, 10 aa, Influenza virus
RNCTIPCFWV

SEQ ID NO: 510779 - protein, 10 aa, Influenza virus
RNCTVPCFWV

SEQ ID NO: 510780 - protein, 10 aa, Influenza virus
RNDDSSSNSN

SEQ ID NO: 510781 - protein, 10 aa, Influenza virus
RNDDSSSSSN

SEQ ID NO: 510782 - protein, 10 aa, Influenza virus
RNDLYGTQSL

SEQ ID NO: 510783 - protein, 10 aa, Influenza virus
RNDTDVVNFL

SEQ ID NO: 510784 - protein, 10 aa, Influenza virus
RNDTDVVNFV

SEQ ID NO: 510785 - protein, 10 aa, Influenza virus
RNDTDVVNYV

SEQ ID NO: 510786 - protein, 10 aa, Influenza virus
RNEAINNRFQ

SEQ ID NO: 510787 - protein, 10 aa, Influenza virus
RNEALNNRFQ

SEQ ID NO: 510788 - protein, 10 aa, Influenza virus
RNEDGSSSSN

SEQ ID NO: 510789 - protein, 10 aa, Influenza virus
RNEDSSSNSN

SEQ ID NO: 510790 - protein, 10 aa, Influenza virus
RNEDSSSSSN

SEQ ID NO: 510791 - protein, 10 aa, Influenza virus
RNEEGTGIAA

SEQ ID NO: 510792 - protein, 10 aa, Influenza virus
RNEEGTGVAA

SEQ ID NO: 510793 - protein, 10 aa, Influenza virus
RNEIKGIKLS

SEQ ID NO: 510794 - protein, 10 aa, Influenza virus
RNEIKGVELS

SEQ ID NO: 510795 - protein, 10 aa, Influenza virus
RNEIKGVKLS

SEQ ID NO: 510796 - protein, 10 aa, Influenza virus
RNFKPNIGPR

SEQ ID NO: 510797 - protein, 10 aa, Influenza virus
RNFPQTTNTY

SEQ ID NO: 510798 - protein, 10 aa, Influenza virus
RNFQPNIGPR

SEQ ID NO: 510799 - protein, 10 aa, Influenza virus
RNFWRGDNGR

SEQ ID NO: 510800 - protein, 10 aa, Influenza virus
RNFWRGENGR

SEQ ID NO: 510801 - protein, 10 aa, Influenza virus
RNGFEMLKIP

SEQ ID NO: 510802 - protein, 10 aa, Influenza virus
RNGKWREQLS

SEQ ID NO: 510803 - protein, 10 aa, Influenza virus
RNGNMRCTIC

SEQ ID NO: 510804 - protein, 10 aa, Influenza virus
RNGTYDHKEF

SEQ ID NO: 510805 - protein, 10 aa, Influenza virus
RNGTYDHNIY

SEQ ID NO: 510806 - protein, 10 aa, Influenza virus
RNGTYDYPKY

SEQ ID NO: 510807 - protein, 10 aa, Influenza virus
RNGTYNHEDY

SEQ ID NO: 510808 - protein, 10 aa, Influenza virus
RNGTYNYPKY

SEQ ID NO: 510809 - protein, 10 aa, Influenza virus
RNICEKLEQS

SEQ ID NO: 510810 - protein, 10 aa, Influenza virus
RNILRTQDSE

SEQ ID NO: 510811 - protein, 10 aa, Influenza virus
RNILRTQESE

SEQ ID NO: 510812 - protein, 10 aa, Influenza virus
RNILSIAPIM

SEQ ID NO: 510813 - protein, 10 aa, Influenza virus
RNILSMAPIM

SEQ ID NO: 510814 - protein, 10 aa, Influenza virus
RNIPEKQTRG

SEQ ID NO: 510815 - protein, 10 aa, Influenza virus
RNIPERQTRG

SEQ ID NO: 510816 - protein, 10 aa, Influenza virus
RNIPGKQAKG

SEQ ID NO: 510817 - protein, 10 aa, Influenza virus
RNIPQIESRG

SEQ ID NO: 510818 - protein, 10 aa, Influenza virus
RNIPSIQSRG

SEQ ID NO: 510819 - protein, 10 aa, Influenza virus
RNIPSVQSRG

SEQ ID NO: 510820 - protein, 10 aa, Influenza virus
RNITEIVYLN

SEQ ID NO: 510821 - protein, 10 aa, Influenza virus
RNIVRRAAVS

SEQ ID NO: 510822 - protein, 10 aa, Influenza virus
RNIVRRAIVS

SEQ ID NO: 510823 - protein, 10 aa, Influenza virus
RNIVRRATVS

SEQ ID NO: 510824 - protein, 10 aa, Influenza virus
RNKHSNGTIH

SEQ ID NO: 510825 - protein, 10 aa, Influenza virus
RNKHSNGTTH

SEQ ID NO: 510826 - protein, 10 aa, Influenza virus
RNKHSNSTTH

SEQ ID NO: 510827 - protein, 10 aa, Influenza virus
RNKYLEEHPN

SEQ ID NO: 510828 - protein, 10 aa, Influenza virus
RNKYLEEHPS

SEQ ID NO: 510829 - protein, 10 aa, Influenza virus
RNLHIPEAGL

SEQ ID NO: 510830 - protein, 10 aa, Influenza virus
RNLHIPEVCL

SEQ ID NO: 510831 - protein, 10 aa, Influenza virus
RNLYDKVRLQ

SEQ ID NO: 510832 - protein, 10 aa, Influenza virus
RNLYDKVRMQ

SEQ ID NO: 510833 - protein, 10 aa, Influenza virus
RNMRWLTLKS

SEQ ID NO: 510834 - protein, 10 aa, Influenza virus
RNNMINNDLG

SEQ ID NO: 510835 - protein, 10 aa, Influenza virus
RNNRKEPALI

SEQ ID NO: 510836 - protein, 10 aa, Influenza virus
RNNTYDHAQY

SEQ ID NO: 510837 - protein, 10 aa, Influenza virus
RNNTYDHKKY

SEQ ID NO: 510838 - protein, 10 aa, Influenza virus
RNNTYDHRKY

SEQ ID NO: 510839 - protein, 10 aa, Influenza virus
RNNTYDHSHY

SEQ ID NO: 510840 - protein, 10 aa, Influenza virus
RNNTYDHSKY

SEQ ID NO: 510841 - protein, 10 aa, Influenza virus
RNNTYDHSQY

SEQ ID NO: 510842 - protein, 10 aa, Influenza virus
RNNTYDHSRY

SEQ ID NO: 510843 - protein, 10 aa, Influenza virus
RNNTYDHSTY

SEQ ID NO: 510844 - protein, 10 aa, Influenza virus
RNNTYDHTKY

SEQ ID NO: 510845 - protein, 10 aa, Influenza virus
RNNTYDHTQY

SEQ ID NO: 510846 - protein, 10 aa, Influenza virus
RNNTYNHTEY

SEQ ID NO: 510847 - protein, 10 aa, Influenza virus
RNNTYNHTQY

SEQ ID NO: 510848 - protein, 10 aa, Influenza virus
RNPGNAEIED

SEQ ID NO: 510849 - protein, 10 aa, Influenza virus
RNPGVKGWAF

SEQ ID NO: 510850 - protein, 10 aa, Influenza virus
RNQIKIRRRV

SEQ ID NO: 510851 - protein, 10 aa, Influenza virus
RNQPAATALA

SEQ ID NO: 510852 - protein, 10 aa, Influenza virus
RNQSGRISIY

SEQ ID NO: 510853 - protein, 10 aa, Influenza virus
RNQVKIRRRV

SEQ ID NO: 510854 - protein, 10 aa, Influenza virus
RNRHSNGTIH

SEQ ID NO: 510855 - protein, 10 aa, Influenza virus
RNRSILNTSQ

SEQ ID NO: 510856 - protein, 10 aa, Influenza virus
RNRYLEEHPS

SEQ ID NO: 510857 - protein, 10 aa, Influenza virus
RNRYLEENPS

SEQ ID NO: 510858 - protein, 10 aa, Influenza virus
RNSFFSRLNW

SEQ ID NO: 510859 - protein, 10 aa, Influenza virus
RNSFYAELKW

SEQ ID NO: 510860 - protein, 10 aa, Influenza virus
RNSIWTSSSS

SEQ ID NO: 510861 - protein, 10 aa, Influenza virus
RNSSDICYPG

SEQ ID NO: 510862 - protein, 10 aa, Influenza virus
RNSSILTDSQ

SEQ ID NO: 510863 - protein, 10 aa, Influenza virus
RNTFGDCPKY

SEQ ID NO: 510864 - protein, 10 aa, Influenza virus
RNTIGDCPKY

SEQ ID NO: 510865 - protein, 10 aa, Influenza virus
RNTIGNCPKY

SEQ ID NO: 510866 - protein, 10 aa, Influenza virus
RNTPSIDPKG

SEQ ID NO: 510867 - protein, 10 aa, Influenza virus
RNTPSIEPKG

SEQ ID NO: 510868 - protein, 10 aa, Influenza virus
RNTPSIEPRG

SEQ ID NO: 510869 - protein, 10 aa, Influenza virus
RNTPSVEPKG

SEQ ID NO: 510870 - protein, 10 aa, Influenza virus
RNTPSVEPRG

SEQ ID NO: 510871 - protein, 10 aa, Influenza virus
RNTRKEPALI

SEQ ID NO: 510872 - protein, 10 aa, Influenza virus
RNVLSIAPIM

SEQ ID NO: 510873 - protein, 10 aa, Influenza virus
RNVLSVAPIM

SEQ ID NO: 510874 - protein, 10 aa, Influenza virus
RNVPEKQTRG

SEQ ID NO: 510875 - protein, 10 aa, Influenza virus
RNVPERQTRG

SEQ ID NO: 510876 - protein, 10 aa, Influenza virus
RNVPETQTRG

SEQ ID NO: 510877 - protein, 10 aa, Influenza virus
RNVPQAQDRG

SEQ ID NO: 510878 - protein, 10 aa, Influenza virus
RNVPQAQNRG

SEQ ID NO: 510879 - protein, 10 aa, Influenza virus
RNVPQIEPRG

SEQ ID NO: 510880 - protein, 10 aa, Influenza virus
RNVPQIESRG

SEQ ID NO: 510881 - protein, 10 aa, Influenza virus
RNVPQIQNRG

SEQ ID NO: 510882 - protein, 10 aa, Influenza virus
RNVPQMESRG

SEQ ID NO: 510883 - protein, 10 aa, Influenza virus
RNVPQVQDRG

SEQ ID NO: 510884 - protein, 10 aa, Influenza virus
RNVPQVQNRG

SEQ ID NO: 510885 - protein, 10 aa, Influenza virus
RNVPSIQSRG

SEQ ID NO: 510886 - protein, 10 aa, Influenza virus
RNVTETLYLN

SEQ ID NO: 510887 - protein, 10 aa, Influenza virus
RNVTVTHAKD

SEQ ID NO: 510888 - protein, 10 aa, Influenza virus
RNVTVTHAKN

SEQ ID NO: 510889 - protein, 10 aa, Influenza virus
RNVTVTHAQD

SEQ ID NO: 510890 - protein, 10 aa, Influenza virus
RNVTVTHSVE

SEQ ID NO: 510891 - protein, 10 aa, Influenza virus
RNVTVTHSVN

SEQ ID NO: 510892 - protein, 10 aa, Influenza virus
RNWRQANNGE

SEQ ID NO: 510893 - protein, 10 aa, Influenza virus
RNWSKPQCQI

SEQ ID NO: 510894 - protein, 10 aa, Influenza virus
RPCFWVELIR

SEQ ID NO: 510895 - protein, 10 aa, Influenza virus
RPCFWVELVR

SEQ ID NO: 510896 - protein, 10 aa, Influenza virus
RPDSSWLFGG

SEQ ID NO: 510897 - protein, 10 aa, Influenza virus
RPEEAKYVEW

SEQ ID NO: 510898 - protein, 10 aa, Influenza virus
RPEEAKYVWW

SEQ ID NO: 510899 - protein, 10 aa, Influenza virus
RPEEVKYVWW

SEQ ID NO: 510900 - protein, 10 aa, Influenza virus
RPFQNVNKIT

SEQ ID NO: 510901 - protein, 10 aa, Influenza virus
RPFVRGQQGR

SEQ ID NO: 510902 - protein, 10 aa, Influenza virus
RPGDNITFSH

SEQ ID NO: 510903 - protein, 10 aa, Influenza virus
RPGETLNVES

SEQ ID NO: 510904 - protein, 10 aa, Influenza virus
RPGQTLRVRS

SEQ ID NO: 510905 - protein, 10 aa, Influenza virus
RPGSSFYAEM

SEQ ID NO: 510906 - protein, 10 aa, Influenza virus
RPGYNGQKSW

SEQ ID NO: 510907 - protein, 10 aa, Influenza virus
RPGYNGQRSW

SEQ ID NO: 510908 - protein, 10 aa, Influenza virus
RPHPEDLNGM

SEQ ID NO: 510909 - protein, 10 aa, Influenza virus
RPIGISSMVE

SEQ ID NO: 510910 - protein, 10 aa, Influenza virus
RPILSPLTKG

SEQ ID NO: 510911 - protein, 10 aa, Influenza virus
RPITEINTWA

SEQ ID NO: 510912 - protein, 10 aa, Influenza virus
RPKEDEVWWT

SEQ ID NO: 510913 - protein, 10 aa, Influenza virus
RPKEDKVWWT

SEQ ID NO: 510914 - protein, 10 aa, Influenza virus
RPKEDRVWWT

SEQ ID NO: 510915 - protein, 10 aa, Influenza virus
RPKEEKVWWT

SEQ ID NO: 510916 - protein, 10 aa, Influenza virus
RPKEIEGICY

SEQ ID NO: 510917 - protein, 10 aa, Influenza virus
RPKEMEGICY

SEQ ID NO: 510918 - protein, 10 aa, Influenza virus
RPKEMEGVCY

SEQ ID NO: 510919 - protein, 10 aa, Influenza virus
RPKENPAHKS

SEQ ID NO: 510920 - protein, 10 aa, Influenza virus
RPKVNGQAGR

SEQ ID NO: 510921 - protein, 10 aa, Influenza virus
RPKVNGQSGR

SEQ ID NO: 510922 - protein, 10 aa, Influenza virus
RPLILKDCSI

SEQ ID NO: 510923 - protein, 10 aa, Influenza virus
RPLILKDCSV

SEQ ID NO: 510924 - protein, 10 aa, Influenza virus
RPLILRDCSV

SEQ ID NO: 510925 - protein, 10 aa, Influenza virus
RPLIRGQQGR

SEQ ID NO: 510926 - protein, 10 aa, Influenza virus
RPLVMGQQGR

SEQ ID NO: 510927 - protein, 10 aa, Influenza virus
RPLVNGQSGR

SEQ ID NO: 510928 - protein, 10 aa, Influenza virus
RPLVREQQGR

SEQ ID NO: 510929 - protein, 10 aa, Influenza virus
RPLVRGQQGR

SEQ ID NO: 510930 - protein, 10 aa, Influenza virus
RPLVRGQQGT

SEQ ID NO: 510931 - protein, 10 aa, Influenza virus
RPLVRGQQGW

SEQ ID NO: 510932 - protein, 10 aa, Influenza virus
RPLVRGQSGR

SEQ ID NO: 510933 - protein, 10 aa, Influenza virus
RPLVRSQSGR

SEQ ID NO: 510934 - protein, 10 aa, Influenza virus
RPNENPAHKS

SEQ ID NO: 510935 - protein, 10 aa, Influenza virus
RPNENPVHKS

SEQ ID NO: 510936 - protein, 10 aa, Influenza virus
RPNIGPRPLI

SEQ ID NO: 510937 - protein, 10 aa, Influenza virus
RPNIGPRPLV

SEQ ID NO: 510938 - protein, 10 aa, Influenza virus
RPPVNGQSGR

SEQ ID NO: 510939 - protein, 10 aa, Influenza virus
RPQINGQSGR

SEQ ID NO: 510940 - protein, 10 aa, Influenza virus
RPQMNGQSGR

SEQ ID NO: 510941 - protein, 10 aa, Influenza virus
RPQVNGQSGR

SEQ ID NO: 510942 - protein, 10 aa, Influenza virus
RPRRGLFGAI

SEQ ID NO: 510943 - protein, 10 aa, Influenza virus
RPRVRNQSGR

SEQ ID NO: 510944 - protein, 10 aa, Influenza virus
RPRYNGQRSW

SEQ ID NO: 510945 - protein, 10 aa, Influenza virus
RPSAPEGMCY

SEQ ID NO: 510946 - protein, 10 aa, Influenza virus
RPTAVDTCYP

SEQ ID NO: 510947 - protein, 10 aa, Influenza virus
RPTRNGWGCK

SEQ ID NO: 510948 - protein, 10 aa, Influenza virus
RPTTEINTWA

SEQ ID NO: 510949 - protein, 10 aa, Influenza virus
RPVAEINTWA

SEQ ID NO: 510950 - protein, 10 aa, Influenza virus
RPVAKAGFIE

SEQ ID NO: 510951 - protein, 10 aa, Influenza virus
RPVGISSMGE

SEQ ID NO: 510952 - protein, 10 aa, Influenza virus
RPVGISSMME

SEQ ID NO: 510953 - protein, 10 aa, Influenza virus
RPVGISSMVE

SEQ ID NO: 510954 - protein, 10 aa, Influenza virus
RPVTEINTWA

SEQ ID NO: 510955 - protein, 10 aa, Influenza virus
RPWIRFNSDL

SEQ ID NO: 510956 - protein, 10 aa, Influenza virus
RPWIRFNSDP

SEQ ID NO: 510957 - protein, 10 aa, Influenza virus
RPWIRFNSNL

SEQ ID NO: 510958 - protein, 10 aa, Influenza virus
RPWIRINNET

SEQ ID NO: 510959 - protein, 10 aa, Influenza virus
RPWISFDQNL

SEQ ID NO: 510960 - protein, 10 aa, Influenza virus
RPWMRINNET

SEQ ID NO: 510961 - protein, 10 aa, Influenza virus
RPWMRISNET

SEQ ID NO: 510962 - protein, 10 aa, Influenza virus
RPWVRGLSSR

SEQ ID NO: 510963 - protein, 10 aa, Influenza virus
RPWVRGQSGR

SEQ ID NO: 510964 - protein, 10 aa, Influenza virus
RPWVRINNET

SEQ ID NO: 510965 - protein, 10 aa, Influenza virus
RPWVRMNNET

SEQ ID NO: 510966 - protein, 10 aa, Influenza virus
RPWVSFDQNL

SEQ ID NO: 510967 - protein, 10 aa, Influenza virus
RPWVSFNHNL

SEQ ID NO: 510968 - protein, 10 aa, Influenza virus
RPWVSFNQDL

SEQ ID NO: 510969 - protein, 10 aa, Influenza virus
RPWVSFNQNL

SEQ ID NO: 510970 - protein, 10 aa, Influenza virus
RQASPSCLVV

SEQ ID NO: 510971 - protein, 10 aa, Influenza virus
RQCFNPMIAE

SEQ ID NO: 510972 - protein, 10 aa, Influenza virus
RQCFNPMIIE

SEQ ID NO: 510973 - protein, 10 aa, Influenza virus
RQCFNPMIVE

SEQ ID NO: 510974 - protein, 10 aa, Influenza virus
RQCFNPMTVE

SEQ ID NO: 510975 - protein, 10 aa, Influenza virus
RQCFNPMVVE

SEQ ID NO: 510976 - protein, 10 aa, Influenza virus
RQEALQNRIM

SEQ ID NO: 510977 - protein, 10 aa, Influenza virus
RQEIDGIKLK

SEQ ID NO: 510978 - protein, 10 aa, Influenza virus
RQEIEGIKLE

SEQ ID NO: 510979 - protein, 10 aa, Influenza virus
RQEIEGIKLK

SEQ ID NO: 510980 - protein, 10 aa, Influenza virus
RQEIEGIRLK

SEQ ID NO: 510981 - protein, 10 aa, Influenza virus
RQEIEGVKLD

SEQ ID NO: 510982 - protein, 10 aa, Influenza virus
RQEIEGVKLN

SEQ ID NO: 510983 - protein, 10 aa, Influenza virus
RQEIEGVRLD

SEQ ID NO: 510984 - protein, 10 aa, Influenza virus
RQEIGGVKLD

SEQ ID NO: 510985 - protein, 10 aa, Influenza virus
RQEINGIKLK

SEQ ID NO: 510986 - protein, 10 aa, Influenza virus
RQEIVDNKNW

SEQ ID NO: 510987 - protein, 10 aa, Influenza virus
RQEIVDNNNW

SEQ ID NO: 510988 - protein, 10 aa, Influenza virus
RQEIVDNSNW

SEQ ID NO: 510989 - protein, 10 aa, Influenza virus
RQEIVGNDNW

SEQ ID NO: 510990 - protein, 10 aa, Influenza virus
RQEIVSNDNW

SEQ ID NO: 510991 - protein, 10 aa, Influenza virus
RQEKNPALRM

SEQ ID NO: 510992 - protein, 10 aa, Influenza virus
RQEKNPSLRM

SEQ ID NO: 510993 - protein, 10 aa, Influenza virus
RQEVEGVKLD

SEQ ID NO: 510994 - protein, 10 aa, Influenza virus
RQGNNVWAGR

SEQ ID NO: 510995 - protein, 10 aa, Influenza virus
RQGNSVWAGR

SEQ ID NO: 510996 - protein, 10 aa, Influenza virus
RQGTSVWAGR

SEQ ID NO: 510997 - protein, 10 aa, Influenza virus
RQIGNVINWT

SEQ ID NO: 510998 - protein, 10 aa, Influenza virus
RQIIRESGGI

SEQ ID NO: 510999 - protein, 10 aa, Influenza virus
RQIIVDNNNW

SEQ ID NO: 511000 - protein, 10 aa, Influenza virus
RQILRESGGI

SEQ ID NO: 511001 - protein, 10 aa, Influenza virus
RQILRGSGGI

SEQ ID NO: 511002 - protein, 10 aa, Influenza virus
RQILRGSGGV

SEQ ID NO: 511003 - protein, 10 aa, Influenza virus
RQILRKSGGI

SEQ ID NO: 511004 - protein, 10 aa, Influenza virus
RQILRRSGGI

SEQ ID NO: 511005 - protein, 10 aa, Influenza virus
RQILRTQESS

SEQ ID NO: 511006 - protein, 10 aa, Influenza virus
RQKIMESGGI

SEQ ID NO: 511007 - protein, 10 aa, Influenza virus
RQKIMESGGV

SEQ ID NO: 511008 - protein, 10 aa, Influenza virus
RQKIMKSGGI

SEQ ID NO: 511009 - protein, 10 aa, Influenza virus
RQKINGVKLE

SEQ ID NO: 511010 - protein, 10 aa, Influenza virus
RQKISGVKLE

SEQ ID NO: 511011 - protein, 10 aa, Influenza virus
RQKRGLFGAI

SEQ ID NO: 511012 - protein, 10 aa, Influenza virus
RQKSLIWLWL

SEQ ID NO: 511013 - protein, 10 aa, Influenza virus
RQKVNGVKLE

SEQ ID NO: 511014 - protein, 10 aa, Influenza virus
RQKWWVWLWL

SEQ ID NO: 511015 - protein, 10 aa, Influenza virus
RQLRENAEDI

SEQ ID NO: 511016 - protein, 10 aa, Influenza virus
RQLRENAEDK

SEQ ID NO: 511017 - protein, 10 aa, Influenza virus
RQLRENAEDM

SEQ ID NO: 511018 - protein, 10 aa, Influenza virus
RQLRENAEDQ

SEQ ID NO: 511019 - protein, 10 aa, Influenza virus
RQLRENAEDR

SEQ ID NO: 511020 - protein, 10 aa, Influenza virus
RQLRENAEED

SEQ ID NO: 511021 - protein, 10 aa, Influenza virus
RQNAEEDGKG

SEQ ID NO: 511022 - protein, 10 aa, Influenza virus
RQNAEEDGRG

SEQ ID NO: 511023 - protein, 10 aa, Influenza virus
RQNPTEEQAV

SEQ ID NO: 511024 - protein, 10 aa, Influenza virus
RQRINGVKLE

SEQ ID NO: 511025 - protein, 10 aa, Influenza virus
RQSERGEDTI

SEQ ID NO: 511026 - protein, 10 aa, Influenza virus
RQSERGEETI

SEQ ID NO: 511027 - protein, 10 aa, Influenza virus
RQSERGEETV

SEQ ID NO: 511028 - protein, 10 aa, Influenza virus
RQSFSPSPGA

SEQ ID NO: 511029 - protein, 10 aa, Influenza virus
RQTFDWTLNR

SEQ ID NO: 511030 - protein, 10 aa, Influenza virus
RQTRGIFGAI

SEQ ID NO: 511031 - protein, 10 aa, Influenza virus
RQTRGLFGAI

SEQ ID NO: 511032 - protein, 10 aa, Influenza virus
RQTYDWTLNR

SEQ ID NO: 511033 - protein, 10 aa, Influenza virus
RQVCIAWSSS

SEQ ID NO: 511034 - protein, 10 aa, Influenza virus
RQVCMAWSSS

SEQ ID NO: 511035 - protein, 10 aa, Influenza virus
RQVCVAWSSS

SEQ ID NO: 511036 - protein, 10 aa, Influenza virus
RQVIVDNNNR

SEQ ID NO: 511037 - protein, 10 aa, Influenza virus
RQVIVDNNNW

SEQ ID NO: 511038 - protein, 10 aa, Influenza virus
RQVIVDNNSW

SEQ ID NO: 511039 - protein, 10 aa, Influenza virus
RQVIVDNSNW

SEQ ID NO: 511040 - protein, 10 aa, Influenza virus
RQVLRESGGI

SEQ ID NO: 511041 - protein, 10 aa, Influenza virus
RQVLRRSGGI

SEQ ID NO: 511042 - protein, 10 aa, Influenza virus
RRAAVSADPL

SEQ ID NO: 511043 - protein, 10 aa, Influenza virus
RRAEIIKMES

SEQ ID NO: 511044 - protein, 10 aa, Influenza virus
RRAIATPGMQ

SEQ ID NO: 511045 - protein, 10 aa, Influenza virus
RRAIVSADPL

SEQ ID NO: 511046 - protein, 10 aa, Influenza virus
RRATVSADPL

SEQ ID NO: 511047 - protein, 10 aa, Influenza virus
RRCLLQSLQQ

SEQ ID NO: 511048 - protein, 10 aa, Influenza virus
RRDILRTQES

SEQ ID NO: 511049 - protein, 10 aa, Influenza virus
RRDQKALKGR

SEQ ID NO: 511050 - protein, 10 aa, Influenza virus
RRDQKSLKGR

SEQ ID NO: 511051 - protein, 10 aa, Influenza virus
RRDQKSLRGR

SEQ ID NO: 511052 - protein, 10 aa, Influenza virus
RRDQMAHCRM

SEQ ID NO: 511053 - protein, 10 aa, Influenza virus
RRDQRALKGR

SEQ ID NO: 511054 - protein, 10 aa, Influenza virus
RRDQRSLRGR

SEQ ID NO: 511055 - protein, 10 aa, Influenza virus
RRDYFTAEVS

SEQ ID NO: 511056 - protein, 10 aa, Influenza virus
RREIHIYYLE

SEQ ID NO: 511057 - protein, 10 aa, Influenza virus
RREVHIYYLE

SEQ ID NO: 511058 - protein, 10 aa, Influenza virus
RREVHMYYLE

SEQ ID NO: 511059 - protein, 10 aa, Influenza virus
RREVHTYYLE

SEQ ID NO: 511060 - protein, 10 aa, Influenza virus
RREVHVYYLE

SEQ ID NO: 511061 - protein, 10 aa, Influenza virus
RRFIQNALNG

SEQ ID NO: 511062 - protein, 10 aa, Influenza virus
RRFVQNALNG

SEQ ID NO: 511063 - protein, 10 aa, Influenza virus
RRFVQNALSG

SEQ ID NO: 511064 - protein, 10 aa, Influenza virus
RRGLFGAIAG

SEQ ID NO: 511065 - protein, 10 aa, Influenza virus
RRGQGHLDEK

SEQ ID NO: 511066 - protein, 10 aa, Influenza virus
RRICEKLEQS

SEQ ID NO: 511067 - protein, 10 aa, Influenza virus
RRIDFHWLFL

SEQ ID NO: 511068 - protein, 10 aa, Influenza virus
RRIDFHWLLL

SEQ ID NO: 511069 - protein, 10 aa, Influenza virus
RRIDFNWLLL

SEQ ID NO: 511070 - protein, 10 aa, Influenza virus
RRIENLNKKM

SEQ ID NO: 511071 - protein, 10 aa, Influenza virus
RRIENLNRKM

SEQ ID NO: 511072 - protein, 10 aa, Influenza virus
RRIESLNKKM

SEQ ID NO: 511073 - protein, 10 aa, Influenza virus
RRINMLADRI

SEQ ID NO: 511074 - protein, 10 aa, Influenza virus
RRIWRQANNG

SEQ ID NO: 511075 - protein, 10 aa, Influenza virus
RRIWRQANSG

SEQ ID NO: 511076 - protein, 10 aa, Influenza virus
RRKKRGLFGA

SEQ ID NO: 511077 - protein, 10 aa, Influenza virus
RRKRGLFGAI

SEQ ID NO: 511078 - protein, 10 aa, Influenza virus
RRKRRGLFGA

SEQ ID NO: 511079 - protein, 10 aa, Influenza virus
RRKTNLYGFI

SEQ ID NO: 511080 - protein, 10 aa, Influenza virus
RRLTTTIKPW

SEQ ID NO: 511081 - protein, 10 aa, Influenza virus
RRLTTTIKTW

SEQ ID NO: 511082 - protein, 10 aa, Influenza virus
RRLTTTIRTW

SEQ ID NO: 511083 - protein, 10 aa, Influenza virus
RRLTTTVKTW

SEQ ID NO: 511084 - protein, 10 aa, Influenza virus
RRLTVLGKDA

SEQ ID NO: 511085 - protein, 10 aa, Influenza virus
RRNKYLEEHP

SEQ ID NO: 511086 - protein, 10 aa, Influenza virus
RRNRYLEEHP

SEQ ID NO: 511087 - protein, 10 aa, Influenza virus
RRNSSDICYP

SEQ ID NO: 511088 - protein, 10 aa, Influenza virus
RRNWRQANNG

SEQ ID NO: 511089 - protein, 10 aa, Influenza virus
RRNYFTAEIS

SEQ ID NO: 511090 - protein, 10 aa, Influenza virus
RRNYFTAEVS

SEQ ID NO: 511091 - protein, 10 aa, Influenza virus
RRNYFTTEVS

SEQ ID NO: 511092 - protein, 10 aa, Influenza virus
RRPDSSWLFG

SEQ ID NO: 511093 - protein, 10 aa, Influenza virus
RRPIGISSMV

SEQ ID NO: 511094 - protein, 10 aa, Influenza virus
RRPVAEINTW

SEQ ID NO: 511095 - protein, 10 aa, Influenza virus
RRPVAKAGFI

SEQ ID NO: 511096 - protein, 10 aa, Influenza virus
RRPVGISSMG

SEQ ID NO: 511097 - protein, 10 aa, Influenza virus
RRPVGISSMM

SEQ ID NO: 511098 - protein, 10 aa, Influenza virus
RRPVGISSMV

SEQ ID NO: 511099 - protein, 10 aa, Influenza virus
RRPVTEINTW

SEQ ID NO: 511100 - protein, 10 aa, Influenza virus
RRQILRTQES

SEQ ID NO: 511101 - protein, 10 aa, Influenza virus
RRQKRGLFGA

SEQ ID NO: 511102 - protein, 10 aa, Influenza virus
RRQKSLIWLW

SEQ ID NO: 511103 - protein, 10 aa, Influenza virus
RRQKWWVWLW

SEQ ID NO: 511104 - protein, 10 aa, Influenza virus
RRQLRENAED

SEQ ID NO: 511105 - protein, 10 aa, Influenza virus
RRQLRENAEE

SEQ ID NO: 511106 - protein, 10 aa, Influenza virus
RRRFIQNALN

SEQ ID NO: 511107 - protein, 10 aa, Influenza virus
RRRFVQNALN

SEQ ID NO: 511108 - protein, 10 aa, Influenza virus
RRRFVQNALS

SEQ ID NO: 511109 - protein, 10 aa, Influenza virus
RRRGLFGAIA

SEQ ID NO: 511110 - protein, 10 aa, Influenza virus
RRRKKRGLFG

SEQ ID NO: 511111 - protein, 10 aa, Influenza virus
RRRKRGLFGA

SEQ ID NO: 511112 - protein, 10 aa, Influenza virus
RRRTNLYGFI

SEQ ID NO: 511113 - protein, 10 aa, Influenza virus
RRRVDINPGH

SEQ ID NO: 511114 - protein, 10 aa, Influenza virus
RRRVDMNPGH

SEQ ID NO: 511115 - protein, 10 aa, Influenza virus
RRRVDTNPGH

SEQ ID NO: 511116 - protein, 10 aa, Influenza virus
RRRVDVNPGH

SEQ ID NO: 511117 - protein, 10 aa, Influenza virus
RRSGAAGAAI

SEQ ID NO: 511118 - protein, 10 aa, Influenza virus
RRSGAAGAAV

SEQ ID NO: 511119 - protein, 10 aa, Influenza virus
RRSYFTAEVS

SEQ ID NO: 511120 - protein, 10 aa, Influenza virus
RRTNLYGFII

SEQ ID NO: 511121 - protein, 10 aa, Influenza virus
RRVDINPGHA

SEQ ID NO: 511122 - protein, 10 aa, Influenza virus
RRVDINPGHS

SEQ ID NO: 511123 - protein, 10 aa, Influenza virus
RRVDMNPGHA

SEQ ID NO: 511124 - protein, 10 aa, Influenza virus
RRVDTNPGHA

SEQ ID NO: 511125 - protein, 10 aa, Influenza virus
RRVDVNPGHA

SEQ ID NO: 511126 - protein, 10 aa, Influenza virus
RRVENLNKKM

SEQ ID NO: 511127 - protein, 10 aa, Influenza virus
RRVWRQANNG

SEQ ID NO: 511128 - protein, 10 aa, Influenza virus
RRYELEIGTR

SEQ ID NO: 511129 - protein, 10 aa, Influenza virus
RRYGPALSIN

SEQ ID NO: 511130 - protein, 10 aa, Influenza virus
RRYGPALSIS

SEQ ID NO: 511131 - protein, 10 aa, Influenza virus
RSALILRGAV

SEQ ID NO: 511132 - protein, 10 aa, Influenza virus
RSALILRGSI

SEQ ID NO: 511133 - protein, 10 aa, Influenza virus
RSALILRGSV

SEQ ID NO: 511134 - protein, 10 aa, Influenza virus
RSAYERMCNI

SEQ ID NO: 511135 - protein, 10 aa, Influenza virus
RSDKICIGYH

SEQ ID NO: 511136 - protein, 10 aa, Influenza virus
RSDKICLGHH

SEQ ID NO: 511137 - protein, 10 aa, Influenza virus
RSDQISIVPN

SEQ ID NO: 511138 - protein, 10 aa, Influenza virus
RSEKLVLATG

SEQ ID NO: 511139 - protein, 10 aa, Influenza virus
RSESSFYAEM

SEQ ID NO: 511140 - protein, 10 aa, Influenza virus
RSFKPNIGPR

SEQ ID NO: 511141 - protein, 10 aa, Influenza virus
RSFQPNIGPR

SEQ ID NO: 511142 - protein, 10 aa, Influenza virus
RSFRPNIGPR

SEQ ID NO: 511143 - protein, 10 aa, Influenza virus
RSFSRTELIA

SEQ ID NO: 511144 - protein, 10 aa, Influenza virus
RSFSRTELIP

SEQ ID NO: 511145 - protein, 10 aa, Influenza virus
RSGAAGAAIK

SEQ ID NO: 511146 - protein, 10 aa, Influenza virus
RSGAAGAAVK

SEQ ID NO: 511147 - protein, 10 aa, Influenza virus
RSGFEIIWDP

SEQ ID NO: 511148 - protein, 10 aa, Influenza virus
RSGFEILLIE

SEQ ID NO: 511149 - protein, 10 aa, Influenza virus
RSGFEMIWDA

SEQ ID NO: 511150 - protein, 10 aa, Influenza virus
RSGFEMIWDP

SEQ ID NO: 511151 - protein, 10 aa, Influenza virus
RSGFEMLKIH

SEQ ID NO: 511152 - protein, 10 aa, Influenza virus
RSGFEMLKIP

SEQ ID NO: 511153 - protein, 10 aa, Influenza virus
RSGFEMLKVP

SEQ ID NO: 511154 - protein, 10 aa, Influenza virus
RSGFEMLRIP

SEQ ID NO: 511155 - protein, 10 aa, Influenza virus
RSGFEMVWDA

SEQ ID NO: 511156 - protein, 10 aa, Influenza virus
RSGFEMVWDD

SEQ ID NO: 511157 - protein, 10 aa, Influenza virus
RSGFEMVWDP

SEQ ID NO: 511158 - protein, 10 aa, Influenza virus
RSGFEVLFIE

SEQ ID NO: 511159 - protein, 10 aa, Influenza virus
RSGFEVLLIE

SEQ ID NO: 511160 - protein, 10 aa, Influenza virus
RSGMDPRMCS

SEQ ID NO: 511161 - protein, 10 aa, Influenza virus
RSGPSFYAEM

SEQ ID NO: 511162 - protein, 10 aa, Influenza virus
RSGQNHGICA

SEQ ID NO: 511163 - protein, 10 aa, Influenza virus
RSGSSFYAEL

SEQ ID NO: 511164 - protein, 10 aa, Influenza virus
RSGSSFYAEM

SEQ ID NO: 511165 - protein, 10 aa, Influenza virus
RSGTSKACNA

SEQ ID NO: 511166 - protein, 10 aa, Influenza virus
RSGYEILKVP

SEQ ID NO: 511167 - protein, 10 aa, Influenza virus
RSGYEMLKVP

SEQ ID NO: 511168 - protein, 10 aa, Influenza virus
RSGYETFKVI

SEQ ID NO: 511169 - protein, 10 aa, Influenza virus
RSGYETFRII

SEQ ID NO: 511170 - protein, 10 aa, Influenza virus
RSGYETFRVI

SEQ ID NO: 511171 - protein, 10 aa, Influenza virus
RSGYETFRVL

SEQ ID NO: 511172 - protein, 10 aa, Influenza virus
RSGYETFRVT

SEQ ID NO: 511173 - protein, 10 aa, Influenza virus
RSGYEVLKVP

SEQ ID NO: 511174 - protein, 10 aa, Influenza virus
RSGYSGIFSV

SEQ ID NO: 511175 - protein, 10 aa, Influenza virus
RSGYSGSFID

SEQ ID NO: 511176 - protein, 10 aa, Influenza virus
RSGYSGVFSV

SEQ ID NO: 511177 - protein, 10 aa, Influenza virus
RSGYWAIRTR

SEQ ID NO: 511178 - protein, 10 aa, Influenza virus
RSHEQMETGG

SEQ ID NO: 511179 - protein, 10 aa, Influenza virus
RSHKICIGYH

SEQ ID NO: 511180 - protein, 10 aa, Influenza virus
RSHLRNDTDV

SEQ ID NO: 511181 - protein, 10 aa, Influenza virus
RSICEKLEQS

SEQ ID NO: 511182 - protein, 10 aa, Influenza virus
RSIEEKFEIT

SEQ ID NO: 511183 - protein, 10 aa, Influenza virus
RSIIFNMERI

SEQ ID NO: 511184 - protein, 10 aa, Influenza virus
RSILANNGKF

SEQ ID NO: 511185 - protein, 10 aa, Influenza virus
RSILANNGRF

SEQ ID NO: 511186 - protein, 10 aa, Influenza virus
RSILASSGSL

SEQ ID NO: 511187 - protein, 10 aa, Influenza virus
RSILNTSQRG

SEQ ID NO: 511188 - protein, 10 aa, Influenza virus
RSINWLTKKE

SEQ ID NO: 511189 - protein, 10 aa, Influenza virus
RSINWLTKKK

SEQ ID NO: 511190 - protein, 10 aa, Influenza virus
RSIRWLTLKS

SEQ ID NO: 511191 - protein, 10 aa, Influenza virus
RSIVASSGTL

SEQ ID NO: 511192 - protein, 10 aa, Influenza virus
RSIVASSGTV

SEQ ID NO: 511193 - protein, 10 aa, Influenza virus
RSIVRRATVS

SEQ ID NO: 511194 - protein, 10 aa, Influenza virus
RSKFLLMDAL

SEQ ID NO: 511195 - protein, 10 aa, Influenza virus
RSKFLLMDSL

SEQ ID NO: 511196 - protein, 10 aa, Influenza virus
RSKINEVKLE

SEQ ID NO: 511197 - protein, 10 aa, Influenza virus
RSKINGVILE

SEQ ID NO: 511198 - protein, 10 aa, Influenza virus
RSKINGVKLE

SEQ ID NO: 511199 - protein, 10 aa, Influenza virus
RSKINGVRLE

SEQ ID NO: 511200 - protein, 10 aa, Influenza virus
RSKYWAIRTR

SEQ ID NO: 511201 - protein, 10 aa, Influenza virus
RSLFSSIKKY

SEQ ID NO: 511202 - protein, 10 aa, Influenza virus
RSLFSSIKRY

SEQ ID NO: 511203 - protein, 10 aa, Influenza virus
RSLIASSGTL

SEQ ID NO: 511204 - protein, 10 aa, Influenza virus
RSLIQFPIGT

SEQ ID NO: 511205 - protein, 10 aa, Influenza virus
RSLIQFPMGT

SEQ ID NO: 511206 - protein, 10 aa, Influenza virus
RSLIRFPIGT

SEQ ID NO: 511207 - protein, 10 aa, Influenza virus
RSLIRFPIGV

SEQ ID NO: 511208 - protein, 10 aa, Influenza virus
RSLIRFPVGT

SEQ ID NO: 511209 - protein, 10 aa, Influenza virus
RSLISWPLSS

SEQ ID NO: 511210 - protein, 10 aa, Influenza virus
RSLKLAIGLR

SEQ ID NO: 511211 - protein, 10 aa, Influenza virus
RSLKLATGLR

SEQ ID NO: 511212 - protein, 10 aa, Influenza virus
RSLLLATGMR

SEQ ID NO: 511213 - protein, 10 aa, Influenza virus
RSLMLATGMR

SEQ ID NO: 511214 - protein, 10 aa, Influenza virus
RSLVASSGNL

SEQ ID NO: 511215 - protein, 10 aa, Influenza virus
RSLVASSGTL

SEQ ID NO: 511216 - protein, 10 aa, Influenza virus
RSLWDSFRQS

SEQ ID NO: 511217 - protein, 10 aa, Influenza virus
RSMKWLTLKS

SEQ ID NO: 511218 - protein, 10 aa, Influenza virus
RSMRWLTLKL

SEQ ID NO: 511219 - protein, 10 aa, Influenza virus
RSMRWLTLKS

SEQ ID NO: 511220 - protein, 10 aa, Influenza virus
RSNAPSGIEY

SEQ ID NO: 511221 - protein, 10 aa, Influenza virus
RSNAPSGVEY

SEQ ID NO: 511222 - protein, 10 aa, Influenza virus
RSNENPAHKS

SEQ ID NO: 511223 - protein, 10 aa, Influenza virus
RSNIFNMERI

SEQ ID NO: 511224 - protein, 10 aa, Influenza virus
RSPFRALISW

SEQ ID NO: 511225 - protein, 10 aa, Influenza virus
RSPFRALVSW

SEQ ID NO: 511226 - protein, 10 aa, Influenza virus
RSPFRTLMSC

SEQ ID NO: 511227 - protein, 10 aa, Influenza virus
RSPFRTLMSV

SEQ ID NO: 511228 - protein, 10 aa, Influenza virus
RSPGNAEIED

SEQ ID NO: 511229 - protein, 10 aa, Influenza virus
RSPHRALMSC

SEQ ID NO: 511230 - protein, 10 aa, Influenza virus
RSPHRSLMSC

SEQ ID NO: 511231 - protein, 10 aa, Influenza virus
RSPHRTLLMN

SEQ ID NO: 511232 - protein, 10 aa, Influenza virus
RSPHRTLMSC

SEQ ID NO: 511233 - protein, 10 aa, Influenza virus
RSPQRTLMSC

SEQ ID NO: 511234 - protein, 10 aa, Influenza virus
RSPYRALISW

SEQ ID NO: 511235 - protein, 10 aa, Influenza virus
RSPYRALMSC

SEQ ID NO: 511236 - protein, 10 aa, Influenza virus
RSPYRALMSV

SEQ ID NO: 511237 - protein, 10 aa, Influenza virus
RSPYRTLMSC

SEQ ID NO: 511238 - protein, 10 aa, Influenza virus
RSPYRTLMSV

SEQ ID NO: 511239 - protein, 10 aa, Influenza virus
RSQFRALISW

SEQ ID NO: 511240 - protein, 10 aa, Influenza virus
RSQSGRISFY

SEQ ID NO: 511241 - protein, 10 aa, Influenza virus
RSQYRALISW

SEQ ID NO: 511242 - protein, 10 aa, Influenza virus
RSQYRALVSW

SEQ ID NO: 511243 - protein, 10 aa, Influenza virus
RSQYRSLISW

SEQ ID NO: 511244 - protein, 10 aa, Influenza virus
RSRNGFEMLK

SEQ ID NO: 511245 - protein, 10 aa, Influenza virus
RSRSGFEMLK

SEQ ID NO: 511246 - protein, 10 aa, Influenza virus
RSRSGFEMLR

SEQ ID NO: 511247 - protein, 10 aa, Influenza virus
RSRSSFYAEM

SEQ ID NO: 511248 - protein, 10 aa, Influenza virus
RSRYWAIRTR

SEQ ID NO: 511249 - protein, 10 aa, Influenza virus
RSSCHDGKAW

SEQ ID NO: 511250 - protein, 10 aa, Influenza virus
RSSFYAEMKW

SEQ ID NO: 511251 - protein, 10 aa, Influenza virus
RSSSSFYAEM

SEQ ID NO: 511252 - protein, 10 aa, Influenza virus
RSTIGDCPKY

SEQ ID NO: 511253 - protein, 10 aa, Influenza virus
RSWKKQILRT

SEQ ID NO: 511254 - protein, 10 aa, Influenza virus
RSWMKIYWHL

SEQ ID NO: 511255 - protein, 10 aa, Influenza virus
RSWMKLYWHL

SEQ ID NO: 511256 - protein, 10 aa, Influenza virus
RSWRKKILRT

SEQ ID NO: 511257 - protein, 10 aa, Influenza virus
RSWRKQILRT

SEQ ID NO: 511258 - protein, 10 aa, Influenza virus
RSWRRQILRT

SEQ ID NO: 511259 - protein, 10 aa, Influenza virus
RSWSKPQCQI

SEQ ID NO: 511260 - protein, 10 aa, Influenza virus
RSYEQMETDG

SEQ ID NO: 511261 - protein, 10 aa, Influenza virus
RSYEQMETGE

SEQ ID NO: 511262 - protein, 10 aa, Influenza virus
RSYEQMETGG

SEQ ID NO: 511263 - protein, 10 aa, Influenza virus
RSYEQMETSG

SEQ ID NO: 511264 - protein, 10 aa, Influenza virus
RSYNNTSGEQ

SEQ ID NO: 511265 - protein, 10 aa, Influenza virus
RSYNNTSGKQ

SEQ ID NO: 511266 - protein, 10 aa, Influenza virus
RTAFRGLIST

SEQ ID NO: 511267 - protein, 10 aa, Influenza virus
RTAFRGLMST

SEQ ID NO: 511268 - protein, 10 aa, Influenza virus
RTATREGKHI

SEQ ID NO: 511269 - protein, 10 aa, Influenza virus
RTAYERMCNI

SEQ ID NO: 511270 - protein, 10 aa, Influenza virus
RTCKLLGINM

SEQ ID NO: 511271 - protein, 10 aa, Influenza virus
RTCKLVGINM

SEQ ID NO: 511272 - protein, 10 aa, Influenza virus
RTDGATSACK

SEQ ID NO: 511273 - protein, 10 aa, Influenza virus
RTELINPNKW

SEQ ID NO: 511274 - protein, 10 aa, Influenza virus
RTELINPSKW

SEQ ID NO: 511275 - protein, 10 aa, Influenza virus
RTELIPPSKW

SEQ ID NO: 511276 - protein, 10 aa, Influenza virus
RTELISPNKW

SEQ ID NO: 511277 - protein, 10 aa, Influenza virus
RTELISPSKW

SEQ ID NO: 511278 - protein, 10 aa, Influenza virus
RTESLQNRIQ

SEQ ID NO: 511279 - protein, 10 aa, Influenza virus
RTFFLTHGAL

SEQ ID NO: 511280 - protein, 10 aa, Influenza virus
RTFFLTHGSL

SEQ ID NO: 511281 - protein, 10 aa, Influenza virus
RTFFLTQGAL

SEQ ID NO: 511282 - protein, 10 aa, Influenza virus
RTFFLTQGSL

SEQ ID NO: 511283 - protein, 10 aa, Influenza virus
RTFLAMITYI

SEQ ID NO: 511284 - protein, 10 aa, Influenza virus
RTFQNIDKNA

SEQ ID NO: 511285 - protein, 10 aa, Influenza virus
RTFQNIDRNA

SEQ ID NO: 511286 - protein, 10 aa, Influenza virus
RTFQNVSPLW

SEQ ID NO: 511287 - protein, 10 aa, Influenza virus
RTFSFQLILI

SEQ ID NO: 511288 - protein, 10 aa, Influenza virus
RTFSFQLILL

SEQ ID NO: 511289 - protein, 10 aa, Influenza virus
RTFSFQLINN

SEQ ID NO: 511290 - protein, 10 aa, Influenza virus
RTFSPRSRSG

SEQ ID NO: 511291 - protein, 10 aa, Influenza virus
RTGMDPRMCS

SEQ ID NO: 511292 - protein, 10 aa, Influenza virus
RTGSLQNRIQ

SEQ ID NO: 511293 - protein, 10 aa, Influenza virus
RTGTFEFTSF

SEQ ID NO: 511294 - protein, 10 aa, Influenza virus
RTHESECVCI

SEQ ID NO: 511295 - protein, 10 aa, Influenza virus
RTHQYSEKGK

SEQ ID NO: 511296 - protein, 10 aa, Influenza virus
RTHQYSEKGR

SEQ ID NO: 511297 - protein, 10 aa, Influenza virus
RTHQYSERGK

SEQ ID NO: 511298 - protein, 10 aa, Influenza virus
RTHQYSERGR

SEQ ID NO: 511299 - protein, 10 aa, Influenza virus
RTINTASRSG

SEQ ID NO: 511300 - protein, 10 aa, Influenza virus
RTIQNEDIPI

SEQ ID NO: 511301 - protein, 10 aa, Influenza virus
RTISIASRSG

SEQ ID NO: 511302 - protein, 10 aa, Influenza virus
RTISKDLRSG

SEQ ID NO: 511303 - protein, 10 aa, Influenza virus
RTISKDSRSG

SEQ ID NO: 511304 - protein, 10 aa, Influenza virus
RTISKDTRSG

SEQ ID NO: 511305 - protein, 10 aa, Influenza virus
RTISMDSRSG

SEQ ID NO: 511306 - protein, 10 aa, Influenza virus
RTISPKLRSG

SEQ ID NO: 511307 - protein, 10 aa, Influenza virus
RTISPRLRSG

SEQ ID NO: 511308 - protein, 10 aa, Influenza virus
RTISPRSRNG

SEQ ID NO: 511309 - protein, 10 aa, Influenza virus
RTISPRSRSG

SEQ ID NO: 511310 - protein, 10 aa, Influenza virus
RTISRDSRSG

SEQ ID NO: 511311 - protein, 10 aa, Influenza virus
RTISTASRAG

SEQ ID NO: 511312 - protein, 10 aa, Influenza virus
RTISTASRSG

SEQ ID NO: 511313 - protein, 10 aa, Influenza virus
RTISTASRYG

SEQ ID NO: 511314 - protein, 10 aa, Influenza virus
RTIWTSGSSI

SEQ ID NO: 511315 - protein, 10 aa, Influenza virus
RTKEGRRKTN

SEQ ID NO: 511316 - protein, 10 aa, Influenza virus
RTKEGRRRTN

SEQ ID NO: 511317 - protein, 10 aa, Influenza virus
RTKEMEGICY

SEQ ID NO: 511318 - protein, 10 aa, Influenza virus
RTKNLESRSG

SEQ ID NO: 511319 - protein, 10 aa, Influenza virus
RTKSGGNTNQ

SEQ ID NO: 511320 - protein, 10 aa, Influenza virus
RTKSLESRSG

SEQ ID NO: 511321 - protein, 10 aa, Influenza virus
RTLDFHDFNV

SEQ ID NO: 511322 - protein, 10 aa, Influenza virus
RTLDFHDLNV

SEQ ID NO: 511323 - protein, 10 aa, Influenza virus
RTLDFHDSNV

SEQ ID NO: 511324 - protein, 10 aa, Influenza virus
RTLDLHDANV

SEQ ID NO: 511325 - protein, 10 aa, Influenza virus
RTLDLHDSNV

SEQ ID NO: 511326 - protein, 10 aa, Influenza virus
RTLDMHDANV

SEQ ID NO: 511327 - protein, 10 aa, Influenza virus
RTLDQHDANV

SEQ ID NO: 511328 - protein, 10 aa, Influenza virus
RTLDYHDSNV

SEQ ID NO: 511329 - protein, 10 aa, Influenza virus
RTLEFHDSNV

SEQ ID NO: 511330 - protein, 10 aa, Influenza virus
RTLFQQMRDI

SEQ ID NO: 511331 - protein, 10 aa, Influenza virus
RTLFQQMRDV

SEQ ID NO: 511332 - protein, 10 aa, Influenza virus
RTLGFHDSNV

SEQ ID NO: 511333 - protein, 10 aa, Influenza virus
RTLGLHDANV

SEQ ID NO: 511334 - protein, 10 aa, Influenza virus
RTLISWEMGQ

SEQ ID NO: 511335 - protein, 10 aa, Influenza virus
RTLLAKSVFN

SEQ ID NO: 511336 - protein, 10 aa, Influenza virus
RTLLMNELGI

SEQ ID NO: 511337 - protein, 10 aa, Influenza virus
RTLLMNELGV

SEQ ID NO: 511338 - protein, 10 aa, Influenza virus
RTLLMSELGV

SEQ ID NO: 511339 - protein, 10 aa, Influenza virus
RTLMSCPIGE

SEQ ID NO: 511340 - protein, 10 aa, Influenza virus
RTLMSCPIGV

SEQ ID NO: 511341 - protein, 10 aa, Influenza virus
RTLMSCPMGV

SEQ ID NO: 511342 - protein, 10 aa, Influenza virus
RTLMSCPVGE

SEQ ID NO: 511343 - protein, 10 aa, Influenza virus
RTLMSCPVGV

SEQ ID NO: 511344 - protein, 10 aa, Influenza virus
RTLMSVEIGQ

SEQ ID NO: 511345 - protein, 10 aa, Influenza virus
RTLMSVEVGQ

SEQ ID NO: 511346 - protein, 10 aa, Influenza virus
RTLMSVGIGQ

SEQ ID NO: 511347 - protein, 10 aa, Influenza virus
RTLMSVKIGQ

SEQ ID NO: 511348 - protein, 10 aa, Influenza virus
RTLMSVKVGQ

SEQ ID NO: 511349 - protein, 10 aa, Influenza virus
RTLTLNTMTK

SEQ ID NO: 511350 - protein, 10 aa, Influenza virus
RTLYFHDSNV

SEQ ID NO: 511351 - protein, 10 aa, Influenza virus
RTNEKFHQIE

SEQ ID NO: 511352 - protein, 10 aa, Influenza virus
RTNEKYHQIE

SEQ ID NO: 511353 - protein, 10 aa, Influenza virus
RTNGNLIAPE

SEQ ID NO: 511354 - protein, 10 aa, Influenza virus
RTNGTSKIKM

SEQ ID NO: 511355 - protein, 10 aa, Influenza virus
RTNGTSKVKM

SEQ ID NO: 511356 - protein, 10 aa, Influenza virus
RTNHQFELID

SEQ ID NO: 511357 - protein, 10 aa, Influenza virus
RTNLYGFIIK

SEQ ID NO: 511358 - protein, 10 aa, Influenza virus
RTNQQFELID

SEQ ID NO: 511359 - protein, 10 aa, Influenza virus
RTPHRTLLMN

SEQ ID NO: 511360 - protein, 10 aa, Influenza virus
RTPIAFLTSS

SEQ ID NO: 511361 - protein, 10 aa, Influenza virus
RTPYRSLIKF

SEQ ID NO: 511362 - protein, 10 aa, Influenza virus
RTPYRSLIQF

SEQ ID NO: 511363 - protein, 10 aa, Influenza virus
RTPYRSLIRF

SEQ ID NO: 511364 - protein, 10 aa, Influenza virus
RTPYRTLLMN

SEQ ID NO: 511365 - protein, 10 aa, Influenza virus
RTQDSECVSH

SEQ ID NO: 511366 - protein, 10 aa, Influenza virus
RTQESECACI

SEQ ID NO: 511367 - protein, 10 aa, Influenza virus
RTQESECACV

SEQ ID NO: 511368 - protein, 10 aa, Influenza virus
RTQESECICI

SEQ ID NO: 511369 - protein, 10 aa, Influenza virus
RTQESECLCI

SEQ ID NO: 511370 - protein, 10 aa, Influenza virus
RTQESECQCI

SEQ ID NO: 511371 - protein, 10 aa, Influenza virus
RTQESECQCL

SEQ ID NO: 511372 - protein, 10 aa, Influenza virus
RTQESECQRI

SEQ ID NO: 511373 - protein, 10 aa, Influenza virus
RTQESECVCH

SEQ ID NO: 511374 - protein, 10 aa, Influenza virus
RTQESECVCI

SEQ ID NO: 511375 - protein, 10 aa, Influenza virus
RTQESECVCM

SEQ ID NO: 511376 - protein, 10 aa, Influenza virus
RTQESECVCQ

SEQ ID NO: 511377 - protein, 10 aa, Influenza virus
RTQESECVCV

SEQ ID NO: 511378 - protein, 10 aa, Influenza virus
RTQESECVRH

SEQ ID NO: 511379 - protein, 10 aa, Influenza virus
RTQESSCTCI

SEQ ID NO: 511380 - protein, 10 aa, Influenza virus
RTQESSCVCI

SEQ ID NO: 511381 - protein, 10 aa, Influenza virus
RTQESSCVCM

SEQ ID NO: 511382 - protein, 10 aa, Influenza virus
RTQESSCVCV

SEQ ID NO: 511383 - protein, 10 aa, Influenza virus
RTRALVRSGM

SEQ ID NO: 511384 - protein, 10 aa, Influenza virus
RTRALVRTGM

SEQ ID NO: 511385 - protein, 10 aa, Influenza virus
RTREGRRKTN

SEQ ID NO: 511386 - protein, 10 aa, Influenza virus
RTREILTKIT

SEQ ID NO: 511387 - protein, 10 aa, Influenza virus
RTREILTKTT

SEQ ID NO: 511388 - protein, 10 aa, Influenza virus
RTREILTRTT

SEQ ID NO: 511389 - protein, 10 aa, Influenza virus
RTRGILTKTT

SEQ ID NO: 511390 - protein, 10 aa, Influenza virus
RTRGLFGAIA

SEQ ID NO: 511391 - protein, 10 aa, Influenza virus
RTRSGGNNNQ

SEQ ID NO: 511392 - protein, 10 aa, Influenza virus
RTRSGGNTNH

SEQ ID NO: 511393 - protein, 10 aa, Influenza virus
RTRSGGNTNQ

SEQ ID NO: 511394 - protein, 10 aa, Influenza virus
RTRSGGNTSQ

SEQ ID NO: 511395 - protein, 10 aa, Influenza virus
RTSDMRAEII

SEQ ID NO: 511396 - protein, 10 aa, Influenza virus
RTSDMRTEII

SEQ ID NO: 511397 - protein, 10 aa, Influenza virus
RTSDMRTEVI

SEQ ID NO: 511398 - protein, 10 aa, Influenza virus
RTSHRTLLMN

SEQ ID NO: 511399 - protein, 10 aa, Influenza virus
RTSISCLYKL

SEQ ID NO: 511400 - protein, 10 aa, Influenza virus
RTSIWTSSSS

SEQ ID NO: 511401 - protein, 10 aa, Influenza virus
RTSYRSLIRF

SEQ ID NO: 511402 - protein, 10 aa, Influenza virus
RTTFESNGGL

SEQ ID NO: 511403 - protein, 10 aa, Influenza virus
RTTFRGLIST

SEQ ID NO: 511404 - protein, 10 aa, Influenza virus
RTTFRGLLST

SEQ ID NO: 511405 - protein, 10 aa, Influenza virus
RTTNTYRNTD

SEQ ID NO: 511406 - protein, 10 aa, Influenza virus
RTTSKDSRSG

SEQ ID NO: 511407 - protein, 10 aa, Influenza virus
RTTVDHMAII

SEQ ID NO: 511408 - protein, 10 aa, Influenza virus
RTVGQCPKYV

SEQ ID NO: 511409 - protein, 10 aa, Influenza virus
RTVSSFYSEM

SEQ ID NO: 511410 - protein, 10 aa, Influenza virus
RTWAKNILRT

SEQ ID NO: 511411 - protein, 10 aa, Influenza virus
RTYNNTTGRD

SEQ ID NO: 511412 - protein, 10 aa, Influenza virus
RTYVDGFEPN

SEQ ID NO: 511413 - protein, 10 aa, Influenza virus
RTYVDGFKPN

SEQ ID NO: 511414 - protein, 10 aa, Influenza virus
RVARCNTKCQ

SEQ ID NO: 511415 - protein, 10 aa, Influenza virus
RVAYERMCNI

SEQ ID NO: 511416 - protein, 10 aa, Influenza virus
RVDDAVTDIW

SEQ ID NO: 511417 - protein, 10 aa, Influenza virus
RVDDAVTDVW

SEQ ID NO: 511418 - protein, 10 aa, Influenza virus
RVDINPGHAD

SEQ ID NO: 511419 - protein, 10 aa, Influenza virus
RVDINPGHSD

SEQ ID NO: 511420 - protein, 10 aa, Influenza virus
RVDKLTQGRQ

SEQ ID NO: 511421 - protein, 10 aa, Influenza virus
RVDMNPGHAD

SEQ ID NO: 511422 - protein, 10 aa, Influenza virus
RVDNHSMSDI

SEQ ID NO: 511423 - protein, 10 aa, Influenza virus
RVDRLTQGRQ

SEQ ID NO: 511424 - protein, 10 aa, Influenza virus
RVDTIIESNV

SEQ ID NO: 511425 - protein, 10 aa, Influenza virus
RVDTIMEKNV

SEQ ID NO: 511426 - protein, 10 aa, Influenza virus
RVDTNPGHAD

SEQ ID NO: 511427 - protein, 10 aa, Influenza virus
RVDVNPGHAD

SEQ ID NO: 511428 - protein, 10 aa, Influenza virus
RVECIGWSST

SEQ ID NO: 511429 - protein, 10 aa, Influenza virus
RVFLAMITYI

SEQ ID NO: 511430 - protein, 10 aa, Influenza virus
RVFLTMITYI

SEQ ID NO: 511431 - protein, 10 aa, Influenza virus
RVGCVILLNP

SEQ ID NO: 511432 - protein, 10 aa, Influenza virus
RVGSRGHVFV

SEQ ID NO: 511433 - protein, 10 aa, Influenza virus
RVKKQLRENA

SEQ ID NO: 511434 - protein, 10 aa, Influenza virus
RVKMFDFIKW

SEQ ID NO: 511435 - protein, 10 aa, Influenza virus
RVKMFDFSKW

SEQ ID NO: 511436 - protein, 10 aa, Influenza virus
RVKMFDFTKW

SEQ ID NO: 511437 - protein, 10 aa, Influenza virus
RVKRQLRENA

SEQ ID NO: 511438 - protein, 10 aa, Influenza virus
RVKRRPVAKA

SEQ ID NO: 511439 - protein, 10 aa, Influenza virus
RVRHQLRENA

SEQ ID NO: 511440 - protein, 10 aa, Influenza virus
RVRKQLRENA

SEQ ID NO: 511441 - protein, 10 aa, Influenza virus
RVRKQLRQNA

SEQ ID NO: 511442 - protein, 10 aa, Influenza virus
RVRLFDYSRW

SEQ ID NO: 511443 - protein, 10 aa, Influenza virus
RVRLQLRDNA

SEQ ID NO: 511444 - protein, 10 aa, Influenza virus
RVRMQLRDNA

SEQ ID NO: 511445 - protein, 10 aa, Influenza virus
RVRNGTYDHK

SEQ ID NO: 511446 - protein, 10 aa, Influenza virus
RVRNQSGRIS

SEQ ID NO: 511447 - protein, 10 aa, Influenza virus
RVRRQLRENA

SEQ ID NO: 511448 - protein, 10 aa, Influenza virus
RVSFYWTIVE

SEQ ID NO: 511449 - protein, 10 aa, Influenza virus
RVSKMGVDEY

SEQ ID NO: 511450 - protein, 10 aa, Influenza virus
RVSKTGVDEY

SEQ ID NO: 511451 - protein, 10 aa, Influenza virus
RVSKVGVDEY

SEQ ID NO: 511452 - protein, 10 aa, Influenza virus
RVSRMGVDEY

SEQ ID NO: 511453 - protein, 10 aa, Influenza virus
RVTCVCRDNW

SEQ ID NO: 511454 - protein, 10 aa, Influenza virus
RVTDSIKSWR

SEQ ID NO: 511455 - protein, 10 aa, Influenza virus
RVTVSTRSDQ

SEQ ID NO: 511456 - protein, 10 aa, Influenza virus
RVWRQANNGE

SEQ ID NO: 511457 - protein, 10 aa, Influenza virus
RVWWTSNSIA

SEQ ID NO: 511458 - protein, 10 aa, Influenza virus
RVWWTSNSII

SEQ ID NO: 511459 - protein, 10 aa, Influenza virus
RVWWTSNSIV

SEQ ID NO: 511460 - protein, 10 aa, Influenza virus
RVWWTTNSIV

SEQ ID NO: 511461 - protein, 10 aa, Influenza virus
RVYVDGFEPN

SEQ ID NO: 511462 - protein, 10 aa, Influenza virus
RWALGENMAP

SEQ ID NO: 511463 - protein, 10 aa, Influenza virus
RWETTGRNCT

SEQ ID NO: 511464 - protein, 10 aa, Influenza virus
RWKHVTNTIL

SEQ ID NO: 511465 - protein, 10 aa, Influenza virus
RWLTLKLGQF

SEQ ID NO: 511466 - protein, 10 aa, Influenza virus
RWLTLKSEQF

SEQ ID NO: 511467 - protein, 10 aa, Influenza virus
RWLTLKSGQF

SEQ ID NO: 511468 - protein, 10 aa, Influenza virus
RWMKIIRVGC

SEQ ID NO: 511469 - protein, 10 aa, Influenza virus
RWPGLVAGWY

SEQ ID NO: 511470 - protein, 10 aa, Influenza virus
RYELEIGARI

SEQ ID NO: 511471 - protein, 10 aa, Influenza virus
RYELEIGTRI

SEQ ID NO: 511472 - protein, 10 aa, Influenza virus
RYERVKMFDF

SEQ ID NO: 511473 - protein, 10 aa, Influenza virus
RYGDGVWIGR

SEQ ID NO: 511474 - protein, 10 aa, Influenza virus
RYGFVANFSM

SEQ ID NO: 511475 - protein, 10 aa, Influenza virus
RYGNGVWIGR

SEQ ID NO: 511476 - protein, 10 aa, Influenza virus
RYGPALSINE

SEQ ID NO: 511477 - protein, 10 aa, Influenza virus
RYGPALSISE

SEQ ID NO: 511478 - protein, 10 aa, Influenza virus
RYGVKGFSFR

SEQ ID NO: 511479 - protein, 10 aa, Influenza virus
RYGYIIEEYG

SEQ ID NO: 511480 - protein, 10 aa, Influenza virus
RYGYIIEKYG

SEQ ID NO: 511481 - protein, 10 aa, Influenza virus
RYICSGLVGD

SEQ ID NO: 511482 - protein, 10 aa, Influenza virus
RYIPSGSLKL

SEQ ID NO: 511483 - protein, 10 aa, Influenza virus
RYLEEHPSAG

SEQ ID NO: 511484 - protein, 10 aa, Influenza virus
RYLEENPSAG

SEQ ID NO: 511485 - protein, 10 aa, Influenza virus
RYLPDLYDYK

SEQ ID NO: 511486 - protein, 10 aa, Influenza virus
RYNGQRSWMK

SEQ ID NO: 511487 - protein, 10 aa, Influenza virus
RYPDVRCVCR

SEQ ID NO: 511488 - protein, 10 aa, Influenza virus
RYPNVRCVCR

SEQ ID NO: 511489 - protein, 10 aa, Influenza virus
RYREEAMQNR

SEQ ID NO: 511490 - protein, 10 aa, Influenza virus
RYSGFVRTLF

SEQ ID NO: 511491 - protein, 10 aa, Influenza virus
RYSGIKTDGA

SEQ ID NO: 511492 - protein, 10 aa, Influenza virus
RYSGIRTDGA

SEQ ID NO: 511493 - protein, 10 aa, Influenza virus
RYSIADKICI

SEQ ID NO: 511494 - protein, 10 aa, Influenza virus
RYSKADKICI

SEQ ID NO: 511495 - protein, 10 aa, Influenza virus
RYSRADKICI

SEQ ID NO: 511496 - protein, 10 aa, Influenza virus
RYTYRCHKGD

SEQ ID NO: 511497 - protein, 10 aa, Influenza virus
RYTYRCHRGD

SEQ ID NO: 511498 - protein, 10 aa, Influenza virus
RYVCSGLVGD

SEQ ID NO: 511499 - protein, 10 aa, Influenza virus
RYVCSKFHSD

SEQ ID NO: 511500 - protein, 10 aa, Influenza virus
RYVCTGILTD

SEQ ID NO: 511501 - protein, 10 aa, Influenza virus
RYVEDTKIDL

SEQ ID NO: 511502 - protein, 10 aa, Influenza virus
RYVKQGSLKL

SEQ ID NO: 511503 - protein, 10 aa, Influenza virus
RYVKQSSLPL

SEQ ID NO: 511504 - protein, 10 aa, Influenza virus
RYWAIRTRSG

SEQ ID NO: 511505 - protein, 10 aa, Influenza virus
RYYMGECPKY

SEQ ID NO: 511506 - protein, 10 aa, Influenza virus
SAAFEDLRIS

SEQ ID NO: 511507 - protein, 10 aa, Influenza virus
SAAFEDLRLL

SEQ ID NO: 511508 - protein, 10 aa, Influenza virus
SAAFEDLRVL

SEQ ID NO: 511509 - protein, 10 aa, Influenza virus
SAAFEDLRVS

SEQ ID NO: 511510 - protein, 10 aa, Influenza virus
SAASYKRIRL

SEQ ID NO: 511511 - protein, 10 aa, Influenza virus
SAASYKRVRL

SEQ ID NO: 511512 - protein, 10 aa, Influenza virus
SACHDGASWL

SEQ ID NO: 511513 - protein, 10 aa, Influenza virus
SACHDGISWL

SEQ ID NO: 511514 - protein, 10 aa, Influenza virus
SACHDGSSWL

SEQ ID NO: 511515 - protein, 10 aa, Influenza virus
SACHDGTNWL

SEQ ID NO: 511516 - protein, 10 aa, Influenza virus
SACHDGTSWL

SEQ ID NO: 511517 - protein, 10 aa, Influenza virus
SACITPNGSI

SEQ ID NO: 511518 - protein, 10 aa, Influenza virus
SACKRTVSSF

SEQ ID NO: 511519 - protein, 10 aa, Influenza virus
SACLRGGRNS

SEQ ID NO: 511520 - protein, 10 aa, Influenza virus
SACYNPCFYV

SEQ ID NO: 511521 - protein, 10 aa, Influenza virus
SADHRIYWIR

SEQ ID NO: 511522 - protein, 10 aa, Influenza virus
SADHRVYWIR

SEQ ID NO: 511523 - protein, 10 aa, Influenza virus
SADMSIGITV

SEQ ID NO: 511524 - protein, 10 aa, Influenza virus
SADMSIGVAV

SEQ ID NO: 511525 - protein, 10 aa, Influenza virus
SADMSIGVTV

SEQ ID NO: 511526 - protein, 10 aa, Influenza virus
SADPLASLLE

SEQ ID NO: 511527 - protein, 10 aa, Influenza virus
SADPLLSLLE

SEQ ID NO: 511528 - protein, 10 aa, Influenza virus
SADPLVSLLE

SEQ ID NO: 511529 - protein, 10 aa, Influenza virus
SAEHIEECSC

SEQ ID NO: 511530 - protein, 10 aa, Influenza virus
SAESRKLLLI

SEQ ID NO: 511531 - protein, 10 aa, Influenza virus
SAESRKLLLV

SEQ ID NO: 511532 - protein, 10 aa, Influenza virus
SAESRKMLLI

SEQ ID NO: 511533 - protein, 10 aa, Influenza virus
SAFDERRNKY

SEQ ID NO: 511534 - protein, 10 aa, Influenza virus
SAFDERRNRY

SEQ ID NO: 511535 - protein, 10 aa, Influenza virus
SAGALASCMG

SEQ ID NO: 511536 - protein, 10 aa, Influenza virus
SAGGAIWVTR

SEQ ID NO: 511537 - protein, 10 aa, Influenza virus
SAGGAVWVTR

SEQ ID NO: 511538 - protein, 10 aa, Influenza virus
SAGGDIWITR

SEQ ID NO: 511539 - protein, 10 aa, Influenza virus
SAGGDIWVMR

SEQ ID NO: 511540 - protein, 10 aa, Influenza virus
SAGGDIWVTR

SEQ ID NO: 511541 - protein, 10 aa, Influenza virus
SAGGHIWVTR

SEQ ID NO: 511542 - protein, 10 aa, Influenza virus
SAGGNIWITR

SEQ ID NO: 511543 - protein, 10 aa, Influenza virus
SAGKDPKKTG

SEQ ID NO: 511544 - protein, 10 aa, Influenza virus
SAGRDPKKTG

SEQ ID NO: 511545 - protein, 10 aa, Influenza virus
SAHHRVYWIR

SEQ ID NO: 511546 - protein, 10 aa, Influenza virus
SAIDQITGKL

SEQ ID NO: 511547 - protein, 10 aa, Influenza virus
SAIDQITRKL

SEQ ID NO: 511548 - protein, 10 aa, Influenza virus
SAIDQVTGKL

SEQ ID NO: 511549 - protein, 10 aa, Influenza virus
SAINQITGKL

SEQ ID NO: 511550 - protein, 10 aa, Influenza virus
SAKELVETNH

SEQ ID NO: 511551 - protein, 10 aa, Influenza virus
SAKHIEECSC

SEQ ID NO: 511552 - protein, 10 aa, Influenza virus
SAKHVEECSC

SEQ ID NO: 511553 - protein, 10 aa, Influenza virus
SALFVYSLRK

SEQ ID NO: 511554 - protein, 10 aa, Influenza virus
SALGSPGCDH

SEQ ID NO: 511555 - protein, 10 aa, Influenza virus
SALILRGAVA

SEQ ID NO: 511556 - protein, 10 aa, Influenza virus
SALILRGSIA

SEQ ID NO: 511557 - protein, 10 aa, Influenza virus
SALILRGSVA

SEQ ID NO: 511558 - protein, 10 aa, Influenza virus
SAPEGMCYPG

SEQ ID NO: 511559 - protein, 10 aa, Influenza virus
SAPGVKGFGF

SEQ ID NO: 511560 - protein, 10 aa, Influenza virus
SAPHGLCYPG

SEQ ID NO: 511561 - protein, 10 aa, Influenza virus
SAPHRLCYPG

SEQ ID NO: 511562 - protein, 10 aa, Influenza virus
SAQATEECSR

SEQ ID NO: 511563 - protein, 10 aa, Influenza virus
SAQEKNDLYG

SEQ ID NO: 511564 - protein, 10 aa, Influenza virus
SAQHIEECSC

SEQ ID NO: 511565 - protein, 10 aa, Influenza virus
SAQHVEECSC

SEQ ID NO: 511566 - protein, 10 aa, Influenza virus
SARHIEECSC

SEQ ID NO: 511567 - protein, 10 aa, Influenza virus
SARHIEEWSC

SEQ ID NO: 511568 - protein, 10 aa, Influenza virus
SARHVEECSC

SEQ ID NO: 511569 - protein, 10 aa, Influenza virus
SARQEKNPAL

SEQ ID NO: 511570 - protein, 10 aa, Influenza virus
SARSALILRG

SEQ ID NO: 511571 - protein, 10 aa, Influenza virus
SASACHDGAS

SEQ ID NO: 511572 - protein, 10 aa, Influenza virus
SASACHDGIS

SEQ ID NO: 511573 - protein, 10 aa, Influenza virus
SASACHDGSS

SEQ ID NO: 511574 - protein, 10 aa, Influenza virus
SASACHDGTN

SEQ ID NO: 511575 - protein, 10 aa, Influenza virus
SASACHDGTS

SEQ ID NO: 511576 - protein, 10 aa, Influenza virus
SASALILRGS

SEQ ID NO: 511577 - protein, 10 aa, Influenza virus
SASCHDGRAW

SEQ ID NO: 511578 - protein, 10 aa, Influenza virus
SASGDIWITR

SEQ ID NO: 511579 - protein, 10 aa, Influenza virus
SASGDIWVTR

SEQ ID NO: 511580 - protein, 10 aa, Influenza virus
SASGKADTRI

SEQ ID NO: 511581 - protein, 10 aa, Influenza virus
SASGRADTKI

SEQ ID NO: 511582 - protein, 10 aa, Influenza virus
SASGRADTRI

SEQ ID NO: 511583 - protein, 10 aa, Influenza virus
SASSISFCGV

SEQ ID NO: 511584 - protein, 10 aa, Influenza virus
SASTGGQSFY

SEQ ID NO: 511585 - protein, 10 aa, Influenza virus
SATACHDGKE

SEQ ID NO: 511586 - protein, 10 aa, Influenza virus
SATACHDGKG

SEQ ID NO: 511587 - protein, 10 aa, Influenza virus
SATACHDGKK

SEQ ID NO: 511588 - protein, 10 aa, Influenza virus
SATACHDGRK

SEQ ID NO: 511589 - protein, 10 aa, Influenza virus
SATACSDGPG

SEQ ID NO: 511590 - protein, 10 aa, Influenza virus
SATACSDGSG

SEQ ID NO: 511591 - protein, 10 aa, Influenza virus
SATGMALSVV

SEQ ID NO: 511592 - protein, 10 aa, Influenza virus
SATGMILSVV

SEQ ID NO: 511593 - protein, 10 aa, Influenza virus
SATGMTLSVV

SEQ ID NO: 511594 - protein, 10 aa, Influenza virus
SATGPADTRI

SEQ ID NO: 511595 - protein, 10 aa, Influenza virus
SATGPADTRV

SEQ ID NO: 511596 - protein, 10 aa, Influenza virus
SATGPAETRI

SEQ ID NO: 511597 - protein, 10 aa, Influenza virus
SATGPAETRV

SEQ ID NO: 511598 - protein, 10 aa, Influenza virus
SATGVTLSVV

SEQ ID NO: 511599 - protein, 10 aa, Influenza virus
SAVDQITGKL

SEQ ID NO: 511600 - protein, 10 aa, Influenza virus
SAVLRGFLII

SEQ ID NO: 511601 - protein, 10 aa, Influenza virus
SAVLRGFLIL

SEQ ID NO: 511602 - protein, 10 aa, Influenza virus
SAVNQITGKL

SEQ ID NO: 511603 - protein, 10 aa, Influenza virus
SAYCNTDLGA

SEQ ID NO: 511604 - protein, 10 aa, Influenza virus
SAYERMCNIL

SEQ ID NO: 511605 - protein, 10 aa, Influenza virus
SCAAMDDFQL

SEQ ID NO: 511606 - protein, 10 aa, Influenza virus
SCAAMDEFQL

SEQ ID NO: 511607 - protein, 10 aa, Influenza virus
SCAAMEDFQL

SEQ ID NO: 511608 - protein, 10 aa, Influenza virus
SCASNINIRE

SEQ ID NO: 511609 - protein, 10 aa, Influenza virus
SCATNINIRE

SEQ ID NO: 511610 - protein, 10 aa, Influenza virus
SCAVVMTDGS

SEQ ID NO: 511611 - protein, 10 aa, Influenza virus
SCDPDECRFY

SEQ ID NO: 511612 - protein, 10 aa, Influenza virus
SCDPDGCRFY

SEQ ID NO: 511613 - protein, 10 aa, Influenza virus
SCDPLGCKMY

SEQ ID NO: 511614 - protein, 10 aa, Influenza virus
SCDPLGCKTY

SEQ ID NO: 511615 - protein, 10 aa, Influenza virus
SCDPLGCRMY

SEQ ID NO: 511616 - protein, 10 aa, Influenza virus
SCDPNECRFY

SEQ ID NO: 511617 - protein, 10 aa, Influenza virus
SCDPSGCKMY

SEQ ID NO: 511618 - protein, 10 aa, Influenza virus
SCDPTGCKMY

SEQ ID NO: 511619 - protein, 10 aa, Influenza virus
SCDSPSNANG

SEQ ID NO: 511620 - protein, 10 aa, Influenza virus
SCDSPSNING

SEQ ID NO: 511621 - protein, 10 aa, Influenza virus
SCDSPSNVKG

SEQ ID NO: 511622 - protein, 10 aa, Influenza virus
SCDSPSNVNG

SEQ ID NO: 511623 - protein, 10 aa, Influenza virus
SCEGECFYSG

SEQ ID NO: 511624 - protein, 10 aa, Influenza virus
SCEPDECRFY

SEQ ID NO: 511625 - protein, 10 aa, Influenza virus
SCFDGKEWLH

SEQ ID NO: 511626 - protein, 10 aa, Influenza virus
SCFDGKEWMH

SEQ ID NO: 511627 - protein, 10 aa, Influenza virus
SCFDGREWMH

SEQ ID NO: 511628 - protein, 10 aa, Influenza virus
SCFLLAALLL

SEQ ID NO: 511629 - protein, 10 aa, Influenza virus
SCFLLIALLL

SEQ ID NO: 511630 - protein, 10 aa, Influenza virus
SCFLLVALFL

SEQ ID NO: 511631 - protein, 10 aa, Influenza virus
SCFLLVALLI

SEQ ID NO: 511632 - protein, 10 aa, Influenza virus
SCFLLVALLL

SEQ ID NO: 511633 - protein, 10 aa, Influenza virus
SCFTIMTDGP

SEQ ID NO: 511634 - protein, 10 aa, Influenza virus
SCFTLMTDGP

SEQ ID NO: 511635 - protein, 10 aa, Influenza virus
SCFTVLTDGP

SEQ ID NO: 511636 - protein, 10 aa, Influenza virus
SCFTVMTDGP

SEQ ID NO: 511637 - protein, 10 aa, Influenza virus
SCFVFVALIL

SEQ ID NO: 511638 - protein, 10 aa, Influenza virus
SCGILGTIIG

SEQ ID NO: 511639 - protein, 10 aa, Influenza virus
SCGPSECRTF

SEQ ID NO: 511640 - protein, 10 aa, Influenza virus
SCHDGIGRMT

SEQ ID NO: 511641 - protein, 10 aa, Influenza virus
SCHDGISRMS

SEQ ID NO: 511642 - protein, 10 aa, Influenza virus
SCHDGKARMS

SEQ ID NO: 511643 - protein, 10 aa, Influenza virus
SCHDGKAWLH

SEQ ID NO: 511644 - protein, 10 aa, Influenza virus
SCHDGKEWLH

SEQ ID NO: 511645 - protein, 10 aa, Influenza virus
SCHDGKFRMS

SEQ ID NO: 511646 - protein, 10 aa, Influenza virus
SCHDGKSRMS

SEQ ID NO: 511647 - protein, 10 aa, Influenza virus
SCHDGKSWLH

SEQ ID NO: 511648 - protein, 10 aa, Influenza virus
SCHDGMSRMS

SEQ ID NO: 511649 - protein, 10 aa, Influenza virus
SCHDGNAWLH

SEQ ID NO: 511650 - protein, 10 aa, Influenza virus
SCHDGRARMS

SEQ ID NO: 511651 - protein, 10 aa, Influenza virus
SCHDGRAWLH

SEQ ID NO: 511652 - protein, 10 aa, Influenza virus
SCHDGRSRMS

SEQ ID NO: 511653 - protein, 10 aa, Influenza virus
SCHDGVGRMT

SEQ ID NO: 511654 - protein, 10 aa, Influenza virus
SCHDGVSRMS

SEQ ID NO: 511655 - protein, 10 aa, Influenza virus
SCIASSIVLV

SEQ ID NO: 511656 - protein, 10 aa, Influenza virus
SCIASSIVMV

SEQ ID NO: 511657 - protein, 10 aa, Influenza virus
SCIASSLILA

SEQ ID NO: 511658 - protein, 10 aa, Influenza virus
SCIASSLVLA

SEQ ID NO: 511659 - protein, 10 aa, Influenza virus
SCIASSTVLV

SEQ ID NO: 511660 - protein, 10 aa, Influenza virus
SCIASSTVMV

SEQ ID NO: 511661 - protein, 10 aa, Influenza virus
SCIASSVVLV

SEQ ID NO: 511662 - protein, 10 aa, Influenza virus
SCIESIRNGT

SEQ ID NO: 511663 - protein, 10 aa, Influenza virus
SCINRCFYVE

SEQ ID NO: 511664 - protein, 10 aa, Influenza virus
SCKMYALHQG

SEQ ID NO: 511665 - protein, 10 aa, Influenza virus
SCLPACAYGP

SEQ ID NO: 511666 - protein, 10 aa, Influenza virus
SCLPACIYGL

SEQ ID NO: 511667 - protein, 10 aa, Influenza virus
SCLPACVYGL

SEQ ID NO: 511668 - protein, 10 aa, Influenza virus
SCLPACVYGP

SEQ ID NO: 511669 - protein, 10 aa, Influenza virus
SCLVPCFWVE

SEQ ID NO: 511670 - protein, 10 aa, Influenza virus
SCMDTIRNGT

SEQ ID NO: 511671 - protein, 10 aa, Influenza virus
SCMEAIRNGT

SEQ ID NO: 511672 - protein, 10 aa, Influenza virus
SCMESIRNNT

SEQ ID NO: 511673 - protein, 10 aa, Influenza virus
SCMETIRNGT

SEQ ID NO: 511674 - protein, 10 aa, Influenza virus
SCMGLIYNRM

SEQ ID NO: 511675 - protein, 10 aa, Influenza virus
SCPIGEAPSP

SEQ ID NO: 511676 - protein, 10 aa, Influenza virus
SCPIGEVPSP

SEQ ID NO: 511677 - protein, 10 aa, Influenza virus
SCPIGVAPSP

SEQ ID NO: 511678 - protein, 10 aa, Influenza virus
SCPIGVVPSP

SEQ ID NO: 511679 - protein, 10 aa, Influenza virus
SCPLGEAPSP

SEQ ID NO: 511680 - protein, 10 aa, Influenza virus
SCPMGVAPSP

SEQ ID NO: 511681 - protein, 10 aa, Influenza virus
SCPVGEAPSP

SEQ ID NO: 511682 - protein, 10 aa, Influenza virus
SCPVGVAPSP

SEQ ID NO: 511683 - protein, 10 aa, Influenza virus
SCSHLECRTF

SEQ ID NO: 511684 - protein, 10 aa, Influenza virus
SCSHMECRTF

SEQ ID NO: 511685 - protein, 10 aa, Influenza virus
SCSHSECRTF

SEQ ID NO: 511686 - protein, 10 aa, Influenza virus
SCSIDECRTF

SEQ ID NO: 511687 - protein, 10 aa, Influenza virus
SCSIHECRTF

SEQ ID NO: 511688 - protein, 10 aa, Influenza virus
SCSINECRTF

SEQ ID NO: 511689 - protein, 10 aa, Influenza virus
SCSISECRTF

SEQ ID NO: 511690 - protein, 10 aa, Influenza virus
SCSVSECRTF

SEQ ID NO: 511691 - protein, 10 aa, Influenza virus
SCSYLECRTF

SEQ ID NO: 511692 - protein, 10 aa, Influenza virus
SCTSPCLTDK

SEQ ID NO: 511693 - protein, 10 aa, Influenza virus
SCTVVMTDGN

SEQ ID NO: 511694 - protein, 10 aa, Influenza virus
SCTVVMTDGS

SEQ ID NO: 511695 - protein, 10 aa, Influenza virus
SCVCRDNWQG

SEQ ID NO: 511696 - protein, 10 aa, Influenza virus
SCVMLLAIAM

SEQ ID NO: 511697 - protein, 10 aa, Influenza virus
SCVNRCFYVE

SEQ ID NO: 511698 - protein, 10 aa, Influenza virus
SCYDGKAWLH

SEQ ID NO: 511699 - protein, 10 aa, Influenza virus
SCYMDIDVYC

SEQ ID NO: 511700 - protein, 10 aa, Influenza virus
SCYPNDGKVE

SEQ ID NO: 511701 - protein, 10 aa, Influenza virus
SCYPNEGKVE

SEQ ID NO: 511702 - protein, 10 aa, Influenza virus
SCYPNLCQVE

SEQ ID NO: 511703 - protein, 10 aa, Influenza virus
SCYPNLGKVE

SEQ ID NO: 511704 - protein, 10 aa, Influenza virus
SCYPNLGQVE

SEQ ID NO: 511705 - protein, 10 aa, Influenza virus
SCYPNMGKVE

SEQ ID NO: 511706 - protein, 10 aa, Influenza virus
SCYPNNGKVE

SEQ ID NO: 511707 - protein, 10 aa, Influenza virus
SCYPNSGKVE

SEQ ID NO: 511708 - protein, 10 aa, Influenza virus
SCYPQYPNVR

SEQ ID NO: 511709 - protein, 10 aa, Influenza virus
SCYPRYPDVR

SEQ ID NO: 511710 - protein, 10 aa, Influenza virus
SCYPRYPGVR

SEQ ID NO: 511711 - protein, 10 aa, Influenza virus
SCYPRYPNVR

SEQ ID NO: 511712 - protein, 10 aa, Influenza virus
SCYSRYPNVR

SEQ ID NO: 511713 - protein, 10 aa, Influenza virus
SCYVDIDIYC

SEQ ID NO: 511714 - protein, 10 aa, Influenza virus
SCYVDIDVYC

SEQ ID NO: 511715 - protein, 10 aa, Influenza virus
SCYVDTDVYC

SEQ ID NO: 511716 - protein, 10 aa, Influenza virus
SCYVDVDVYC

SEQ ID NO: 511717 - protein, 10 aa, Influenza virus
SDAPFLDRLR

SEQ ID NO: 511718 - protein, 10 aa, Influenza virus
SDAQAFYKIL

SEQ ID NO: 511719 - protein, 10 aa, Influenza virus
SDAQAFYKLL

SEQ ID NO: 511720 - protein, 10 aa, Influenza virus
SDAQIDESCE

SEQ ID NO: 511721 - protein, 10 aa, Influenza virus
SDDFALILNA

SEQ ID NO: 511722 - protein, 10 aa, Influenza virus
SDDFALIVNA

SEQ ID NO: 511723 - protein, 10 aa, Influenza virus
SDDNVYKALS

SEQ ID NO: 511724 - protein, 10 aa, Influenza virus
SDDSVYKALS

SEQ ID NO: 511725 - protein, 10 aa, Influenza virus
SDEALKMTIA

SEQ ID NO: 511726 - protein, 10 aa, Influenza virus
SDFICVGWSS

SEQ ID NO: 511727 - protein, 10 aa, Influenza virus
SDFLCVGWSS

SEQ ID NO: 511728 - protein, 10 aa, Influenza virus
SDFMCVGWSS

SEQ ID NO: 511729 - protein, 10 aa, Influenza virus
SDGAFLAPRY

SEQ ID NO: 511730 - protein, 10 aa, Influenza virus
SDGGPNLYNI

SEQ ID NO: 511731 - protein, 10 aa, Influenza virus
SDGNLIAPWY

SEQ ID NO: 511732 - protein, 10 aa, Influenza virus
SDGPGWLTIG

SEQ ID NO: 511733 - protein, 10 aa, Influenza virus
SDGPGWLTLG

SEQ ID NO: 511734 - protein, 10 aa, Influenza virus
SDGSGWLTLG

SEQ ID NO: 511735 - protein, 10 aa, Influenza virus
SDHICIGYHA

SEQ ID NO: 511736 - protein, 10 aa, Influenza virus
SDICYPGKFT

SEQ ID NO: 511737 - protein, 10 aa, Influenza virus
SDICYPGRFT

SEQ ID NO: 511738 - protein, 10 aa, Influenza virus
SDIEAMASQG

SEQ ID NO: 511739 - protein, 10 aa, Influenza virus
SDIEAMATQG

SEQ ID NO: 511740 - protein, 10 aa, Influenza virus
SDIEIMASQG

SEQ ID NO: 511741 - protein, 10 aa, Influenza virus
SDILVTREPY

SEQ ID NO: 511742 - protein, 10 aa, Influenza virus
SDINIMASQG

SEQ ID NO: 511743 - protein, 10 aa, Influenza virus
SDKICIGYHA

SEQ ID NO: 511744 - protein, 10 aa, Influenza virus
SDKICLGHHA

SEQ ID NO: 511745 - protein, 10 aa, Influenza virus
SDKLYIWGVH

SEQ ID NO: 511746 - protein, 10 aa, Influenza virus
SDKPFQNVSR

SEQ ID NO: 511747 - protein, 10 aa, Influenza virus
SDKRIGSCTS

SEQ ID NO: 511748 - protein, 10 aa, Influenza virus
SDLDYQIGYI

SEQ ID NO: 511749 - protein, 10 aa, Influenza virus
SDLDYQIGYV

SEQ ID NO: 511750 - protein, 10 aa, Influenza virus
SDLEALMEWL

SEQ ID NO: 511751 - protein, 10 aa, Influenza virus
SDLIIERKEG

SEQ ID NO: 511752 - protein, 10 aa, Influenza virus
SDLIIERREG

SEQ ID NO: 511753 - protein, 10 aa, Influenza virus
SDNADKICLG

SEQ ID NO: 511754 - protein, 10 aa, Influenza virus
SDNEQTDLYK

SEQ ID NO: 511755 - protein, 10 aa, Influenza virus
SDNGGLIAPS

SEQ ID NO: 511756 - protein, 10 aa, Influenza virus
SDNRSGYSGI

SEQ ID NO: 511757 - protein, 10 aa, Influenza virus
SDPDYQIGYV

SEQ ID NO: 511758 - protein, 10 aa, Influenza virus
SDQICIGYHA

SEQ ID NO: 511759 - protein, 10 aa, Influenza virus
SDQICVGYHA

SEQ ID NO: 511760 - protein, 10 aa, Influenza virus
SDQISIVPNI

SEQ ID NO: 511761 - protein, 10 aa, Influenza virus
SDQLKLATGL

SEQ ID NO: 511762 - protein, 10 aa, Influenza virus
SDRICIGYHA

SEQ ID NO: 511763 - protein, 10 aa, Influenza virus
SDRLVLAIGL

SEQ ID NO: 511764 - protein, 10 aa, Influenza virus
SDRLVLATGL

SEQ ID NO: 511765 - protein, 10 aa, Influenza virus
SDSIKSWRKD

SEQ ID NO: 511766 - protein, 10 aa, Influenza virus
SDSSFYAEMK

SEQ ID NO: 511767 - protein, 10 aa, Influenza virus
SDTPRGEDAQ

SEQ ID NO: 511768 - protein, 10 aa, Influenza virus
SDTPRGEDGQ

SEQ ID NO: 511769 - protein, 10 aa, Influenza virus
SDTPRGEDNQ

SEQ ID NO: 511770 - protein, 10 aa, Influenza virus
SDTPRGEDSQ

SEQ ID NO: 511771 - protein, 10 aa, Influenza virus
SDTPRPADPS

SEQ ID NO: 511772 - protein, 10 aa, Influenza virus
SDTPRPDDPS

SEQ ID NO: 511773 - protein, 10 aa, Influenza virus
SDTPRPSDPS

SEQ ID NO: 511774 - protein, 10 aa, Influenza virus
SDTPRPTDPS

SEQ ID NO: 511775 - protein, 10 aa, Influenza virus
SDTPRPVDPS

SEQ ID NO: 511776 - protein, 10 aa, Influenza virus
SDTTCWSWPD

SEQ ID NO: 511777 - protein, 10 aa, Influenza virus
SDTTGWPWPD

SEQ ID NO: 511778 - protein, 10 aa, Influenza virus
SDTTGWSWPD

SEQ ID NO: 511779 - protein, 10 aa, Influenza virus
SDTTSWSWPD

SEQ ID NO: 511780 - protein, 10 aa, Influenza virus
SDTVDTLTEN

SEQ ID NO: 511781 - protein, 10 aa, Influenza virus
SDVLVTREPY

SEQ ID NO: 511782 - protein, 10 aa, Influenza virus
SDVWLGRTVS

SEQ ID NO: 511783 - protein, 10 aa, Influenza virus
SDWSGYSGSF

SEQ ID NO: 511784 - protein, 10 aa, Influenza virus
SDYEELKHLM

SEQ ID NO: 511785 - protein, 10 aa, Influenza virus
SEAPGWSWDD

SEQ ID NO: 511786 - protein, 10 aa, Influenza virus
SECACINGSC

SEQ ID NO: 511787 - protein, 10 aa, Influenza virus
SECACVNGSC

SEQ ID NO: 511788 - protein, 10 aa, Influenza virus
SECICINGTC

SEQ ID NO: 511789 - protein, 10 aa, Influenza virus
SECITPNGSI

SEQ ID NO: 511790 - protein, 10 aa, Influenza virus
SECRTFFLTQ

SEQ ID NO: 511791 - protein, 10 aa, Influenza virus
SECVCHDGTC

SEQ ID NO: 511792 - protein, 10 aa, Influenza virus
SECVCHDGVC

SEQ ID NO: 511793 - protein, 10 aa, Influenza virus
SECVCHKGIC

SEQ ID NO: 511794 - protein, 10 aa, Influenza virus
SECVCHKGVC

SEQ ID NO: 511795 - protein, 10 aa, Influenza virus
SECVCHNGIC

SEQ ID NO: 511796 - protein, 10 aa, Influenza virus
SECVCHNGTC

SEQ ID NO: 511797 - protein, 10 aa, Influenza virus
SECVCHNGVC

SEQ ID NO: 511798 - protein, 10 aa, Influenza virus
SECVCHNSTC

SEQ ID NO: 511799 - protein, 10 aa, Influenza virus
SECVCHSGIC

SEQ ID NO: 511800 - protein, 10 aa, Influenza virus
SECVCINGIC

SEQ ID NO: 511801 - protein, 10 aa, Influenza virus
SECVCINGSC

SEQ ID NO: 511802 - protein, 10 aa, Influenza virus
SECVCINGTC

SEQ ID NO: 511803 - protein, 10 aa, Influenza virus
SECVCISGTC

SEQ ID NO: 511804 - protein, 10 aa, Influenza virus
SECVCMNGSC

SEQ ID NO: 511805 - protein, 10 aa, Influenza virus
SECVCQDEFC

SEQ ID NO: 511806 - protein, 10 aa, Influenza virus
SECVCVNGSC

SEQ ID NO: 511807 - protein, 10 aa, Influenza virus
SECVRHNGTC

SEQ ID NO: 511808 - protein, 10 aa, Influenza virus
SECVSHNGTW

SEQ ID NO: 511809 - protein, 10 aa, Influenza virus
SECYNPCFYV

SEQ ID NO: 511810 - protein, 10 aa, Influenza virus
SEDGVYKALS

SEQ ID NO: 511811 - protein, 10 aa, Influenza virus
SEDNVYKALS

SEQ ID NO: 511812 - protein, 10 aa, Influenza virus
SEDNVYKVLS

SEQ ID NO: 511813 - protein, 10 aa, Influenza virus
SEDNVYRALS

SEQ ID NO: 511814 - protein, 10 aa, Influenza virus
SEDSRSGYET

SEQ ID NO: 511815 - protein, 10 aa, Influenza virus
SEEALRQKIM

SEQ ID NO: 511816 - protein, 10 aa, Influenza virus
SEECSCYVDI

SEQ ID NO: 511817 - protein, 10 aa, Influenza virus
SEFICVGWSS

SEQ ID NO: 511818 - protein, 10 aa, Influenza virus
SEFLCVGWSS

SEQ ID NO: 511819 - protein, 10 aa, Influenza virus
SEFNEIEHQI

SEQ ID NO: 511820 - protein, 10 aa, Influenza virus
SEFNEIEYQI

SEQ ID NO: 511821 - protein, 10 aa, Influenza virus
SEFNKACELT

SEQ ID NO: 511822 - protein, 10 aa, Influenza virus
SEFSEIEHQI

SEQ ID NO: 511823 - protein, 10 aa, Influenza virus
SEFSETEHQI

SEQ ID NO: 511824 - protein, 10 aa, Influenza virus
SEGIGQAADL

SEQ ID NO: 511825 - protein, 10 aa, Influenza virus
SEGMGQAADL

SEQ ID NO: 511826 - protein, 10 aa, Influenza virus
SEGRGQAADL

SEQ ID NO: 511827 - protein, 10 aa, Influenza virus
SEGTGIAADR

SEQ ID NO: 511828 - protein, 10 aa, Influenza virus
SEGTGIVADR

SEQ ID NO: 511829 - protein, 10 aa, Influenza virus
SEGTGMAADQ

SEQ ID NO: 511830 - protein, 10 aa, Influenza virus
SEGTGQAADL

SEQ ID NO: 511831 - protein, 10 aa, Influenza virus
SEGTGQAGDL

SEQ ID NO: 511832 - protein, 10 aa, Influenza virus
SEGTGTAADL

SEQ ID NO: 511833 - protein, 10 aa, Influenza virus
SEHTAYSQIT

SEQ ID NO: 511834 - protein, 10 aa, Influenza virus
SEIEGRIQDL

SEQ ID NO: 511835 - protein, 10 aa, Influenza virus
SEIEHQIGNV

SEQ ID NO: 511836 - protein, 10 aa, Influenza virus
SEIEHQISNV

SEQ ID NO: 511837 - protein, 10 aa, Influenza virus
SEIEQQIGNV

SEQ ID NO: 511838 - protein, 10 aa, Influenza virus
SEKLVLATGL

SEQ ID NO: 511839 - protein, 10 aa, Influenza virus
SEKLVLATGP

SEQ ID NO: 511840 - protein, 10 aa, Influenza virus
SELGVPFHLG

SEQ ID NO: 511841 - protein, 10 aa, Influenza virus
SEMDKLFERV

SEQ ID NO: 511842 - protein, 10 aa, Influenza virus
SEMDKLYERV

SEQ ID NO: 511843 - protein, 10 aa, Influenza virus
SEMDKLYTRV

SEQ ID NO: 511844 - protein, 10 aa, Influenza virus
SEMKKLYERV

SEQ ID NO: 511845 - protein, 10 aa, Influenza virus
SEMKWLLSSK

SEQ ID NO: 511846 - protein, 10 aa, Influenza virus
SEMKWLSSSG

SEQ ID NO: 511847 - protein, 10 aa, Influenza virus
SEMKWLSSSM

SEQ ID NO: 511848 - protein, 10 aa, Influenza virus
SEMLNLYDRV

SEQ ID NO: 511849 - protein, 10 aa, Influenza virus
SEMLNLYERV

SEQ ID NO: 511850 - protein, 10 aa, Influenza virus
SEMNKLFEKT

SEQ ID NO: 511851 - protein, 10 aa, Influenza virus
SEMNKLFERI

SEQ ID NO: 511852 - protein, 10 aa, Influenza virus
SEMNKLFERT

SEQ ID NO: 511853 - protein, 10 aa, Influenza virus
SEMNKLFERV

SEQ ID NO: 511854 - protein, 10 aa, Influenza virus
SEMNKLYEKV

SEQ ID NO: 511855 - protein, 10 aa, Influenza virus
SEMNKLYERV

SEQ ID NO: 511856 - protein, 10 aa, Influenza virus
SEMNNLYERV

SEQ ID NO: 511857 - protein, 10 aa, Influenza virus
SEMNRLFERV

SEQ ID NO: 511858 - protein, 10 aa, Influenza virus
SEMSKLFEKT

SEQ ID NO: 511859 - protein, 10 aa, Influenza virus
SEMSKLFERT

SEQ ID NO: 511860 - protein, 10 aa, Influenza virus
SEMSKLFERV

SEQ ID NO: 511861 - protein, 10 aa, Influenza virus
SEMSKLYERV

SEQ ID NO: 511862 - protein, 10 aa, Influenza virus
SEQAAEAIEV

SEQ ID NO: 511863 - protein, 10 aa, Influenza virus
SEQAAEAMDI

SEQ ID NO: 511864 - protein, 10 aa, Influenza virus
SEQAAEAMEI

SEQ ID NO: 511865 - protein, 10 aa, Influenza virus
SEQAAEAMEV

SEQ ID NO: 511866 - protein, 10 aa, Influenza virus
SEQFPVQTDE

SEQ ID NO: 511867 - protein, 10 aa, Influenza virus
SEQIIVTREP

SEQ ID NO: 511868 - protein, 10 aa, Influenza virus
SEQIVVTREP

SEQ ID NO: 511869 - protein, 10 aa, Influenza virus
SEQMETGGER

SEQ ID NO: 511870 - protein, 10 aa, Influenza virus
SEQNVPVTQV

SEQ ID NO: 511871 - protein, 10 aa, Influenza virus
SEQVIVTREP

SEQ ID NO: 511872 - protein, 10 aa, Influenza virus
SERGEDTIEE

SEQ ID NO: 511873 - protein, 10 aa, Influenza virus
SERGEETIEE

SEQ ID NO: 511874 - protein, 10 aa, Influenza virus
SERGEETVEE

SEQ ID NO: 511875 - protein, 10 aa, Influenza virus
SERGLFGAIA

SEQ ID NO: 511876 - protein, 10 aa, Influenza virus
SERGLQRRRF

SEQ ID NO: 511877 - protein, 10 aa, Influenza virus
SERLVLATGL

SEQ ID NO: 511878 - protein, 10 aa, Influenza virus
SESGRLIDFL

SEQ ID NO: 511879 - protein, 10 aa, Influenza virus
SESRSNIFNM

SEQ ID NO: 511880 - protein, 10 aa, Influenza virus
SESSFYAEME

SEQ ID NO: 511881 - protein, 10 aa, Influenza virus
SETEHQIGNV

SEQ ID NO: 511882 - protein, 10 aa, Influenza virus
SETGAPQLNP

SEQ ID NO: 511883 - protein, 10 aa, Influenza virus
SEVEGRIQDL

SEQ ID NO: 511884 - protein, 10 aa, Influenza virus
SEVPEWSWDD

SEQ ID NO: 511885 - protein, 10 aa, Influenza virus
SEVPGWSWDD

SEQ ID NO: 511886 - protein, 10 aa, Influenza virus
SFAGWILGNP

SEQ ID NO: 511887 - protein, 10 aa, Influenza virus
SFAISCFLLC

SEQ ID NO: 511888 - protein, 10 aa, Influenza virus
SFALAQGALL

SEQ ID NO: 511889 - protein, 10 aa, Influenza virus
SFALAQGALV

SEQ ID NO: 511890 - protein, 10 aa, Influenza virus
SFALAQGTLL

SEQ ID NO: 511891 - protein, 10 aa, Influenza virus
SFALAQGVLL

SEQ ID NO: 511892 - protein, 10 aa, Influenza virus
SFAMSCFLLC

SEQ ID NO: 511893 - protein, 10 aa, Influenza virus
SFATSCFLLC

SEQ ID NO: 511894 - protein, 10 aa, Influenza virus
SFEGWIGGNP

SEQ ID NO: 511895 - protein, 10 aa, Influenza virus
SFEGWIVGNP

SEQ ID NO: 511896 - protein, 10 aa, Influenza virus
SFEKFEIFPK

SEQ ID NO: 511897 - protein, 10 aa, Influenza virus
SFEQITFIQA

SEQ ID NO: 511898 - protein, 10 aa, Influenza virus
SFEQITFLQA

SEQ ID NO: 511899 - protein, 10 aa, Influenza virus
SFEQITFMQA

SEQ ID NO: 511900 - protein, 10 aa, Influenza virus
SFERFEIFPK

SEQ ID NO: 511901 - protein, 10 aa, Influenza virus
SFERFEIFPN

SEQ ID NO: 511902 - protein, 10 aa, Influenza virus
SFERFEMFPK

SEQ ID NO: 511903 - protein, 10 aa, Influenza virus
SFESNGGLLA

SEQ ID NO: 511904 - protein, 10 aa, Influenza virus
SFESNGNFIA

SEQ ID NO: 511905 - protein, 10 aa, Influenza virus
SFESTGNLIA

SEQ ID NO: 511906 - protein, 10 aa, Influenza virus
SFESTGNLVA

SEQ ID NO: 511907 - protein, 10 aa, Influenza virus
SFFRHMVWLI

SEQ ID NO: 511908 - protein, 10 aa, Influenza virus
SFFRNIVWLI

SEQ ID NO: 511909 - protein, 10 aa, Influenza virus
SFFRNMIWLI

SEQ ID NO: 511910 - protein, 10 aa, Influenza virus
SFFRNMIWLT

SEQ ID NO: 511911 - protein, 10 aa, Influenza virus
SFFRNMVWLI

SEQ ID NO: 511912 - protein, 10 aa, Influenza virus
SFFRNMVWLT

SEQ ID NO: 511913 - protein, 10 aa, Influenza virus
SFFRNMVWLV

SEQ ID NO: 511914 - protein, 10 aa, Influenza virus
SFFRNVVWLI

SEQ ID NO: 511915 - protein, 10 aa, Influenza virus
SFFRNVVWLT

SEQ ID NO: 511916 - protein, 10 aa, Influenza virus
SFFRNVVWLV

SEQ ID NO: 511917 - protein, 10 aa, Influenza virus
SFFSRLNWLT

SEQ ID NO: 511918 - protein, 10 aa, Influenza virus
SFFYRYGFVA

SEQ ID NO: 511919 - protein, 10 aa, Influenza virus
SFGASCFIFL

SEQ ID NO: 511920 - protein, 10 aa, Influenza virus
SFGASCFILL

SEQ ID NO: 511921 - protein, 10 aa, Influenza virus
SFGASCFLFL

SEQ ID NO: 511922 - protein, 10 aa, Influenza virus
SFGASCFLLI

SEQ ID NO: 511923 - protein, 10 aa, Influenza virus
SFGASCFLLL

SEQ ID NO: 511924 - protein, 10 aa, Influenza virus
SFGASCFVLL

SEQ ID NO: 511925 - protein, 10 aa, Influenza virus
SFGASCVMLL

SEQ ID NO: 511926 - protein, 10 aa, Influenza virus
SFGASSFVLL

SEQ ID NO: 511927 - protein, 10 aa, Influenza virus
SFGGFTFKRT

SEQ ID NO: 511928 - protein, 10 aa, Influenza virus
SFGVSGINES

SEQ ID NO: 511929 - protein, 10 aa, Influenza virus
SFGVSGVNES

SEQ ID NO: 511930 - protein, 10 aa, Influenza virus
SFHLGTKQVC

SEQ ID NO: 511931 - protein, 10 aa, Influenza virus
SFIGEEMATK

SEQ ID NO: 511932 - protein, 10 aa, Influenza virus
SFIQHPELTG

SEQ ID NO: 511933 - protein, 10 aa, Influenza virus
SFKPNIGPRP

SEQ ID NO: 511934 - protein, 10 aa, Influenza virus
SFLAHALKLV

SEQ ID NO: 511935 - protein, 10 aa, Influenza virus
SFLTHALRFL

SEQ ID NO: 511936 - protein, 10 aa, Influenza virus
SFNGAFIAPD

SEQ ID NO: 511937 - protein, 10 aa, Influenza virus
SFNGAFVAPD

SEQ ID NO: 511938 - protein, 10 aa, Influenza virus
SFNGEEMATK

SEQ ID NO: 511939 - protein, 10 aa, Influenza virus
SFPDGAQIKY

SEQ ID NO: 511940 - protein, 10 aa, Influenza virus
SFPDGAQIQY

SEQ ID NO: 511941 - protein, 10 aa, Influenza virus
SFPDGARIQY

SEQ ID NO: 511942 - protein, 10 aa, Influenza virus
SFPNGAQIQY

SEQ ID NO: 511943 - protein, 10 aa, Influenza virus
SFPQTTNTYR

SEQ ID NO: 511944 - protein, 10 aa, Influenza virus
SFQGGHIEEC

SEQ ID NO: 511945 - protein, 10 aa, Influenza virus
SFQGRGVFEF

SEQ ID NO: 511946 - protein, 10 aa, Influenza virus
SFQGRGVFEL

SEQ ID NO: 511947 - protein, 10 aa, Influenza virus
SFQLINNKKP

SEQ ID NO: 511948 - protein, 10 aa, Influenza virus
SFQPNIGPRA

SEQ ID NO: 511949 - protein, 10 aa, Influenza virus
SFQPNIGPRP

SEQ ID NO: 511950 - protein, 10 aa, Influenza virus
SFQSGHIEEC

SEQ ID NO: 511951 - protein, 10 aa, Influenza virus
SFQVDCFIWH

SEQ ID NO: 511952 - protein, 10 aa, Influenza virus
SFQVDCFLWH

SEQ ID NO: 511953 - protein, 10 aa, Influenza virus
SFQVDCYLWH

SEQ ID NO: 511954 - protein, 10 aa, Influenza virus
SFRGRGVFEL

SEQ ID NO: 511955 - protein, 10 aa, Influenza virus
SFRPNIGPRP

SEQ ID NO: 511956 - protein, 10 aa, Influenza virus
SFRQSERGED

SEQ ID NO: 511957 - protein, 10 aa, Influenza virus
SFRQSERGEE

SEQ ID NO: 511958 - protein, 10 aa, Influenza virus
SFRYGDGVWI

SEQ ID NO: 511959 - protein, 10 aa, Influenza virus
SFSFGGFTFK

SEQ ID NO: 511960 - protein, 10 aa, Influenza virus
SFSIRGETTG

SEQ ID NO: 511961 - protein, 10 aa, Influenza virus
SFSIRWETTG

SEQ ID NO: 511962 - protein, 10 aa, Influenza virus
SFSISCFLLA

SEQ ID NO: 511963 - protein, 10 aa, Influenza virus
SFSISCFLLI

SEQ ID NO: 511964 - protein, 10 aa, Influenza virus
SFSISCFLLV

SEQ ID NO: 511965 - protein, 10 aa, Influenza virus
SFSMSCFVFV

SEQ ID NO: 511966 - protein, 10 aa, Influenza virus
SFSPSPGARP

SEQ ID NO: 511967 - protein, 10 aa, Influenza virus
SFSPSPGDRP

SEQ ID NO: 511968 - protein, 10 aa, Influenza virus
SFSRTELIAP

SEQ ID NO: 511969 - protein, 10 aa, Influenza virus
SFSRTELINP

SEQ ID NO: 511970 - protein, 10 aa, Influenza virus
SFSRTELIPP

SEQ ID NO: 511971 - protein, 10 aa, Influenza virus
SFSRTELISP

SEQ ID NO: 511972 - protein, 10 aa, Influenza virus
SFSRTQLIAP

SEQ ID NO: 511973 - protein, 10 aa, Influenza virus
SFTGEEMASK

SEQ ID NO: 511974 - protein, 10 aa, Influenza virus
SFTGEEMATK

SEQ ID NO: 511975 - protein, 10 aa, Influenza virus
SFTGEEMATR

SEQ ID NO: 511976 - protein, 10 aa, Influenza virus
SFTGWILGNP

SEQ ID NO: 511977 - protein, 10 aa, Influenza virus
SFTITGDNTK

SEQ ID NO: 511978 - protein, 10 aa, Influenza virus
SFVPVVGARP

SEQ ID NO: 511979 - protein, 10 aa, Influenza virus
SFVQHPELTG

SEQ ID NO: 511980 - protein, 10 aa, Influenza virus
SFVQHPEMTG

SEQ ID NO: 511981 - protein, 10 aa, Influenza virus
SFWMCPNGSL

SEQ ID NO: 511982 - protein, 10 aa, Influenza virus
SFWMCSGHSC

SEQ ID NO: 511983 - protein, 10 aa, Influenza virus
SFWMCSNGSL

SEQ ID NO: 511984 - protein, 10 aa, Influenza virus
SFWRCSNGSL

SEQ ID NO: 511985 - protein, 10 aa, Influenza virus
SFYAELKWLI

SEQ ID NO: 511986 - protein, 10 aa, Influenza virus
SFYAELKWLV

SEQ ID NO: 511987 - protein, 10 aa, Influenza virus
SFYAEMEWLL

SEQ ID NO: 511988 - protein, 10 aa, Influenza virus
SFYAEMKWLL

SEQ ID NO: 511989 - protein, 10 aa, Influenza virus
SFYRNLIWLV

SEQ ID NO: 511990 - protein, 10 aa, Influenza virus
SFYRNLVWIV

SEQ ID NO: 511991 - protein, 10 aa, Influenza virus
SFYRNLVWLV

SEQ ID NO: 511992 - protein, 10 aa, Influenza virus
SFYRNMRWLT

SEQ ID NO: 511993 - protein, 10 aa, Influenza virus
SFYRNVVWLI

SEQ ID NO: 511994 - protein, 10 aa, Influenza virus
SFYRSINWLT

SEQ ID NO: 511995 - protein, 10 aa, Influenza virus
SFYRSIRWLT

SEQ ID NO: 511996 - protein, 10 aa, Influenza virus
SFYRSMKWLT

SEQ ID NO: 511997 - protein, 10 aa, Influenza virus
SFYRSMRWLT

SEQ ID NO: 511998 - protein, 10 aa, Influenza virus
SFYSEMKWLL

SEQ ID NO: 511999 - protein, 10 aa, Influenza virus
SFYSEMKWLS

SEQ ID NO: 512000 - protein, 10 aa, Influenza virus
SFYWTIVDPG

SEQ ID NO: 512001 - protein, 10 aa, Influenza virus
SFYWTIVEPE

SEQ ID NO: 512002 - protein, 10 aa, Influenza virus
SFYWTIVEPG

SEQ ID NO: 512003 - protein, 10 aa, Influenza virus
SFYWTIVKPG

SEQ ID NO: 512004 - protein, 10 aa, Influenza virus
SGAAGAAIKG

SEQ ID NO: 512005 - protein, 10 aa, Influenza virus
SGAAGAAVKG

SEQ ID NO: 512006 - protein, 10 aa, Influenza virus
SGADDDAYAV

SEQ ID NO: 512007 - protein, 10 aa, Influenza virus
SGADDEAYAV

SEQ ID NO: 512008 - protein, 10 aa, Influenza virus
SGADNDAYAV

SEQ ID NO: 512009 - protein, 10 aa, Influenza virus
SGCITPNGSI

SEQ ID NO: 512010 - protein, 10 aa, Influenza virus
SGCKMYALHQ

SEQ ID NO: 512011 - protein, 10 aa, Influenza virus
SGDDVWMGRT

SEQ ID NO: 512012 - protein, 10 aa, Influenza virus
SGDIWITREP

SEQ ID NO: 512013 - protein, 10 aa, Influenza virus
SGDIWVTREP

SEQ ID NO: 512014 - protein, 10 aa, Influenza virus
SGDYARLYIW

SEQ ID NO: 512015 - protein, 10 aa, Influenza virus
SGEQMLIIWG

SEQ ID NO: 512016 - protein, 10 aa, Influenza virus
SGEQMLVIWG

SEQ ID NO: 512017 - protein, 10 aa, Influenza virus
SGEQVLVIWG

SEQ ID NO: 512018 - protein, 10 aa, Influenza virus
SGEVPGWSWD

SEQ ID NO: 512019 - protein, 10 aa, Influenza virus
SGFAIFSKDN

SEQ ID NO: 512020 - protein, 10 aa, Influenza virus
SGFAIISKDN

SEQ ID NO: 512021 - protein, 10 aa, Influenza virus
SGFAIVSKDN

SEQ ID NO: 512022 - protein, 10 aa, Influenza virus
SGFAVVSKDN

SEQ ID NO: 512023 - protein, 10 aa, Influenza virus
SGFEIIWDPN

SEQ ID NO: 512024 - protein, 10 aa, Influenza virus
SGFEILLIED

SEQ ID NO: 512025 - protein, 10 aa, Influenza virus
SGFEILLIEE

SEQ ID NO: 512026 - protein, 10 aa, Influenza virus
SGFEMIWDAN

SEQ ID NO: 512027 - protein, 10 aa, Influenza virus
SGFEMIWDPD

SEQ ID NO: 512028 - protein, 10 aa, Influenza virus
SGFEMIWDPN

SEQ ID NO: 512029 - protein, 10 aa, Influenza virus
SGFEMLKIHN

SEQ ID NO: 512030 - protein, 10 aa, Influenza virus
SGFEMLKIPN

SEQ ID NO: 512031 - protein, 10 aa, Influenza virus
SGFEMLKVPN

SEQ ID NO: 512032 - protein, 10 aa, Influenza virus
SGFEMLRIPN

SEQ ID NO: 512033 - protein, 10 aa, Influenza virus
SGFEMVWDAN

SEQ ID NO: 512034 - protein, 10 aa, Influenza virus
SGFEMVWDPN

SEQ ID NO: 512035 - protein, 10 aa, Influenza virus
SGFEVLFIED

SEQ ID NO: 512036 - protein, 10 aa, Influenza virus
SGFEVLLIED

SEQ ID NO: 512037 - protein, 10 aa, Influenza virus
SGFEVLLIEN

SEQ ID NO: 512038 - protein, 10 aa, Influenza virus
SGFFGDNPRP

SEQ ID NO: 512039 - protein, 10 aa, Influenza virus
SGFFPDGPQI

SEQ ID NO: 512040 - protein, 10 aa, Influenza virus
SGFVIVSKDN

SEQ ID NO: 512041 - protein, 10 aa, Influenza virus
SGFVRTLFQQ

SEQ ID NO: 512042 - protein, 10 aa, Influenza virus
SGGGDIWVTR

SEQ ID NO: 512043 - protein, 10 aa, Influenza virus
SGGHIEECSC

SEQ ID NO: 512044 - protein, 10 aa, Influenza virus
SGGIDKEPMG

SEQ ID NO: 512045 - protein, 10 aa, Influenza virus
SGGIDKESMG

SEQ ID NO: 512046 - protein, 10 aa, Influenza virus
SGGLLAPRYG

SEQ ID NO: 512047 - protein, 10 aa, Influenza virus
SGGTINSPLP

SEQ ID NO: 512048 - protein, 10 aa, Influenza virus
SGGYKDIILW

SEQ ID NO: 512049 - protein, 10 aa, Influenza virus
SGGYKDVILW

SEQ ID NO: 512050 - protein, 10 aa, Influenza virus
SGIAIALGII

SEQ ID NO: 512051 - protein, 10 aa, Influenza virus
SGIAIVLGII

SEQ ID NO: 512052 - protein, 10 aa, Influenza virus
SGICPVVFTD

SEQ ID NO: 512053 - protein, 10 aa, Influenza virus
SGIEYNGKSL

SEQ ID NO: 512054 - protein, 10 aa, Influenza virus
SGIFGDNPRP

SEQ ID NO: 512055 - protein, 10 aa, Influenza virus
SGIFGDSPRP

SEQ ID NO: 512056 - protein, 10 aa, Influenza virus
SGIGRFYIQM

SEQ ID NO: 512057 - protein, 10 aa, Influenza virus
SGIKSFSRTE

SEQ ID NO: 512058 - protein, 10 aa, Influenza virus
SGIKSFSRTQ

SEQ ID NO: 512059 - protein, 10 aa, Influenza virus
SGIKTDGATS

SEQ ID NO: 512060 - protein, 10 aa, Influenza virus
SGIMKTEGTL

SEQ ID NO: 512061 - protein, 10 aa, Influenza virus
SGIMKTEKTL

SEQ ID NO: 512062 - protein, 10 aa, Influenza virus
SGIMKTERTL

SEQ ID NO: 512063 - protein, 10 aa, Influenza virus
SGIMKTGGTL

SEQ ID NO: 512064 - protein, 10 aa, Influenza virus
SGINESADMS

SEQ ID NO: 512065 - protein, 10 aa, Influenza virus
SGIPPLELGD

SEQ ID NO: 512066 - protein, 10 aa, Influenza virus
SGIRSFSRTE

SEQ ID NO: 512067 - protein, 10 aa, Influenza virus
SGIRTDGATS

SEQ ID NO: 512068 - protein, 10 aa, Influenza virus
SGKADTRILF

SEQ ID NO: 512069 - protein, 10 aa, Influenza virus
SGKNTDLEAL

SEQ ID NO: 512070 - protein, 10 aa, Influenza virus
SGKVECVCRD

SEQ ID NO: 512071 - protein, 10 aa, Influenza virus
SGLIAGWYGF

SEQ ID NO: 512072 - protein, 10 aa, Influenza virus
SGLPVGGNEK

SEQ ID NO: 512073 - protein, 10 aa, Influenza virus
SGLTHIMIWH

SEQ ID NO: 512074 - protein, 10 aa, Influenza virus
SGLVAGWYGF

SEQ ID NO: 512075 - protein, 10 aa, Influenza virus
SGLVGDTPRD

SEQ ID NO: 512076 - protein, 10 aa, Influenza virus
SGLVGDTPRE

SEQ ID NO: 512077 - protein, 10 aa, Influenza virus
SGLVGDTPRG

SEQ ID NO: 512078 - protein, 10 aa, Influenza virus
SGLVGDTPRK

SEQ ID NO: 512079 - protein, 10 aa, Influenza virus
SGLVGDTPRN

SEQ ID NO: 512080 - protein, 10 aa, Influenza virus
SGLVGDTPRS

SEQ ID NO: 512081 - protein, 10 aa, Influenza virus
SGLVGDTPRT

SEQ ID NO: 512082 - protein, 10 aa, Influenza virus
SGMDPRMCSL

SEQ ID NO: 512083 - protein, 10 aa, Influenza virus
SGMIDGWYGF

SEQ ID NO: 512084 - protein, 10 aa, Influenza virus
SGMSANGDIL

SEQ ID NO: 512085 - protein, 10 aa, Influenza virus
SGNAQHVEEC

SEQ ID NO: 512086 - protein, 10 aa, Influenza virus
SGNCRFNVCI

SEQ ID NO: 512087 - protein, 10 aa, Influenza virus
SGNCRFSVCI

SEQ ID NO: 512088 - protein, 10 aa, Influenza virus
SGNGDPNNMD

SEQ ID NO: 512089 - protein, 10 aa, Influenza virus
SGNLIAPEYG

SEQ ID NO: 512090 - protein, 10 aa, Influenza virus
SGNNQVFPQL

SEQ ID NO: 512091 - protein, 10 aa, Influenza virus
SGNWPDGANI

SEQ ID NO: 512092 - protein, 10 aa, Influenza virus
SGNWPDGSDI

SEQ ID NO: 512093 - protein, 10 aa, Influenza virus
SGNWPDGSNI

SEQ ID NO: 512094 - protein, 10 aa, Influenza virus
SGPDDGAVAV

SEQ ID NO: 512095 - protein, 10 aa, Influenza virus
SGPDNEAVAV

SEQ ID NO: 512096 - protein, 10 aa, Influenza virus
SGPDNGAVAV

SEQ ID NO: 512097 - protein, 10 aa, Influenza virus
SGPDSGAVAV

SEQ ID NO: 512098 - protein, 10 aa, Influenza virus
SGPLKAEIAQ

SEQ ID NO: 512099 - protein, 10 aa, Influenza virus
SGPNDNASAV

SEQ ID NO: 512100 - protein, 10 aa, Influenza virus
SGPNNNASAI

SEQ ID NO: 512101 - protein, 10 aa, Influenza virus
SGPNNNASAV

SEQ ID NO: 512102 - protein, 10 aa, Influenza virus
SGPSFYAEMK

SEQ ID NO: 512103 - protein, 10 aa, Influenza virus
SGQFPVQTDE

SEQ ID NO: 512104 - protein, 10 aa, Influenza virus
SGQLKLATGL

SEQ ID NO: 512105 - protein, 10 aa, Influenza virus
SGQNHGICAV

SEQ ID NO: 512106 - protein, 10 aa, Influenza virus
SGRADTKILF

SEQ ID NO: 512107 - protein, 10 aa, Influenza virus
SGRADTRILF

SEQ ID NO: 512108 - protein, 10 aa, Influenza virus
SGREWSYIVE

SEQ ID NO: 512109 - protein, 10 aa, Influenza virus
SGRIDFHWLI

SEQ ID NO: 512110 - protein, 10 aa, Influenza virus
SGRIDFHWLL

SEQ ID NO: 512111 - protein, 10 aa, Influenza virus
SGRIDFHWLM

SEQ ID NO: 512112 - protein, 10 aa, Influenza virus
SGRIDFHWLV

SEQ ID NO: 512113 - protein, 10 aa, Influenza virus
SGRIFQSGVR

SEQ ID NO: 512114 - protein, 10 aa, Influenza virus
SGRISFYWTI

SEQ ID NO: 512115 - protein, 10 aa, Influenza virus
SGRISIYWTL

SEQ ID NO: 512116 - protein, 10 aa, Influenza virus
SGRLIDFLKD

SEQ ID NO: 512117 - protein, 10 aa, Influenza virus
SGRLMDFLKD

SEQ ID NO: 512118 - protein, 10 aa, Influenza virus
SGRQEKNPAL

SEQ ID NO: 512119 - protein, 10 aa, Influenza virus
SGRQEKNPSL

SEQ ID NO: 512120 - protein, 10 aa, Influenza virus
SGRSSFFRNV

SEQ ID NO: 512121 - protein, 10 aa, Influenza virus
SGRVSFYWTI

SEQ ID NO: 512122 - protein, 10 aa, Influenza virus
SGSAQHIEEC

SEQ ID NO: 512123 - protein, 10 aa, Influenza virus
SGSAQHVEEC

SEQ ID NO: 512124 - protein, 10 aa, Influenza virus
SGSFIDYWAE

SEQ ID NO: 512125 - protein, 10 aa, Influenza virus
SGSFIDYWAK

SEQ ID NO: 512126 - protein, 10 aa, Influenza virus
SGSFIDYWDD

SEQ ID NO: 512127 - protein, 10 aa, Influenza virus
SGSFIDYWDE

SEQ ID NO: 512128 - protein, 10 aa, Influenza virus
SGSFIDYWND

SEQ ID NO: 512129 - protein, 10 aa, Influenza virus
SGSFIQHPEL

SEQ ID NO: 512130 - protein, 10 aa, Influenza virus
SGSFMDYWAE

SEQ ID NO: 512131 - protein, 10 aa, Influenza virus
SGSFPDGAQI

SEQ ID NO: 512132 - protein, 10 aa, Influenza virus
SGSFPDGARI

SEQ ID NO: 512133 - protein, 10 aa, Influenza virus
SGSFPNGAQI

SEQ ID NO: 512134 - protein, 10 aa, Influenza virus
SGSFSIRGET

SEQ ID NO: 512135 - protein, 10 aa, Influenza virus
SGSFSIRWET

SEQ ID NO: 512136 - protein, 10 aa, Influenza virus
SGSFTLPIEL

SEQ ID NO: 512137 - protein, 10 aa, Influenza virus
SGSFTLPVEL

SEQ ID NO: 512138 - protein, 10 aa, Influenza virus
SGSFTLPVEM

SEQ ID NO: 512139 - protein, 10 aa, Influenza virus
SGSFTLPVGL

SEQ ID NO: 512140 - protein, 10 aa, Influenza virus
SGSFVDYWAE

SEQ ID NO: 512141 - protein, 10 aa, Influenza virus
SGSFVQHPEL

SEQ ID NO: 512142 - protein, 10 aa, Influenza virus
SGSFVQHPEM

SEQ ID NO: 512143 - protein, 10 aa, Influenza virus
SGSIISFCGV

SEQ ID NO: 512144 - protein, 10 aa, Influenza virus
SGSLEFIAEQ

SEQ ID NO: 512145 - protein, 10 aa, Influenza virus
SGSLKLAIGL

SEQ ID NO: 512146 - protein, 10 aa, Influenza virus
SGSLKLAIGP

SEQ ID NO: 512147 - protein, 10 aa, Influenza virus
SGSLPDGAQI

SEQ ID NO: 512148 - protein, 10 aa, Influenza virus
SGSLQCRICI

SEQ ID NO: 512149 - protein, 10 aa, Influenza virus
SGSQKQEFKM

SEQ ID NO: 512150 - protein, 10 aa, Influenza virus
SGSSFYAELK

SEQ ID NO: 512151 - protein, 10 aa, Influenza virus
SGSSFYAEMK

SEQ ID NO: 512152 - protein, 10 aa, Influenza virus
SGSSIAFCGV

SEQ ID NO: 512153 - protein, 10 aa, Influenza virus
SGSSISFCGV

SEQ ID NO: 512154 - protein, 10 aa, Influenza virus
SGTCAVVMTD

SEQ ID NO: 512155 - protein, 10 aa, Influenza virus
SGTDNYGVKG

SEQ ID NO: 512156 - protein, 10 aa, Influenza virus
SGTNNYGVKG

SEQ ID NO: 512157 - protein, 10 aa, Influenza virus
SGTSKACNAL

SEQ ID NO: 512158 - protein, 10 aa, Influenza virus
SGTSKACNAS

SEQ ID NO: 512159 - protein, 10 aa, Influenza virus
SGTSKACSAS

SEQ ID NO: 512160 - protein, 10 aa, Influenza virus
SGTYGAGSWP

SEQ ID NO: 512161 - protein, 10 aa, Influenza virus
SGTYGKGSWP

SEQ ID NO: 512162 - protein, 10 aa, Influenza virus
SGTYGSGSWP

SEQ ID NO: 512163 - protein, 10 aa, Influenza virus
SGTYGTGSWP

SEQ ID NO: 512164 - protein, 10 aa, Influenza virus
SGTYGTGTWP

SEQ ID NO: 512165 - protein, 10 aa, Influenza virus
SGVAIALSIL

SEQ ID NO: 512166 - protein, 10 aa, Influenza virus
SGVAIALSVL

SEQ ID NO: 512167 - protein, 10 aa, Influenza virus
SGVESAVLRG

SEQ ID NO: 512168 - protein, 10 aa, Influenza virus
SGVEYNGKSL

SEQ ID NO: 512169 - protein, 10 aa, Influenza virus
SGVFGDNPRP

SEQ ID NO: 512170 - protein, 10 aa, Influenza virus
SGVFGDNPRS

SEQ ID NO: 512171 - protein, 10 aa, Influenza virus
SGVFGDSPRP

SEQ ID NO: 512172 - protein, 10 aa, Influenza virus
SGVFGDTPRP

SEQ ID NO: 512173 - protein, 10 aa, Influenza virus
SGVKLEENST

SEQ ID NO: 512174 - protein, 10 aa, Influenza virus
SGVLGDNPRP

SEQ ID NO: 512175 - protein, 10 aa, Influenza virus
SGVMKTEGTL

SEQ ID NO: 512176 - protein, 10 aa, Influenza virus
SGVNESADMS

SEQ ID NO: 512177 - protein, 10 aa, Influenza virus
SGVNSFSRTE

SEQ ID NO: 512178 - protein, 10 aa, Influenza virus
SGWLLGNPMC

SEQ ID NO: 512179 - protein, 10 aa, Influenza virus
SGWLTLGITG

SEQ ID NO: 512180 - protein, 10 aa, Influenza virus
SGWTTANSKS

SEQ ID NO: 512181 - protein, 10 aa, Influenza virus
SGYAADKAST

SEQ ID NO: 512182 - protein, 10 aa, Influenza virus
SGYAADKESS

SEQ ID NO: 512183 - protein, 10 aa, Influenza virus
SGYAADKEST

SEQ ID NO: 512184 - protein, 10 aa, Influenza virus
SGYAADKKST

SEQ ID NO: 512185 - protein, 10 aa, Influenza virus
SGYAADLKST

SEQ ID NO: 512186 - protein, 10 aa, Influenza virus
SGYAADQEST

SEQ ID NO: 512187 - protein, 10 aa, Influenza virus
SGYAADQKST

SEQ ID NO: 512188 - protein, 10 aa, Influenza virus
SGYAADREST

SEQ ID NO: 512189 - protein, 10 aa, Influenza virus
SGYAADRKST

SEQ ID NO: 512190 - protein, 10 aa, Influenza virus
SGYAANKEST

SEQ ID NO: 512191 - protein, 10 aa, Influenza virus
SGYAQTDCVL

SEQ ID NO: 512192 - protein, 10 aa, Influenza virus
SGYEILKVPN

SEQ ID NO: 512193 - protein, 10 aa, Influenza virus
SGYEMLKVPD

SEQ ID NO: 512194 - protein, 10 aa, Influenza virus
SGYEMLKVPN

SEQ ID NO: 512195 - protein, 10 aa, Influenza virus
SGYETFKVIG

SEQ ID NO: 512196 - protein, 10 aa, Influenza virus
SGYETFRVID

SEQ ID NO: 512197 - protein, 10 aa, Influenza virus
SGYETFRVIG

SEQ ID NO: 512198 - protein, 10 aa, Influenza virus
SGYETFRVIS

SEQ ID NO: 512199 - protein, 10 aa, Influenza virus
SGYETFRVTG

SEQ ID NO: 512200 - protein, 10 aa, Influenza virus
SGYEVLKVPD

SEQ ID NO: 512201 - protein, 10 aa, Influenza virus
SGYEVLKVPN

SEQ ID NO: 512202 - protein, 10 aa, Influenza virus
SGYFGVFSVE

SEQ ID NO: 512203 - protein, 10 aa, Influenza virus
SGYKDIILWF

SEQ ID NO: 512204 - protein, 10 aa, Influenza virus
SGYKDVIIWF

SEQ ID NO: 512205 - protein, 10 aa, Influenza virus
SGYKDVILWF

SEQ ID NO: 512206 - protein, 10 aa, Influenza virus
SGYKEVILWF

SEQ ID NO: 512207 - protein, 10 aa, Influenza virus
SGYSGAFIDY

SEQ ID NO: 512208 - protein, 10 aa, Influenza virus
SGYSGAFMDY

SEQ ID NO: 512209 - protein, 10 aa, Influenza virus
SGYSGAFTIP

SEQ ID NO: 512210 - protein, 10 aa, Influenza virus
SGYSGAFTVP

SEQ ID NO: 512211 - protein, 10 aa, Influenza virus
SGYSGAFVDY

SEQ ID NO: 512212 - protein, 10 aa, Influenza virus
SGYSGIFSIE

SEQ ID NO: 512213 - protein, 10 aa, Influenza virus
SGYSGIFSVE

SEQ ID NO: 512214 - protein, 10 aa, Influenza virus
SGYSGSFIDY

SEQ ID NO: 512215 - protein, 10 aa, Influenza virus
SGYSGSFIQH

SEQ ID NO: 512216 - protein, 10 aa, Influenza virus
SGYSGSFMDY

SEQ ID NO: 512217 - protein, 10 aa, Influenza virus
SGYSGSFSIR

SEQ ID NO: 512218 - protein, 10 aa, Influenza virus
SGYSGSFTIP

SEQ ID NO: 512219 - protein, 10 aa, Influenza virus
SGYSGSFTLP

SEQ ID NO: 512220 - protein, 10 aa, Influenza virus
SGYSGSFVDY

SEQ ID NO: 512221 - protein, 10 aa, Influenza virus
SGYSGSFVQH

SEQ ID NO: 512222 - protein, 10 aa, Influenza virus
SGYSGVFSVE

SEQ ID NO: 512223 - protein, 10 aa, Influenza virus
SGYVCSGLVG

SEQ ID NO: 512224 - protein, 10 aa, Influenza virus
SGYWAIRTRS

SEQ ID NO: 512225 - protein, 10 aa, Influenza virus
SHCRATEYIM

SEQ ID NO: 512226 - protein, 10 aa, Influenza virus
SHCRATEYMM

SEQ ID NO: 512227 - protein, 10 aa, Influenza virus
SHCRIIQNED

SEQ ID NO: 512228 - protein, 10 aa, Influenza virus
SHEGEGIPLC

SEQ ID NO: 512229 - protein, 10 aa, Influenza virus
SHEGEGIPLH

SEQ ID NO: 512230 - protein, 10 aa, Influenza virus
SHEGEGIPLY

SEQ ID NO: 512231 - protein, 10 aa, Influenza virus
SHGKIIQNED

SEQ ID NO: 512232 - protein, 10 aa, Influenza virus
SHGRIIQNED

SEQ ID NO: 512233 - protein, 10 aa, Influenza virus
SHGRILKNDL

SEQ ID NO: 512234 - protein, 10 aa, Influenza virus
SHGRILKNNL

SEQ ID NO: 512235 - protein, 10 aa, Influenza virus
SHGRTIQNED

SEQ ID NO: 512236 - protein, 10 aa, Influenza virus
SHGRVLKNNL

SEQ ID NO: 512237 - protein, 10 aa, Influenza virus
SHGTGTGYTM

SEQ ID NO: 512238 - protein, 10 aa, Influenza virus
SHGVKGWAFD

SEQ ID NO: 512239 - protein, 10 aa, Influenza virus
SHISPLSGSA

SEQ ID NO: 512240 - protein, 10 aa, Influenza virus
SHKICIGYHA

SEQ ID NO: 512241 - protein, 10 aa, Influenza virus
SHLECRTFFL

SEQ ID NO: 512242 - protein, 10 aa, Influenza virus
SHLKFKADLI

SEQ ID NO: 512243 - protein, 10 aa, Influenza virus
SHLRNDTDVV

SEQ ID NO: 512244 - protein, 10 aa, Influenza virus
SHMECRTFFL

SEQ ID NO: 512245 - protein, 10 aa, Influenza virus
SHNGGLIAPD

SEQ ID NO: 512246 - protein, 10 aa, Influenza virus
SHNGGLIAPS

SEQ ID NO: 512247 - protein, 10 aa, Influenza virus
SHNGGLVAPS

SEQ ID NO: 512248 - protein, 10 aa, Influenza virus
SHPGIFENSC

SEQ ID NO: 512249 - protein, 10 aa, Influenza virus
SHPGIFESSC

SEQ ID NO: 512250 - protein, 10 aa, Influenza virus
SHPGIFGNSC

SEQ ID NO: 512251 - protein, 10 aa, Influenza virus
SHPGLFENSC

SEQ ID NO: 512252 - protein, 10 aa, Influenza virus
SHRTLLMNEL

SEQ ID NO: 512253 - protein, 10 aa, Influenza virus
SHSECRTFFL

SEQ ID NO: 512254 - protein, 10 aa, Influenza virus
SHTAYSQITN

SEQ ID NO: 512255 - protein, 10 aa, Influenza virus
SHYEECSCYP

SEQ ID NO: 512256 - protein, 10 aa, Influenza virus
SHYVCSGLVG

SEQ ID NO: 512257 - protein, 10 aa, Influenza virus
SIAASYKRIR

SEQ ID NO: 512258 - protein, 10 aa, Influenza virus
SIADKICIGY

SEQ ID NO: 512259 - protein, 10 aa, Influenza virus
SIAFCGVDSD

SEQ ID NO: 512260 - protein, 10 aa, Influenza virus
SIAFCGVNSD

SEQ ID NO: 512261 - protein, 10 aa, Influenza virus
SIAFCGVNSN

SEQ ID NO: 512262 - protein, 10 aa, Influenza virus
SIAGWLLGNP

SEQ ID NO: 512263 - protein, 10 aa, Influenza virus
SIAHKSCLPA

SEQ ID NO: 512264 - protein, 10 aa, Influenza virus
SIAPIMFSNK

SEQ ID NO: 512265 - protein, 10 aa, Influenza virus
SIASRSGYEI

SEQ ID NO: 512266 - protein, 10 aa, Influenza virus
SIASRSGYEM

SEQ ID NO: 512267 - protein, 10 aa, Influenza virus
SIAVFCGTSG

SEQ ID NO: 512268 - protein, 10 aa, Influenza virus
SIAWSATACH

SEQ ID NO: 512269 - protein, 10 aa, Influenza virus
SICEKLEQSG

SEQ ID NO: 512270 - protein, 10 aa, Influenza virus
SICISGPNNN

SEQ ID NO: 512271 - protein, 10 aa, Influenza virus
SICMSGPNDN

SEQ ID NO: 512272 - protein, 10 aa, Influenza virus
SICMSGPNNN

SEQ ID NO: 512273 - protein, 10 aa, Influenza virus
SICTHLEVCF

SEQ ID NO: 512274 - protein, 10 aa, Influenza virus
SICVSGPNNN

SEQ ID NO: 512275 - protein, 10 aa, Influenza virus
SIDECRTFFL

SEQ ID NO: 512276 - protein, 10 aa, Influenza virus
SIDGKAPISL

SEQ ID NO: 512277 - protein, 10 aa, Influenza virus
SIDLVETNHT

SEQ ID NO: 512278 - protein, 10 aa, Influenza virus
SIDPKGLFGA

SEQ ID NO: 512279 - protein, 10 aa, Influenza virus
SIDRFLRVKD

SEQ ID NO: 512280 - protein, 10 aa, Influenza virus
SIDRFLRVRD

SEQ ID NO: 512281 - protein, 10 aa, Influenza virus
SIDSGYVCSG

SEQ ID NO: 512282 - protein, 10 aa, Influenza virus
SIDSNYVCSG

SEQ ID NO: 512283 - protein, 10 aa, Influenza virus
SIDSSYICSG

SEQ ID NO: 512284 - protein, 10 aa, Influenza virus
SIDSSYVCSG

SEQ ID NO: 512285 - protein, 10 aa, Influenza virus
SIEDPDHEGE

SEQ ID NO: 512286 - protein, 10 aa, Influenza virus
SIEDPNHEGE

SEQ ID NO: 512287 - protein, 10 aa, Influenza virus
SIEDPSHEGE

SEQ ID NO: 512288 - protein, 10 aa, Influenza virus
SIEECLINDP

SEQ ID NO: 512289 - protein, 10 aa, Influenza virus
SIEEPSHEGE

SEQ ID NO: 512290 - protein, 10 aa, Influenza virus
SIENLEELRF

SEQ ID NO: 512291 - protein, 10 aa, Influenza virus
SIENPSHEGE

SEQ ID NO: 512292 - protein, 10 aa, Influenza virus
SIENQEELKS

SEQ ID NO: 512293 - protein, 10 aa, Influenza virus
SIENQEELRF

SEQ ID NO: 512294 - protein, 10 aa, Influenza virus
SIENQEELRS

SEQ ID NO: 512295 - protein, 10 aa, Influenza virus
SIEPKGLFGA

SEQ ID NO: 512296 - protein, 10 aa, Influenza virus
SIEPRGLFGA

SEQ ID NO: 512297 - protein, 10 aa, Influenza virus
SIESEFNEIE

SEQ ID NO: 512298 - protein, 10 aa, Influenza virus
SIESEFSEIE

SEQ ID NO: 512299 - protein, 10 aa, Influenza virus
SIESEFSETE

SEQ ID NO: 512300 - protein, 10 aa, Influenza virus
SIGITVIKNN

SEQ ID NO: 512301 - protein, 10 aa, Influenza virus
SIGKVCRALL

SEQ ID NO: 512302 - protein, 10 aa, Influenza virus
SIGKVCRTLL

SEQ ID NO: 512303 - protein, 10 aa, Influenza virus
SIGNLIAPRG

SEQ ID NO: 512304 - protein, 10 aa, Influenza virus
SIGSSTYQNN

SEQ ID NO: 512305 - protein, 10 aa, Influenza virus
SIGSWSQNIL

SEQ ID NO: 512306 - protein, 10 aa, Influenza virus
SIGTSTLNQR

SEQ ID NO: 512307 - protein, 10 aa, Influenza virus
SIGVAVIKNN

SEQ ID NO: 512308 - protein, 10 aa, Influenza virus
SIGVTVIKNN

SEQ ID NO: 512309 - protein, 10 aa, Influenza virus
SIGVTVIRNN

SEQ ID NO: 512310 - protein, 10 aa, Influenza virus
SIHECRTFFL

SEQ ID NO: 512311 - protein, 10 aa, Influenza virus
SIHSRGLFGA

SEQ ID NO: 512312 - protein, 10 aa, Influenza virus
SIHWTIVKPG

SEQ ID NO: 512313 - protein, 10 aa, Influenza virus
SIIAFCGTSG

SEQ ID NO: 512314 - protein, 10 aa, Influenza virus
SIIALLIGIG

SEQ ID NO: 512315 - protein, 10 aa, Influenza virus
SIIDKMNTQF

SEQ ID NO: 512316 - protein, 10 aa, Influenza virus
SIIEAESSVK

SEQ ID NO: 512317 - protein, 10 aa, Influenza virus
SIIEKMNTQF

SEQ ID NO: 512318 - protein, 10 aa, Influenza virus
SIIFNMERIK

SEQ ID NO: 512319 - protein, 10 aa, Influenza virus
SIIFNSIGNL

SEQ ID NO: 512320 - protein, 10 aa, Influenza virus
SIIGKMNTQF

SEQ ID NO: 512321 - protein, 10 aa, Influenza virus
SIINKMNTQF

SEQ ID NO: 512322 - protein, 10 aa, Influenza virus
SIIPSGPLKA

SEQ ID NO: 512323 - protein, 10 aa, Influenza virus
SIISFCGVNS

SEQ ID NO: 512324 - protein, 10 aa, Influenza virus
SIISMCSSTE

SEQ ID NO: 512325 - protein, 10 aa, Influenza virus
SIITELPFQN

SEQ ID NO: 512326 - protein, 10 aa, Influenza virus
SIITFCGLDN

SEQ ID NO: 512327 - protein, 10 aa, Influenza virus
SIIVFCGTSG

SEQ ID NO: 512328 - protein, 10 aa, Influenza virus
SIKKYERVKM

SEQ ID NO: 512329 - protein, 10 aa, Influenza virus
SIKNQEELRS

SEQ ID NO: 512330 - protein, 10 aa, Influenza virus
SIKRYERVKM

SEQ ID NO: 512331 - protein, 10 aa, Influenza virus
SIKSWRKDIL

SEQ ID NO: 512332 - protein, 10 aa, Influenza virus
SIKSWRRDIL

SEQ ID NO: 512333 - protein, 10 aa, Influenza virus
SIKTKLPFQN

SEQ ID NO: 512334 - protein, 10 aa, Influenza virus
SILANNGKFE

SEQ ID NO: 512335 - protein, 10 aa, Influenza virus
SILANNGRFE

SEQ ID NO: 512336 - protein, 10 aa, Influenza virus
SILASSGSLE

SEQ ID NO: 512337 - protein, 10 aa, Influenza virus
SILHKCNDSC

SEQ ID NO: 512338 - protein, 10 aa, Influenza virus
SILNLLIGIS

SEQ ID NO: 512339 - protein, 10 aa, Influenza virus
SILNTSQRGI

SEQ ID NO: 512340 - protein, 10 aa, Influenza virus
SILNTSQRGV

SEQ ID NO: 512341 - protein, 10 aa, Influenza virus
SILRTQESEC

SEQ ID NO: 512342 - protein, 10 aa, Influenza virus
SILTDSQTAT

SEQ ID NO: 512343 - protein, 10 aa, Influenza virus
SIMSCDSPSN

SEQ ID NO: 512344 - protein, 10 aa, Influenza virus
SINECRTFFL

SEQ ID NO: 512345 - protein, 10 aa, Influenza virus
SINGKAPISL

SEQ ID NO: 512346 - protein, 10 aa, Influenza virus
SINGKQPISL

SEQ ID NO: 512347 - protein, 10 aa, Influenza virus
SINGRAPISL

SEQ ID NO: 512348 - protein, 10 aa, Influenza virus
SINPVKLSSG

SEQ ID NO: 512349 - protein, 10 aa, Influenza virus
SINTKLPFQN

SEQ ID NO: 512350 - protein, 10 aa, Influenza virus
SINTRLPFQN

SEQ ID NO: 512351 - protein, 10 aa, Influenza virus
SINWLTKKEP

SEQ ID NO: 512352 - protein, 10 aa, Influenza virus
SINWLTKKKN

SEQ ID NO: 512353 - protein, 10 aa, Influenza virus
SINWLTKKKP

SEQ ID NO: 512354 - protein, 10 aa, Influenza virus
SIPNDKPFQN

SEQ ID NO: 512355 - protein, 10 aa, Influenza virus
SIPNEKPFQN

SEQ ID NO: 512356 - protein, 10 aa, Influenza virus
SIPNGKPFQN

SEQ ID NO: 512357 - protein, 10 aa, Influenza virus
SIPNNKPFQN

SEQ ID NO: 512358 - protein, 10 aa, Influenza virus
SIQPTFSVQR

SEQ ID NO: 512359 - protein, 10 aa, Influenza virus
SIQSDKPFQN

SEQ ID NO: 512360 - protein, 10 aa, Influenza virus
SIQSKGLFGA

SEQ ID NO: 512361 - protein, 10 aa, Influenza virus
SIQSRGLFGA

SEQ ID NO: 512362 - protein, 10 aa, Influenza virus
SIQTRGLFGA

SEQ ID NO: 512363 - protein, 10 aa, Influenza virus
SIRDNTYDHT

SEQ ID NO: 512364 - protein, 10 aa, Influenza virus
SIRGEFNQVE

SEQ ID NO: 512365 - protein, 10 aa, Influenza virus
SIRGEFSQVE

SEQ ID NO: 512366 - protein, 10 aa, Influenza virus
SIRGETTGRN

SEQ ID NO: 512367 - protein, 10 aa, Influenza virus
SIRIGSKGDI

SEQ ID NO: 512368 - protein, 10 aa, Influenza virus
SIRIGSKGDV

SEQ ID NO: 512369 - protein, 10 aa, Influenza virus
SIRIGSRGDV

SEQ ID NO: 512370 - protein, 10 aa, Influenza virus
SIRLAAGGAI

SEQ ID NO: 512371 - protein, 10 aa, Influenza virus
SIRLAAGGDI

SEQ ID NO: 512372 - protein, 10 aa, Influenza virus
SIRLSADGDI

SEQ ID NO: 512373 - protein, 10 aa, Influenza virus
SIRLSAGGAI

SEQ ID NO: 512374 - protein, 10 aa, Influenza virus
SIRLSAGGDI

SEQ ID NO: 512375 - protein, 10 aa, Influenza virus
SIRLSAGGHI

SEQ ID NO: 512376 - protein, 10 aa, Influenza virus
SIRLSAGGNI

SEQ ID NO: 512377 - protein, 10 aa, Influenza virus
SIRLSASGDV

SEQ ID NO: 512378 - protein, 10 aa, Influenza virus
SIRNETYDHD

SEQ ID NO: 512379 - protein, 10 aa, Influenza virus
SIRNGTYDHD

SEQ ID NO: 512380 - protein, 10 aa, Influenza virus
SIRNGTYDHN

SEQ ID NO: 512381 - protein, 10 aa, Influenza virus
SIRNGTYNHD

SEQ ID NO: 512382 - protein, 10 aa, Influenza virus
SIRNGTYNHN

SEQ ID NO: 512383 - protein, 10 aa, Influenza virus
SIRNNTYDHA

SEQ ID NO: 512384 - protein, 10 aa, Influenza virus
SIRNNTYDHK

SEQ ID NO: 512385 - protein, 10 aa, Influenza virus
SIRNNTYDHN

SEQ ID NO: 512386 - protein, 10 aa, Influenza virus
SIRNNTYDHR

SEQ ID NO: 512387 - protein, 10 aa, Influenza virus
SIRNNTYDHS

SEQ ID NO: 512388 - protein, 10 aa, Influenza virus
SIRNNTYDHT

SEQ ID NO: 512389 - protein, 10 aa, Influenza virus
SIRNNTYNHT

SEQ ID NO: 512390 - protein, 10 aa, Influenza virus
SIRNSTYDHS

SEQ ID NO: 512391 - protein, 10 aa, Influenza virus
SIRWETTGRN

SEQ ID NO: 512392 - protein, 10 aa, Influenza virus
SISCFLLAAL

SEQ ID NO: 512393 - protein, 10 aa, Influenza virus
SISCFLLIAL

SEQ ID NO: 512394 - protein, 10 aa, Influenza virus
SISCFLLVAL

SEQ ID NO: 512395 - protein, 10 aa, Influenza virus
SISCLYKLSQ

SEQ ID NO: 512396 - protein, 10 aa, Influenza virus
SISECRTFFL

SEQ ID NO: 512397 - protein, 10 aa, Influenza virus
SISIGSSTYQ

SEQ ID NO: 512398 - protein, 10 aa, Influenza virus
SISNDKPFQN

SEQ ID NO: 512399 - protein, 10 aa, Influenza virus
SISSWSQNIL

SEQ ID NO: 512400 - protein, 10 aa, Influenza virus
SISVESSTYQ

SEQ ID NO: 512401 - protein, 10 aa, Influenza virus
SISVGSSIYQ

SEQ ID NO: 512402 - protein, 10 aa, Influenza virus
SISVGSSTYQ

SEQ ID NO: 512403 - protein, 10 aa, Influenza virus
SITDIWTYQA

SEQ ID NO: 512404 - protein, 10 aa, Influenza virus
SITELWSYNA

SEQ ID NO: 512405 - protein, 10 aa, Influenza virus
SITEVWSYNA

SEQ ID NO: 512406 - protein, 10 aa, Influenza virus
SITFSHNGGL

SEQ ID NO: 512407 - protein, 10 aa, Influenza virus
SITQTLVSNN

SEQ ID NO: 512408 - protein, 10 aa, Influenza virus
SITQTLVSNS

SEQ ID NO: 512409 - protein, 10 aa, Influenza virus
SITYIWTYQA

SEQ ID NO: 512410 - protein, 10 aa, Influenza virus
SIVAFCGTSG

SEQ ID NO: 512411 - protein, 10 aa, Influenza virus
SIVALCGSKE

SEQ ID NO: 512412 - protein, 10 aa, Influenza virus
SIVALCGSKK

SEQ ID NO: 512413 - protein, 10 aa, Influenza virus
SIVALCGSRE

SEQ ID NO: 512414 - protein, 10 aa, Influenza virus
SIVASSGTLE

SEQ ID NO: 512415 - protein, 10 aa, Influenza virus
SIVASSGTVE

SEQ ID NO: 512416 - protein, 10 aa, Influenza virus
SIVEFCGTSG

SEQ ID NO: 512417 - protein, 10 aa, Influenza virus
SIVLVGLILA

SEQ ID NO: 512418 - protein, 10 aa, Influenza virus
SIVMVGLILA

SEQ ID NO: 512419 - protein, 10 aa, Influenza virus
SIVPNIGSRP

SEQ ID NO: 512420 - protein, 10 aa, Influenza virus
SIVPSGPLKA

SEQ ID NO: 512421 - protein, 10 aa, Influenza virus
SIVRRATVSA

SEQ ID NO: 512422 - protein, 10 aa, Influenza virus
SIVSMCSSTE

SEQ ID NO: 512423 - protein, 10 aa, Influenza virus
SIVSWSQNIL

SEQ ID NO: 512424 - protein, 10 aa, Influenza virus
SIVTFCGLDN

SEQ ID NO: 512425 - protein, 10 aa, Influenza virus
SIVTFCGLNN

SEQ ID NO: 512426 - protein, 10 aa, Influenza virus
SIVVFCGTSA

SEQ ID NO: 512427 - protein, 10 aa, Influenza virus
SIVVFCGTSG

SEQ ID NO: 512428 - protein, 10 aa, Influenza virus
SIWFSHYNQM

SEQ ID NO: 512429 - protein, 10 aa, Influenza virus
SIWFSHYNQV

SEQ ID NO: 512430 - protein, 10 aa, Influenza virus
SIWMCSNGSL

SEQ ID NO: 512431 - protein, 10 aa, Influenza virus
SIWTSSSSTV

SEQ ID NO: 512432 - protein, 10 aa, Influenza virus
SIYASPQLEG

SEQ ID NO: 512433 - protein, 10 aa, Influenza virus
SIYIEVLHLT

SEQ ID NO: 512434 - protein, 10 aa, Influenza virus
SIYSCIASSI

SEQ ID NO: 512435 - protein, 10 aa, Influenza virus
SIYSCIASSL

SEQ ID NO: 512436 - protein, 10 aa, Influenza virus
SIYSCIASST

SEQ ID NO: 512437 - protein, 10 aa, Influenza virus
SIYSCIASSV

SEQ ID NO: 512438 - protein, 10 aa, Influenza virus
SIYSCVASSL

SEQ ID NO: 512439 - protein, 10 aa, Influenza virus
SIYSSVASSL

SEQ ID NO: 512440 - protein, 10 aa, Influenza virus
SIYSTAASSL

SEQ ID NO: 512441 - protein, 10 aa, Influenza virus
SIYSTVAASL

SEQ ID NO: 512442 - protein, 10 aa, Influenza virus
SIYSTVASSL

SEQ ID NO: 512443 - protein, 10 aa, Influenza virus
SIYSTVSSSL

SEQ ID NO: 512444 - protein, 10 aa, Influenza virus
SIYSTVTSSL

SEQ ID NO: 512445 - protein, 10 aa, Influenza virus
SIYSTVVSSL

SEQ ID NO: 512446 - protein, 10 aa, Influenza virus
SIYWTIVKPG

SEQ ID NO: 512447 - protein, 10 aa, Influenza virus
SIYWTLVNPG

SEQ ID NO: 512448 - protein, 10 aa, Influenza virus
SIYWTVVKPG

SEQ ID NO: 512449 - protein, 10 aa, Influenza virus
SKACNALTGG

SEQ ID NO: 512450 - protein, 10 aa, Influenza virus
SKACNASTGA

SEQ ID NO: 512451 - protein, 10 aa, Influenza virus
SKACNASTGG

SEQ ID NO: 512452 - protein, 10 aa, Influenza virus
SKACSASTGG

SEQ ID NO: 512453 - protein, 10 aa, Influenza virus
SKADKICIGY

SEQ ID NO: 512454 - protein, 10 aa, Influenza virus
SKANQVFPQL

SEQ ID NO: 512455 - protein, 10 aa, Influenza virus
SKCFWKGGSI

SEQ ID NO: 512456 - protein, 10 aa, Influenza virus
SKCFWREGSI

SEQ ID NO: 512457 - protein, 10 aa, Influenza virus
SKCFWRGGSI

SEQ ID NO: 512458 - protein, 10 aa, Influenza virus
SKCITPNGSI

SEQ ID NO: 512459 - protein, 10 aa, Influenza virus
SKCKTKEGRR

SEQ ID NO: 512460 - protein, 10 aa, Influenza virus
SKCQQSFTPS

SEQ ID NO: 512461 - protein, 10 aa, Influenza virus
SKCRTKEGRR

SEQ ID NO: 512462 - protein, 10 aa, Influenza virus
SKCRTREGRR

SEQ ID NO: 512463 - protein, 10 aa, Influenza virus
SKCYNPCFYV

SEQ ID NO: 512464 - protein, 10 aa, Influenza virus
SKCYQFALGQ

SEQ ID NO: 512465 - protein, 10 aa, Influenza virus
SKDNAIRIGE

SEQ ID NO: 512466 - protein, 10 aa, Influenza virus
SKDNGIRIGS

SEQ ID NO: 512467 - protein, 10 aa, Influenza virus
SKDNGIRVGS

SEQ ID NO: 512468 - protein, 10 aa, Influenza virus
SKDNNIRIGS

SEQ ID NO: 512469 - protein, 10 aa, Influenza virus
SKDNQVFPQL

SEQ ID NO: 512470 - protein, 10 aa, Influenza virus
SKDNSIQLSA

SEQ ID NO: 512471 - protein, 10 aa, Influenza virus
SKDNSIRIGS

SEQ ID NO: 512472 - protein, 10 aa, Influenza virus
SKDNSIRLAA

SEQ ID NO: 512473 - protein, 10 aa, Influenza virus
SKDNSIRLSA

SEQ ID NO: 512474 - protein, 10 aa, Influenza virus
SKDNSVRIGS

SEQ ID NO: 512475 - protein, 10 aa, Influenza virus
SKDNSVRLSA

SEQ ID NO: 512476 - protein, 10 aa, Influenza virus
SKDSRSGYET

SEQ ID NO: 512477 - protein, 10 aa, Influenza virus
SKEAQDVIME

SEQ ID NO: 512478 - protein, 10 aa, Influenza virus
SKEGSYFFGD

SEQ ID NO: 512479 - protein, 10 aa, Influenza virus
SKEQGSGYAA

SEQ ID NO: 512480 - protein, 10 aa, Influenza virus
SKEQLGSWSW

SEQ ID NO: 512481 - protein, 10 aa, Influenza virus
SKERLGSWSW

SEQ ID NO: 512482 - protein, 10 aa, Influenza virus
SKFESVAWSA

SEQ ID NO: 512483 - protein, 10 aa, Influenza virus
SKFHSDTPRP

SEQ ID NO: 512484 - protein, 10 aa, Influenza virus
SKFLLMDALK

SEQ ID NO: 512485 - protein, 10 aa, Influenza virus
SKFLLMDSLK

SEQ ID NO: 512486 - protein, 10 aa, Influenza virus
SKGDIFVIRE

SEQ ID NO: 512487 - protein, 10 aa, Influenza virus
SKGDIFVMRE

SEQ ID NO: 512488 - protein, 10 aa, Influenza virus
SKGDVFVIRE

SEQ ID NO: 512489 - protein, 10 aa, Influenza virus
SKGDVFVMRE

SEQ ID NO: 512490 - protein, 10 aa, Influenza virus
SKGHVFVIRE

SEQ ID NO: 512491 - protein, 10 aa, Influenza virus
SKGLFGAIAG

SEQ ID NO: 512492 - protein, 10 aa, Influenza virus
SKGSSKQQHK

SEQ ID NO: 512493 - protein, 10 aa, Influenza virus
SKHYIGKCPK

SEQ ID NO: 512494 - protein, 10 aa, Influenza virus
SKHYIGKCPR

SEQ ID NO: 512495 - protein, 10 aa, Influenza virus
SKIKMKWGME

SEQ ID NO: 512496 - protein, 10 aa, Influenza virus
SKILTDTSRP

SEQ ID NO: 512497 - protein, 10 aa, Influenza virus
SKINEVKLEE

SEQ ID NO: 512498 - protein, 10 aa, Influenza virus
SKINGVILEE

SEQ ID NO: 512499 - protein, 10 aa, Influenza virus
SKINGVKLEE

SEQ ID NO: 512500 - protein, 10 aa, Influenza virus
SKINGVRLEE

SEQ ID NO: 512501 - protein, 10 aa, Influenza virus
SKINRQEIEG

SEQ ID NO: 512502 - protein, 10 aa, Influenza virus
SKITLKFAFN

SEQ ID NO: 512503 - protein, 10 aa, Influenza virus
SKKKSYINKT

SEQ ID NO: 512504 - protein, 10 aa, Influenza virus
SKKKSYINRT

SEQ ID NO: 512505 - protein, 10 aa, Influenza virus
SKKRLGSWSW

SEQ ID NO: 512506 - protein, 10 aa, Influenza virus
SKLKRNEIKG

SEQ ID NO: 512507 - protein, 10 aa, Influenza virus
SKLKRQEIDG

SEQ ID NO: 512508 - protein, 10 aa, Influenza virus
SKLKRQEIEG

SEQ ID NO: 512509 - protein, 10 aa, Influenza virus
SKLKRQEING

SEQ ID NO: 512510 - protein, 10 aa, Influenza virus
SKLNRNEIKG

SEQ ID NO: 512511 - protein, 10 aa, Influenza virus
SKLNRQEIEG

SEQ ID NO: 512512 - protein, 10 aa, Influenza virus
SKLNRQEIGG

SEQ ID NO: 512513 - protein, 10 aa, Influenza virus
SKLNRSEIKG

SEQ ID NO: 512514 - protein, 10 aa, Influenza virus
SKLNRTEIKG

SEQ ID NO: 512515 - protein, 10 aa, Influenza virus
SKMGVDEYSN

SEQ ID NO: 512516 - protein, 10 aa, Influenza virus
SKMGVDEYSS

SEQ ID NO: 512517 - protein, 10 aa, Influenza virus
SKMQFSSLTV

SEQ ID NO: 512518 - protein, 10 aa, Influenza virus
SKNILRTQES

SEQ ID NO: 512519 - protein, 10 aa, Influenza virus
SKNPYTLVST

SEQ ID NO: 512520 - protein, 10 aa, Influenza virus
SKNSRSGYET

SEQ ID NO: 512521 - protein, 10 aa, Influenza virus
SKPFQNASRH

SEQ ID NO: 512522 - protein, 10 aa, Influenza virus
SKPFQNASRY

SEQ ID NO: 512523 - protein, 10 aa, Influenza virus
SKPFQNICKP

SEQ ID NO: 512524 - protein, 10 aa, Influenza virus
SKPFQNTSKH

SEQ ID NO: 512525 - protein, 10 aa, Influenza virus
SKPFQNTSRH

SEQ ID NO: 512526 - protein, 10 aa, Influenza virus
SKPLQNASRH

SEQ ID NO: 512527 - protein, 10 aa, Influenza virus
SKPLQNTSKH

SEQ ID NO: 512528 - protein, 10 aa, Influenza virus
SKPQCHITGF

SEQ ID NO: 512529 - protein, 10 aa, Influenza virus
SKPQCKITGF

SEQ ID NO: 512530 - protein, 10 aa, Influenza virus
SKPQCLITGF

SEQ ID NO: 512531 - protein, 10 aa, Influenza virus
SKPQCQIAGF

SEQ ID NO: 512532 - protein, 10 aa, Influenza virus
SKPQCQITGF

SEQ ID NO: 512533 - protein, 10 aa, Influenza virus
SKPQCQITGS

SEQ ID NO: 512534 - protein, 10 aa, Influenza virus
SKRGGSGIMK

SEQ ID NO: 512535 - protein, 10 aa, Influenza virus
SKRGNSGIMK

SEQ ID NO: 512536 - protein, 10 aa, Influenza virus
SKRGSSGIMK

SEQ ID NO: 512537 - protein, 10 aa, Influenza virus
SKRGSSGIVK

SEQ ID NO: 512538 - protein, 10 aa, Influenza virus
SKRGSSGVMK

SEQ ID NO: 512539 - protein, 10 aa, Influenza virus
SKRKSYINKT

SEQ ID NO: 512540 - protein, 10 aa, Influenza virus
SKRYELEIGA

SEQ ID NO: 512541 - protein, 10 aa, Influenza virus
SKRYELEIGT

SEQ ID NO: 512542 - protein, 10 aa, Influenza virus
SKSLCKVEGW

SEQ ID NO: 512543 - protein, 10 aa, Influenza virus
SKSRGYKMNI

SEQ ID NO: 512544 - protein, 10 aa, Influenza virus
SKSRGYKMNN

SEQ ID NO: 512545 - protein, 10 aa, Influenza virus
SKSRGYKMNT

SEQ ID NO: 512546 - protein, 10 aa, Influenza virus
SKSRSIIFNM

SEQ ID NO: 512547 - protein, 10 aa, Influenza virus
SKSRSNIFNM

SEQ ID NO: 512548 - protein, 10 aa, Influenza virus
SKSRVDNHSM

SEQ ID NO: 512549 - protein, 10 aa, Influenza virus
SKSTKSTVLK

SEQ ID NO: 512550 - protein, 10 aa, Influenza virus
SKTGVDEYSS

SEQ ID NO: 512551 - protein, 10 aa, Influenza virus
SKTLTDTSRP

SEQ ID NO: 512552 - protein, 10 aa, Influenza virus
SKTNQQFELI

SEQ ID NO: 512553 - protein, 10 aa, Influenza virus
SKTQCQITGF

SEQ ID NO: 512554 - protein, 10 aa, Influenza virus
SKVGVDEYSS

SEQ ID NO: 512555 - protein, 10 aa, Influenza virus
SKVKMKWGME

SEQ ID NO: 512556 - protein, 10 aa, Influenza virus
SKVLTDTSRP

SEQ ID NO: 512557 - protein, 10 aa, Influenza virus
SKVTCICRDN

SEQ ID NO: 512558 - protein, 10 aa, Influenza virus
SKVTCVCRDN

SEQ ID NO: 512559 - protein, 10 aa, Influenza virus
SKWGDILEGT

SEQ ID NO: 512560 - protein, 10 aa, Influenza virus
SKWGDVLDGV

SEQ ID NO: 512561 - protein, 10 aa, Influenza virus
SKWGNVLDGV

SEQ ID NO: 512562 - protein, 10 aa, Influenza virus
SKWNVTYTGT

SEQ ID NO: 512563 - protein, 10 aa, Influenza virus
SKYEEESKLN

SEQ ID NO: 512564 - protein, 10 aa, Influenza virus
SKYHWNLALD

SEQ ID NO: 512565 - protein, 10 aa, Influenza virus
SKYLQSFTPS

SEQ ID NO: 512566 - protein, 10 aa, Influenza virus
SKYQQSFSPS

SEQ ID NO: 512567 - protein, 10 aa, Influenza virus
SKYQQSFTPS

SEQ ID NO: 512568 - protein, 10 aa, Influenza virus
SKYRQSFSPS

SEQ ID NO: 512569 - protein, 10 aa, Influenza virus
SKYWAIRTRS

SEQ ID NO: 512570 - protein, 10 aa, Influenza virus
SLAIMIAGIF

SEQ ID NO: 512571 - protein, 10 aa, Influenza virus
SLAIMIAGIS

SEQ ID NO: 512572 - protein, 10 aa, Influenza virus
SLAIMMAGIF

SEQ ID NO: 512573 - protein, 10 aa, Influenza virus
SLAIMMAGIS

SEQ ID NO: 512574 - protein, 10 aa, Influenza virus
SLAIMVAGIS

SEQ ID NO: 512575 - protein, 10 aa, Influenza virus
SLAVNVRGSG

SEQ ID NO: 512576 - protein, 10 aa, Influenza virus
SLCEVNSWHI

SEQ ID NO: 512577 - protein, 10 aa, Influenza virus
SLCKIEGWVV

SEQ ID NO: 512578 - protein, 10 aa, Influenza virus
SLCKVEEWVV

SEQ ID NO: 512579 - protein, 10 aa, Influenza virus
SLCKVEGWVV

SEQ ID NO: 512580 - protein, 10 aa, Influenza virus
SLCLAILIAG

SEQ ID NO: 512581 - protein, 10 aa, Influenza virus
SLCLAILVAG

SEQ ID NO: 512582 - protein, 10 aa, Influenza virus
SLCLAVLIAG

SEQ ID NO: 512583 - protein, 10 aa, Influenza virus
SLCNVEGWVV

SEQ ID NO: 512584 - protein, 10 aa, Influenza virus
SLCSIWFSHY

SEQ ID NO: 512585 - protein, 10 aa, Influenza virus
SLCSVEGWVV

SEQ ID NO: 512586 - protein, 10 aa, Influenza virus
SLDEQNKLYG

SEQ ID NO: 512587 - protein, 10 aa, Influenza virus
SLDGKAPISL

SEQ ID NO: 512588 - protein, 10 aa, Influenza virus
SLDKICLGHH

SEQ ID NO: 512589 - protein, 10 aa, Influenza virus
SLEFIAEQFT

SEQ ID NO: 512590 - protein, 10 aa, Influenza virus
SLEGIILGNP

SEQ ID NO: 512591 - protein, 10 aa, Influenza virus
SLEGLILGNP

SEQ ID NO: 512592 - protein, 10 aa, Influenza virus
SLEGLILSNP

SEQ ID NO: 512593 - protein, 10 aa, Influenza virus
SLEGLVLGNP

SEQ ID NO: 512594 - protein, 10 aa, Influenza virus
SLERRLENLN

SEQ ID NO: 512595 - protein, 10 aa, Influenza virus
SLESRRGFEM

SEQ ID NO: 512596 - protein, 10 aa, Influenza virus
SLESRSGFEM

SEQ ID NO: 512597 - protein, 10 aa, Influenza virus
SLFEKFFPSS

SEQ ID NO: 512598 - protein, 10 aa, Influenza virus
SLFSSIKKYE

SEQ ID NO: 512599 - protein, 10 aa, Influenza virus
SLFSSIKRYE

SEQ ID NO: 512600 - protein, 10 aa, Influenza virus
SLGAISFWMC

SEQ ID NO: 512601 - protein, 10 aa, Influenza virus
SLGAVSFWMC

SEQ ID NO: 512602 - protein, 10 aa, Influenza virus
SLGDCSFAGW

SEQ ID NO: 512603 - protein, 10 aa, Influenza virus
SLGGCSFAGW

SEQ ID NO: 512604 - protein, 10 aa, Influenza virus
SLGIQSDAQI

SEQ ID NO: 512605 - protein, 10 aa, Influenza virus
SLIALCGSPF

SEQ ID NO: 512606 - protein, 10 aa, Influenza virus
SLIALCGSPI

SEQ ID NO: 512607 - protein, 10 aa, Influenza virus
SLIALCGSPV

SEQ ID NO: 512608 - protein, 10 aa, Influenza virus
SLIASSGTLE

SEQ ID NO: 512609 - protein, 10 aa, Influenza virus
SLIIAARNIV

SEQ ID NO: 512610 - protein, 10 aa, Influenza virus
SLIIAARSIV

SEQ ID NO: 512611 - protein, 10 aa, Influenza virus
SLILAAIIMG

SEQ ID NO: 512612 - protein, 10 aa, Influenza virus
SLIMRTVIAL

SEQ ID NO: 512613 - protein, 10 aa, Influenza virus
SLIQFPIGTA

SEQ ID NO: 512614 - protein, 10 aa, Influenza virus
SLIQFPMGTA

SEQ ID NO: 512615 - protein, 10 aa, Influenza virus
SLIRFPIGTA

SEQ ID NO: 512616 - protein, 10 aa, Influenza virus
SLIRFPIGVA

SEQ ID NO: 512617 - protein, 10 aa, Influenza virus
SLIRFPVGTA

SEQ ID NO: 512618 - protein, 10 aa, Influenza virus
SLISWPLSSP

SEQ ID NO: 512619 - protein, 10 aa, Influenza virus
SLIWLWLVLR

SEQ ID NO: 512620 - protein, 10 aa, Influenza virus
SLKGLILGNP

SEQ ID NO: 512621 - protein, 10 aa, Influenza virus
SLKLAIGLRN

SEQ ID NO: 512622 - protein, 10 aa, Influenza virus
SLKLAIGPRN

SEQ ID NO: 512623 - protein, 10 aa, Influenza virus
SLKLASGLRN

SEQ ID NO: 512624 - protein, 10 aa, Influenza virus
SLKLATGLRN

SEQ ID NO: 512625 - protein, 10 aa, Influenza virus
SLKLATGMRN

SEQ ID NO: 512626 - protein, 10 aa, Influenza virus
SLKLATGPRN

SEQ ID NO: 512627 - protein, 10 aa, Influenza virus
SLKLAVGLKN

SEQ ID NO: 512628 - protein, 10 aa, Influenza virus
SLKLAVGLRN

SEQ ID NO: 512629 - protein, 10 aa, Influenza virus
SLKLAVGMRN

SEQ ID NO: 512630 - protein, 10 aa, Influenza virus
SLKLAVGPRN

SEQ ID NO: 512631 - protein, 10 aa, Influenza virus
SLLEMCHGTQ

SEQ ID NO: 512632 - protein, 10 aa, Influenza virus
SLLEMCHSTQ

SEQ ID NO: 512633 - protein, 10 aa, Influenza virus
SLLEMCHSTR

SEQ ID NO: 512634 - protein, 10 aa, Influenza virus
SLLHKCNDSC

SEQ ID NO: 512635 - protein, 10 aa, Influenza virus
SLLLATGMKN

SEQ ID NO: 512636 - protein, 10 aa, Influenza virus
SLLLATGMRN

SEQ ID NO: 512637 - protein, 10 aa, Influenza virus
SLLLLQANLC

SEQ ID NO: 512638 - protein, 10 aa, Influenza virus
SLLLQANLCR

SEQ ID NO: 512639 - protein, 10 aa, Influenza virus
SLLNDKHSNG

SEQ ID NO: 512640 - protein, 10 aa, Influenza virus
SLLNDKHSSG

SEQ ID NO: 512641 - protein, 10 aa, Influenza virus
SLLNDRHSNG

SEQ ID NO: 512642 - protein, 10 aa, Influenza virus
SLLNRLSINP

SEQ ID NO: 512643 - protein, 10 aa, Influenza virus
SLLQSAILSL

SEQ ID NO: 512644 - protein, 10 aa, Influenza virus
SLLTEVETYV

SEQ ID NO: 512645 - protein, 10 aa, Influenza virus
SLMLATGMKN

SEQ ID NO: 512646 - protein, 10 aa, Influenza virus
SLMLATGMRN

SEQ ID NO: 512647 - protein, 10 aa, Influenza virus
SLMQGSTLPR

SEQ ID NO: 512648 - protein, 10 aa, Influenza virus
SLMWEINGPE

SEQ ID NO: 512649 - protein, 10 aa, Influenza virus
SLNGISPIHL

SEQ ID NO: 512650 - protein, 10 aa, Influenza virus
SLNGISPVHL

SEQ ID NO: 512651 - protein, 10 aa, Influenza virus
SLNGVSPIHL

SEQ ID NO: 512652 - protein, 10 aa, Influenza virus
SLNGVSPVHL

SEQ ID NO: 512653 - protein, 10 aa, Influenza virus
SLNITAASLN

SEQ ID NO: 512654 - protein, 10 aa, Influenza virus
SLNKKMEDGF

SEQ ID NO: 512655 - protein, 10 aa, Influenza virus
SLPDLYDYKE

SEQ ID NO: 512656 - protein, 10 aa, Influenza virus
SLPFQNINPR

SEQ ID NO: 512657 - protein, 10 aa, Influenza virus
SLPFQNINSR

SEQ ID NO: 512658 - protein, 10 aa, Influenza virus
SLPLALGMKN

SEQ ID NO: 512659 - protein, 10 aa, Influenza virus
SLPLCPFKGF

SEQ ID NO: 512660 - protein, 10 aa, Influenza virus
SLPLCPFQGF

SEQ ID NO: 512661 - protein, 10 aa, Influenza virus
SLPLCPFRGF

SEQ ID NO: 512662 - protein, 10 aa, Influenza virus
SLPNDKHSNG

SEQ ID NO: 512663 - protein, 10 aa, Influenza virus
SLQNRIQIDP

SEQ ID NO: 512664 - protein, 10 aa, Influenza virus
SLQNRIQIDQ

SEQ ID NO: 512665 - protein, 10 aa, Influenza virus
SLQNRIQIDS

SEQ ID NO: 512666 - protein, 10 aa, Influenza virus
SLQQIESIIE

SEQ ID NO: 512667 - protein, 10 aa, Influenza virus
SLQQIESMIE

SEQ ID NO: 512668 - protein, 10 aa, Influenza virus
SLQQIESMVE

SEQ ID NO: 512669 - protein, 10 aa, Influenza virus
SLRGRGSTLG

SEQ ID NO: 512670 - protein, 10 aa, Influenza virus
SLRLAIGLRN

SEQ ID NO: 512671 - protein, 10 aa, Influenza virus
SLRLALGLRN

SEQ ID NO: 512672 - protein, 10 aa, Influenza virus
SLRLATGLRN

SEQ ID NO: 512673 - protein, 10 aa, Influenza virus
SLRLAVGLRN

SEQ ID NO: 512674 - protein, 10 aa, Influenza virus
SLRMKWMMAM

SEQ ID NO: 512675 - protein, 10 aa, Influenza virus
SLRSILANNG

SEQ ID NO: 512676 - protein, 10 aa, Influenza virus
SLRSILASSG

SEQ ID NO: 512677 - protein, 10 aa, Influenza virus
SLRSIVASSG

SEQ ID NO: 512678 - protein, 10 aa, Influenza virus
SLRSLIASSG

SEQ ID NO: 512679 - protein, 10 aa, Influenza virus
SLRSLVASSG

SEQ ID NO: 512680 - protein, 10 aa, Influenza virus
SLSISIGSST

SEQ ID NO: 512681 - protein, 10 aa, Influenza virus
SLSISVESST

SEQ ID NO: 512682 - protein, 10 aa, Influenza virus
SLSISVGSST

SEQ ID NO: 512683 - protein, 10 aa, Influenza virus
SLSLAIMIAG

SEQ ID NO: 512684 - protein, 10 aa, Influenza virus
SLSLAIMMAG

SEQ ID NO: 512685 - protein, 10 aa, Influenza virus
SLSLAIMVAG

SEQ ID NO: 512686 - protein, 10 aa, Influenza virus
SLSPGMMMGM

SEQ ID NO: 512687 - protein, 10 aa, Influenza virus
SLSRTREILT

SEQ ID NO: 512688 - protein, 10 aa, Influenza virus
SLSYSAGALA

SEQ ID NO: 512689 - protein, 10 aa, Influenza virus
SLSYSTGALA

SEQ ID NO: 512690 - protein, 10 aa, Influenza virus
SLTEIWSYNA

SEQ ID NO: 512691 - protein, 10 aa, Influenza virus
SLTHALRELW

SEQ ID NO: 512692 - protein, 10 aa, Influenza virus
SLTKGVLGFV

SEQ ID NO: 512693 - protein, 10 aa, Influenza virus
SLTQTLVSNN

SEQ ID NO: 512694 - protein, 10 aa, Influenza virus
SLTSLPFQNI

SEQ ID NO: 512695 - protein, 10 aa, Influenza virus
SLTVNVRGSG

SEQ ID NO: 512696 - protein, 10 aa, Influenza virus
SLTVNVRGTG

SEQ ID NO: 512697 - protein, 10 aa, Influenza virus
SLTVSVRGSG

SEQ ID NO: 512698 - protein, 10 aa, Influenza virus
SLVALCGSPI

SEQ ID NO: 512699 - protein, 10 aa, Influenza virus
SLVALCGSPV

SEQ ID NO: 512700 - protein, 10 aa, Influenza virus
SLVASSGNLE

SEQ ID NO: 512701 - protein, 10 aa, Influenza virus
SLVASSGTLE

SEQ ID NO: 512702 - protein, 10 aa, Influenza virus
SLVGIDPFKL

SEQ ID NO: 512703 - protein, 10 aa, Influenza virus
SLVGIDPFRL

SEQ ID NO: 512704 - protein, 10 aa, Influenza virus
SLVGVDPFKL

SEQ ID NO: 512705 - protein, 10 aa, Influenza virus
SLVGVDPFRL

SEQ ID NO: 512706 - protein, 10 aa, Influenza virus
SLVIAARNIV

SEQ ID NO: 512707 - protein, 10 aa, Influenza virus
SLVLAAIIMG

SEQ ID NO: 512708 - protein, 10 aa, Influenza virus
SLVLAALIMG

SEQ ID NO: 512709 - protein, 10 aa, Influenza virus
SLVLAALNMG

SEQ ID NO: 512710 - protein, 10 aa, Influenza virus
SLVLAASIMG

SEQ ID NO: 512711 - protein, 10 aa, Influenza virus
SLVLIVSLGA

SEQ ID NO: 512712 - protein, 10 aa, Influenza virus
SLVLLFMIIG

SEQ ID NO: 512713 - protein, 10 aa, Influenza virus
SLVLLLMIIG

SEQ ID NO: 512714 - protein, 10 aa, Influenza virus
SLVLLVSLGA

SEQ ID NO: 512715 - protein, 10 aa, Influenza virus
SLVLVVSLGA

SEQ ID NO: 512716 - protein, 10 aa, Influenza virus
SLWDSFRQSE

SEQ ID NO: 512717 - protein, 10 aa, Influenza virus
SLWMCSNGSL

SEQ ID NO: 512718 - protein, 10 aa, Influenza virus
SLWMCSNGSY

SEQ ID NO: 512719 - protein, 10 aa, Influenza virus
SLYASPQLEG

SEQ ID NO: 512720 - protein, 10 aa, Influenza virus
SLYASSQLEG

SEQ ID NO: 512721 - protein, 10 aa, Influenza virus
SLYDKVRMQL

SEQ ID NO: 512722 - protein, 10 aa, Influenza virus
SLYSSPQLEG

SEQ ID NO: 512723 - protein, 10 aa, Influenza virus
SMAPIMFSNK

SEQ ID NO: 512724 - protein, 10 aa, Influenza virus
SMCSSTEFLG

SEQ ID NO: 512725 - protein, 10 aa, Influenza virus
SMDSRSGYET

SEQ ID NO: 512726 - protein, 10 aa, Influenza virus
SMEFSLTDPK

SEQ ID NO: 512727 - protein, 10 aa, Influenza virus
SMEFSLTDPR

SEQ ID NO: 512728 - protein, 10 aa, Influenza virus
SMELPSFGVS

SEQ ID NO: 512729 - protein, 10 aa, Influenza virus
SMFLYVRTNG

SEQ ID NO: 512730 - protein, 10 aa, Influenza virus
SMGEAMVSRA

SEQ ID NO: 512731 - protein, 10 aa, Influenza virus
SMGFRYSGIR

SEQ ID NO: 512732 - protein, 10 aa, Influenza virus
SMGIYQILAI

SEQ ID NO: 512733 - protein, 10 aa, Influenza virus
SMGVYQILAI

SEQ ID NO: 512734 - protein, 10 aa, Influenza virus
SMIEAESSIK

SEQ ID NO: 512735 - protein, 10 aa, Influenza virus
SMIEAESSVK

SEQ ID NO: 512736 - protein, 10 aa, Influenza virus
SMIEAESSVR

SEQ ID NO: 512737 - protein, 10 aa, Influenza virus
SMMEAMVSRA

SEQ ID NO: 512738 - protein, 10 aa, Influenza virus
SMMWEINGPD

SEQ ID NO: 512739 - protein, 10 aa, Influenza virus
SMMWEINGPE

SEQ ID NO: 512740 - protein, 10 aa, Influenza virus
SMMWEVNGPE

SEQ ID NO: 512741 - protein, 10 aa, Influenza virus
SMNNQVFPQL

SEQ ID NO: 512742 - protein, 10 aa, Influenza virus
SMPFHNIHPL

SEQ ID NO: 512743 - protein, 10 aa, Influenza virus
SMPFHNVHPL

SEQ ID NO: 512744 - protein, 10 aa, Influenza virus
SMPLHNIHPL

SEQ ID NO: 512745 - protein, 10 aa, Influenza virus
SMQCRICIGS

SEQ ID NO: 512746 - protein, 10 aa, Influenza virus
SMSCFVFVAL

SEQ ID NO: 512747 - protein, 10 aa, Influenza virus
SMSDIEAMAS

SEQ ID NO: 512748 - protein, 10 aa, Influenza virus
SMSGFRSNLP

SEQ ID NO: 512749 - protein, 10 aa, Influenza virus
SMTEIWSYNA

SEQ ID NO: 512750 - protein, 10 aa, Influenza virus
SMTEVWSYNA

SEQ ID NO: 512751 - protein, 10 aa, Influenza virus
SMVEAESSVK

SEQ ID NO: 512752 - protein, 10 aa, Influenza virus
SMVEAMISRA

SEQ ID NO: 512753 - protein, 10 aa, Influenza virus
SMVEAMMSRA

SEQ ID NO: 512754 - protein, 10 aa, Influenza virus
SMVEAMVSRA

SEQ ID NO: 512755 - protein, 10 aa, Influenza virus
SMVKSDKICL

SEQ ID NO: 512756 - protein, 10 aa, Influenza virus
SMVRSDKICL

SEQ ID NO: 512757 - protein, 10 aa, Influenza virus
SMVTFCGLDN

SEQ ID NO: 512758 - protein, 10 aa, Influenza virus
SNAASYKRIR

SEQ ID NO: 512759 - protein, 10 aa, Influenza virus
SNAEGTGMAA

SEQ ID NO: 512760 - protein, 10 aa, Influenza virus
SNAIDEGDGC

SEQ ID NO: 512761 - protein, 10 aa, Influenza virus
SNAITRSGQN

SEQ ID NO: 512762 - protein, 10 aa, Influenza virus
SNALLKHRFE

SEQ ID NO: 512763 - protein, 10 aa, Influenza virus
SNAPSGIEYN

SEQ ID NO: 512764 - protein, 10 aa, Influenza virus
SNAPSGVEYN

SEQ ID NO: 512765 - protein, 10 aa, Influenza virus
SNAQAFYKIL

SEQ ID NO: 512766 - protein, 10 aa, Influenza virus
SNAYQAKFES

SEQ ID NO: 512767 - protein, 10 aa, Influenza virus
SNCKDPNNER

SEQ ID NO: 512768 - protein, 10 aa, Influenza virus
SNCRDPNNEK

SEQ ID NO: 512769 - protein, 10 aa, Influenza virus
SNCRDPNNER

SEQ ID NO: 512770 - protein, 10 aa, Influenza virus
SNCRDPNNES

SEQ ID NO: 512771 - protein, 10 aa, Influenza virus
SNCRDSNNER

SEQ ID NO: 512772 - protein, 10 aa, Influenza virus
SNCRNPNNEK

SEQ ID NO: 512773 - protein, 10 aa, Influenza virus
SNCRNPNNER

SEQ ID NO: 512774 - protein, 10 aa, Influenza virus
SNDKPFQNVN

SEQ ID NO: 512775 - protein, 10 aa, Influenza virus
SNDNWSGYSG

SEQ ID NO: 512776 - protein, 10 aa, Influenza virus
SNDQGAGYAA

SEQ ID NO: 512777 - protein, 10 aa, Influenza virus
SNDQGSGYAA

SEQ ID NO: 512778 - protein, 10 aa, Influenza virus
SNDTINYYNE

SEQ ID NO: 512779 - protein, 10 aa, Influenza virus
SNDVWLGRTV

SEQ ID NO: 512780 - protein, 10 aa, Influenza virus
SNEGSYFFGD

SEQ ID NO: 512781 - protein, 10 aa, Influenza virus
SNENLIAPWY

SEQ ID NO: 512782 - protein, 10 aa, Influenza virus
SNENPAHKSQ

SEQ ID NO: 512783 - protein, 10 aa, Influenza virus
SNEQAAEAME

SEQ ID NO: 512784 - protein, 10 aa, Influenza virus
SNEQGSGYAA

SEQ ID NO: 512785 - protein, 10 aa, Influenza virus
SNETILETGY

SEQ ID NO: 512786 - protein, 10 aa, Influenza virus
SNETVKDRSP

SEQ ID NO: 512787 - protein, 10 aa, Influenza virus
SNGAFIAPRY

SEQ ID NO: 512788 - protein, 10 aa, Influenza virus
SNGAFLAPGY

SEQ ID NO: 512789 - protein, 10 aa, Influenza virus
SNGAFLAPRY

SEQ ID NO: 512790 - protein, 10 aa, Influenza virus
SNGGFLAPRY

SEQ ID NO: 512791 - protein, 10 aa, Influenza virus
SNGGLIAPRY

SEQ ID NO: 512792 - protein, 10 aa, Influenza virus
SNGGLLAPKY

SEQ ID NO: 512793 - protein, 10 aa, Influenza virus
SNGGLLAPRY

SEQ ID NO: 512794 - protein, 10 aa, Influenza virus
SNGNCRFNVC

SEQ ID NO: 512795 - protein, 10 aa, Influenza virus
SNGNFIAPEN

SEQ ID NO: 512796 - protein, 10 aa, Influenza virus
SNGNFIAPEY

SEQ ID NO: 512797 - protein, 10 aa, Influenza virus
SNGNFITPEY

SEQ ID NO: 512798 - protein, 10 aa, Influenza virus
SNGNLIAPEY

SEQ ID NO: 512799 - protein, 10 aa, Influenza virus
SNGNLIAPLY

SEQ ID NO: 512800 - protein, 10 aa, Influenza virus
SNGNLIAPRG

SEQ ID NO: 512801 - protein, 10 aa, Influenza virus
SNGNLIAPWF

SEQ ID NO: 512802 - protein, 10 aa, Influenza virus
SNGNLIAPWY

SEQ ID NO: 512803 - protein, 10 aa, Influenza virus
SNGNLVAPRG

SEQ ID NO: 512804 - protein, 10 aa, Influenza virus
SNGNLVAPWY

SEQ ID NO: 512805 - protein, 10 aa, Influenza virus
SNGQGSGYAA

SEQ ID NO: 512806 - protein, 10 aa, Influenza virus
SNGSCRCTIC

SEQ ID NO: 512807 - protein, 10 aa, Influenza virus
SNGSCRFNVC

SEQ ID NO: 512808 - protein, 10 aa, Influenza virus
SNGSLQCKIC

SEQ ID NO: 512809 - protein, 10 aa, Influenza virus
SNGSLQCRIA

SEQ ID NO: 512810 - protein, 10 aa, Influenza virus
SNGSLQCRIC

SEQ ID NO: 512811 - protein, 10 aa, Influenza virus
SNGSLQCRVC

SEQ ID NO: 512812 - protein, 10 aa, Influenza virus
SNGSLQCTIC

SEQ ID NO: 512813 - protein, 10 aa, Influenza virus
SNGSLRCRIC

SEQ ID NO: 512814 - protein, 10 aa, Influenza virus
SNGTAKDRSP

SEQ ID NO: 512815 - protein, 10 aa, Influenza virus
SNGTIHDRAA

SEQ ID NO: 512816 - protein, 10 aa, Influenza virus
SNGTIHDRSQ

SEQ ID NO: 512817 - protein, 10 aa, Influenza virus
SNGTIHDRTA

SEQ ID NO: 512818 - protein, 10 aa, Influenza virus
SNGTIHDRTT

SEQ ID NO: 512819 - protein, 10 aa, Influenza virus
SNGTIIKTLT

SEQ ID NO: 512820 - protein, 10 aa, Influenza virus
SNGTIKDRSP

SEQ ID NO: 512821 - protein, 10 aa, Influenza virus
SNGTIVKTLT

SEQ ID NO: 512822 - protein, 10 aa, Influenza virus
SNGTKINTLT

SEQ ID NO: 512823 - protein, 10 aa, Influenza virus
SNGTKVNTLT

SEQ ID NO: 512824 - protein, 10 aa, Influenza virus
SNGTMKDRSP

SEQ ID NO: 512825 - protein, 10 aa, Influenza virus
SNGTTHDRTA

SEQ ID NO: 512826 - protein, 10 aa, Influenza virus
SNGTVKDRSP

SEQ ID NO: 512827 - protein, 10 aa, Influenza virus
SNGTVNDRSP

SEQ ID NO: 512828 - protein, 10 aa, Influenza virus
SNGVFLAPRY

SEQ ID NO: 512829 - protein, 10 aa, Influenza virus
SNGVQDIIDN

SEQ ID NO: 512830 - protein, 10 aa, Influenza virus
SNIFNMERIK

SEQ ID NO: 512831 - protein, 10 aa, Influenza virus
SNIGLNVSLH

SEQ ID NO: 512832 - protein, 10 aa, Influenza virus
SNINIREWSY

SEQ ID NO: 512833 - protein, 10 aa, Influenza virus
SNKMARLGKG

SEQ ID NO: 512834 - protein, 10 aa, Influenza virus
SNKMARLGRG

SEQ ID NO: 512835 - protein, 10 aa, Influenza virus
SNKVARLGKG

SEQ ID NO: 512836 - protein, 10 aa, Influenza virus
SNLDYQIGYV

SEQ ID NO: 512837 - protein, 10 aa, Influenza virus
SNLEKRLENL

SEQ ID NO: 512838 - protein, 10 aa, Influenza virus
SNLERRLENL

SEQ ID NO: 512839 - protein, 10 aa, Influenza virus
SNLNDATYQR

SEQ ID NO: 512840 - protein, 10 aa, Influenza virus
SNLNDTTYQR

SEQ ID NO: 512841 - protein, 10 aa, Influenza virus
SNLPFQNINS

SEQ ID NO: 512842 - protein, 10 aa, Influenza virus
SNMDRAVKLY

SEQ ID NO: 512843 - protein, 10 aa, Influenza virus
SNMGIYQILA

SEQ ID NO: 512844 - protein, 10 aa, Influenza virus
SNMGVYQILA

SEQ ID NO: 512845 - protein, 10 aa, Influenza virus
SNMSLNISLY

SEQ ID NO: 512846 - protein, 10 aa, Influenza virus
SNNATDTVDT

SEQ ID NO: 512847 - protein, 10 aa, Influenza virus
SNNDWSGYSG

SEQ ID NO: 512848 - protein, 10 aa, Influenza virus
SNNGVKGFSY

SEQ ID NO: 512849 - protein, 10 aa, Influenza virus
SNNNGVKGFS

SEQ ID NO: 512850 - protein, 10 aa, Influenza virus
SNNRSGYSGI

SEQ ID NO: 512851 - protein, 10 aa, Influenza virus
SNNSSDTVDT

SEQ ID NO: 512852 - protein, 10 aa, Influenza virus
SNNSTDKIDT

SEQ ID NO: 512853 - protein, 10 aa, Influenza virus
SNNSTDKVDT

SEQ ID NO: 512854 - protein, 10 aa, Influenza virus
SNNSTDKVNT

SEQ ID NO: 512855 - protein, 10 aa, Influenza virus
SNNSTDTVDT

SEQ ID NO: 512856 - protein, 10 aa, Influenza virus
SNNSTDTVNT

SEQ ID NO: 512857 - protein, 10 aa, Influenza virus
SNNSTEKVDT

SEQ ID NO: 512858 - protein, 10 aa, Influenza virus
SNNSTERVDT

SEQ ID NO: 512859 - protein, 10 aa, Influenza virus
SNNSTNTVNT

SEQ ID NO: 512860 - protein, 10 aa, Influenza virus
SNNTTNYYNE

SEQ ID NO: 512861 - protein, 10 aa, Influenza virus
SNNTVKDRSP

SEQ ID NO: 512862 - protein, 10 aa, Influenza virus
SNNWSGYSGI

SEQ ID NO: 512863 - protein, 10 aa, Influenza virus
SNPGRVTVST

SEQ ID NO: 512864 - protein, 10 aa, Influenza virus
SNPITGSPGA

SEQ ID NO: 512865 - protein, 10 aa, Influenza virus
SNPITGSPSA

SEQ ID NO: 512866 - protein, 10 aa, Influenza virus
SNPKCDLYLN

SEQ ID NO: 512867 - protein, 10 aa, Influenza virus
SNQASYKIFK

SEQ ID NO: 512868 - protein, 10 aa, Influenza virus
SNQDSFYRSM

SEQ ID NO: 512869 - protein, 10 aa, Influenza virus
SNQGSFYRNM

SEQ ID NO: 512870 - protein, 10 aa, Influenza virus
SNQGSFYRSI

SEQ ID NO: 512871 - protein, 10 aa, Influenza virus
SNQGSFYRSM

SEQ ID NO: 512872 - protein, 10 aa, Influenza virus
SNRGSFYRSM

SEQ ID NO: 512873 - protein, 10 aa, Influenza virus
SNRPIIDINM

SEQ ID NO: 512874 - protein, 10 aa, Influenza virus
SNRPVIDINM

SEQ ID NO: 512875 - protein, 10 aa, Influenza virus
SNRPVIDVNM

SEQ ID NO: 512876 - protein, 10 aa, Influenza virus
SNRPVIQIDP

SEQ ID NO: 512877 - protein, 10 aa, Influenza virus
SNRPVIQINP

SEQ ID NO: 512878 - protein, 10 aa, Influenza virus
SNRPVIRIDP

SEQ ID NO: 512879 - protein, 10 aa, Influenza virus
SNRPVVDINM

SEQ ID NO: 512880 - protein, 10 aa, Influenza virus
SNRPWIRFNS

SEQ ID NO: 512881 - protein, 10 aa, Influenza virus
SNRPWIRINN

SEQ ID NO: 512882 - protein, 10 aa, Influenza virus
SNRPWISFDQ

SEQ ID NO: 512883 - protein, 10 aa, Influenza virus
SNRPWMRINN

SEQ ID NO: 512884 - protein, 10 aa, Influenza virus
SNRPWMRISN

SEQ ID NO: 512885 - protein, 10 aa, Influenza virus
SNRPWVRINN

SEQ ID NO: 512886 - protein, 10 aa, Influenza virus
SNRPWVRMNN

SEQ ID NO: 512887 - protein, 10 aa, Influenza virus
SNRPWVSFDQ

SEQ ID NO: 512888 - protein, 10 aa, Influenza virus
SNRPWVSFNQ

SEQ ID NO: 512889 - protein, 10 aa, Influenza virus
SNRSGYSGSF

SEQ ID NO: 512890 - protein, 10 aa, Influenza virus
SNSDFICVGW

SEQ ID NO: 512891 - protein, 10 aa, Influenza virus
SNSDFLCVGW

SEQ ID NO: 512892 - protein, 10 aa, Influenza virus
SNSDFMCVGW

SEQ ID NO: 512893 - protein, 10 aa, Influenza virus
SNSDWSGYSG

SEQ ID NO: 512894 - protein, 10 aa, Influenza virus
SNSEFICVGW

SEQ ID NO: 512895 - protein, 10 aa, Influenza virus
SNSEFLCVGW

SEQ ID NO: 512896 - protein, 10 aa, Influenza virus
SNSEGTGMAA

SEQ ID NO: 512897 - protein, 10 aa, Influenza virus
SNSIAVFCGT

SEQ ID NO: 512898 - protein, 10 aa, Influenza virus
SNSIIAFCGT

SEQ ID NO: 512899 - protein, 10 aa, Influenza virus
SNSIIVFCGT

SEQ ID NO: 512900 - protein, 10 aa, Influenza virus
SNSIVAFCGT

SEQ ID NO: 512901 - protein, 10 aa, Influenza virus
SNSIVALCGS

SEQ ID NO: 512902 - protein, 10 aa, Influenza virus
SNSIVSMCSS

SEQ ID NO: 512903 - protein, 10 aa, Influenza virus
SNSIVTFCGL

SEQ ID NO: 512904 - protein, 10 aa, Influenza virus
SNSIVVFCGA

SEQ ID NO: 512905 - protein, 10 aa, Influenza virus
SNSIVVFCGT

SEQ ID NO: 512906 - protein, 10 aa, Influenza virus
SNSIVVFCST

SEQ ID NO: 512907 - protein, 10 aa, Influenza virus
SNSIVVFVAP

SEQ ID NO: 512908 - protein, 10 aa, Influenza virus
SNSKSRDPNN

SEQ ID NO: 512909 - protein, 10 aa, Influenza virus
SNSLIALCGS

SEQ ID NO: 512910 - protein, 10 aa, Influenza virus
SNSLKLAIGL

SEQ ID NO: 512911 - protein, 10 aa, Influenza virus
SNSLVALCGS

SEQ ID NO: 512912 - protein, 10 aa, Influenza virus
SNSMVTFCGL

SEQ ID NO: 512913 - protein, 10 aa, Influenza virus
SNSNCKDPNN

SEQ ID NO: 512914 - protein, 10 aa, Influenza virus
SNSNCRDPNN

SEQ ID NO: 512915 - protein, 10 aa, Influenza virus
SNSNCRNPNN

SEQ ID NO: 512916 - protein, 10 aa, Influenza virus
SNSRFESVAW

SEQ ID NO: 512917 - protein, 10 aa, Influenza virus
SNSTTHDRTA

SEQ ID NO: 512918 - protein, 10 aa, Influenza virus
SNSVVVFCGT

SEQ ID NO: 512919 - protein, 10 aa, Influenza virus
SNTWLGRTIS

SEQ ID NO: 512920 - protein, 10 aa, Influenza virus
SNVENLFDEV

SEQ ID NO: 512921 - protein, 10 aa, Influenza virus
SNVGLKVSLH

SEQ ID NO: 512922 - protein, 10 aa, Influenza virus
SNVGLNMSLH

SEQ ID NO: 512923 - protein, 10 aa, Influenza virus
SNVGLNVSLH

SEQ ID NO: 512924 - protein, 10 aa, Influenza virus
SNVKNLFDEV

SEQ ID NO: 512925 - protein, 10 aa, Influenza virus
SNVKNLYDKV

SEQ ID NO: 512926 - protein, 10 aa, Influenza virus
SNVKNLYDRV

SEQ ID NO: 512927 - protein, 10 aa, Influenza virus
SNVKNLYEKV

SEQ ID NO: 512928 - protein, 10 aa, Influenza virus
SNVKNLYNKV

SEQ ID NO: 512929 - protein, 10 aa, Influenza virus
SNVRNLYDKV

SEQ ID NO: 512930 - protein, 10 aa, Influenza virus
SNVTVTNSVE

SEQ ID NO: 512931 - protein, 10 aa, Influenza virus
SNVTVTSSIE

SEQ ID NO: 512932 - protein, 10 aa, Influenza virus
SNVTVTSSVE

SEQ ID NO: 512933 - protein, 10 aa, Influenza virus
SNVVLNVSLH

SEQ ID NO: 512934 - protein, 10 aa, Influenza virus
SNWSGYSGIF

SEQ ID NO: 512935 - protein, 10 aa, Influenza virus
SNWSGYSGSF

SEQ ID NO: 512936 - protein, 10 aa, Influenza virus
SNYHQSFVPS

SEQ ID NO: 512937 - protein, 10 aa, Influenza virus
SNYQQSFVPS

SEQ ID NO: 512938 - protein, 10 aa, Influenza virus
SNYVCSGLVG

SEQ ID NO: 512939 - protein, 10 aa, Influenza virus
SPCLTDKGSI

SEQ ID NO: 512940 - protein, 10 aa, Influenza virus
SPDPGVKGFA

SEQ ID NO: 512941 - protein, 10 aa, Influenza virus
SPEEVSEAQG

SEQ ID NO: 512942 - protein, 10 aa, Influenza virus
SPEEVSETQG

SEQ ID NO: 512943 - protein, 10 aa, Influenza virus
SPFPVGSGSF

SEQ ID NO: 512944 - protein, 10 aa, Influenza virus
SPFRALISWE

SEQ ID NO: 512945 - protein, 10 aa, Influenza virus
SPFRALISWG

SEQ ID NO: 512946 - protein, 10 aa, Influenza virus
SPFRALVSWE

SEQ ID NO: 512947 - protein, 10 aa, Influenza virus
SPFRTLMSCP

SEQ ID NO: 512948 - protein, 10 aa, Influenza virus
SPFRTLMSVE

SEQ ID NO: 512949 - protein, 10 aa, Influenza virus
SPFRTLMSVK

SEQ ID NO: 512950 - protein, 10 aa, Influenza virus
SPGAPGVKGF

SEQ ID NO: 512951 - protein, 10 aa, Influenza virus
SPGARPKVNG

SEQ ID NO: 512952 - protein, 10 aa, Influenza virus
SPGCDRLQDT

SEQ ID NO: 512953 - protein, 10 aa, Influenza virus
SPGDRPKVNG

SEQ ID NO: 512954 - protein, 10 aa, Influenza virus
SPGMMMGMFN

SEQ ID NO: 512955 - protein, 10 aa, Influenza virus
SPGNAEIEDL

SEQ ID NO: 512956 - protein, 10 aa, Influenza virus
SPGRVTVSTK

SEQ ID NO: 512957 - protein, 10 aa, Influenza virus
SPGVKGFGFL

SEQ ID NO: 512958 - protein, 10 aa, Influenza virus
SPGVKGWAFD

SEQ ID NO: 512959 - protein, 10 aa, Influenza virus
SPHRALMSCP

SEQ ID NO: 512960 - protein, 10 aa, Influenza virus
SPHRSLMSCP

SEQ ID NO: 512961 - protein, 10 aa, Influenza virus
SPHRTLLMNE

SEQ ID NO: 512962 - protein, 10 aa, Influenza virus
SPHRTLMSCP

SEQ ID NO: 512963 - protein, 10 aa, Influenza virus
SPIHLGDCSF

SEQ ID NO: 512964 - protein, 10 aa, Influenza virus
SPINNGKGRY

SEQ ID NO: 512965 - protein, 10 aa, Influenza virus
SPISVGSGSF

SEQ ID NO: 512966 - protein, 10 aa, Influenza virus
SPKLRSGFEM

SEQ ID NO: 512967 - protein, 10 aa, Influenza virus
SPLAGSAQHV

SEQ ID NO: 512968 - protein, 10 aa, Influenza virus
SPLAVTWWNR

SEQ ID NO: 512969 - protein, 10 aa, Influenza virus
SPLELRDCKI

SEQ ID NO: 512970 - protein, 10 aa, Influenza virus
SPLGAINTTL

SEQ ID NO: 512971 - protein, 10 aa, Influenza virus
SPLKLVDGQD

SEQ ID NO: 512972 - protein, 10 aa, Influenza virus
SPLMVAYMLE

SEQ ID NO: 512973 - protein, 10 aa, Influenza virus
SPLPFQNIDS

SEQ ID NO: 512974 - protein, 10 aa, Influenza virus
SPLSGSAQHI

SEQ ID NO: 512975 - protein, 10 aa, Influenza virus
SPLSGSAQHV

SEQ ID NO: 512976 - protein, 10 aa, Influenza virus
SPLSRCRETR

SEQ ID NO: 512977 - protein, 10 aa, Influenza virus
SPLSRCRKTR

SEQ ID NO: 512978 - protein, 10 aa, Influenza virus
SPLTKGILGF

SEQ ID NO: 512979 - protein, 10 aa, Influenza virus
SPLTKGMLGF

SEQ ID NO: 512980 - protein, 10 aa, Influenza virus
SPLVLDDCSL

SEQ ID NO: 512981 - protein, 10 aa, Influenza virus
SPMMWEINGP

SEQ ID NO: 512982 - protein, 10 aa, Influenza virus
SPNAYQAKFE

SEQ ID NO: 512983 - protein, 10 aa, Influenza virus
SPNAYQAQFE

SEQ ID NO: 512984 - protein, 10 aa, Influenza virus
SPNAYQARFE

SEQ ID NO: 512985 - protein, 10 aa, Influenza virus
SPNVYQAKFE

SEQ ID NO: 512986 - protein, 10 aa, Influenza virus
SPNVYQARFE

SEQ ID NO: 512987 - protein, 10 aa, Influenza virus
SPNVYQSRFE

SEQ ID NO: 512988 - protein, 10 aa, Influenza virus
SPPIVSNSDF

SEQ ID NO: 512989 - protein, 10 aa, Influenza virus
SPPIVSNSEF

SEQ ID NO: 512990 - protein, 10 aa, Influenza virus
SPPMVSNSDF

SEQ ID NO: 512991 - protein, 10 aa, Influenza virus
SPPVVSNSDF

SEQ ID NO: 512992 - protein, 10 aa, Influenza virus
SPQLEGFSAE

SEQ ID NO: 512993 - protein, 10 aa, Influenza virus
SPQRTLMSCP

SEQ ID NO: 512994 - protein, 10 aa, Influenza virus
SPRLRSGFEM

SEQ ID NO: 512995 - protein, 10 aa, Influenza virus
SPRMFLAMIT

SEQ ID NO: 512996 - protein, 10 aa, Influenza virus
SPRSRNGFEM

SEQ ID NO: 512997 - protein, 10 aa, Influenza virus
SPRSRSGFEM

SEQ ID NO: 512998 - protein, 10 aa, Influenza virus
SPRSRSGFEV

SEQ ID NO: 512999 - protein, 10 aa, Influenza virus
SPRTVGQCPK

SEQ ID NO: 513000 - protein, 10 aa, Influenza virus
SPSAPGVKGF

SEQ ID NO: 513001 - protein, 10 aa, Influenza virus
SPSECRTFFL

SEQ ID NO: 513002 - protein, 10 aa, Influenza virus
SPSNSRFESV

SEQ ID NO: 513003 - protein, 10 aa, Influenza virus
SPSPGARPKV

SEQ ID NO: 513004 - protein, 10 aa, Influenza virus
SPSPGDRPKV

SEQ ID NO: 513005 - protein, 10 aa, Influenza virus
SPVHLGDCNF

SEQ ID NO: 513006 - protein, 10 aa, Influenza virus
SPVHLGDCRF

SEQ ID NO: 513007 - protein, 10 aa, Influenza virus
SPVHLGDCSF

SEQ ID NO: 513008 - protein, 10 aa, Influenza virus
SPVLTDNPRP

SEQ ID NO: 513009 - protein, 10 aa, Influenza virus
SPVNNGKGRY

SEQ ID NO: 513010 - protein, 10 aa, Influenza virus
SPVPVGSGSF

SEQ ID NO: 513011 - protein, 10 aa, Influenza virus
SPVSVGSGSF

SEQ ID NO: 513012 - protein, 10 aa, Influenza virus
SPYNSKFESV

SEQ ID NO: 513013 - protein, 10 aa, Influenza virus
SPYNSRFESV

SEQ ID NO: 513014 - protein, 10 aa, Influenza virus
SPYRALISWE

SEQ ID NO: 513015 - protein, 10 aa, Influenza virus
SPYRALMSCP

SEQ ID NO: 513016 - protein, 10 aa, Influenza virus
SPYRALMSVP

SEQ ID NO: 513017 - protein, 10 aa, Influenza virus
SPYRTLMSCP

SEQ ID NO: 513018 - protein, 10 aa, Influenza virus
SPYRTLMSVE

SEQ ID NO: 513019 - protein, 10 aa, Influenza virus
SPYRTLMSVG

SEQ ID NO: 513020 - protein, 10 aa, Influenza virus
SPYRTLMSVK

SEQ ID NO: 513021 - protein, 10 aa, Influenza virus
SQASYKIFKS

SEQ ID NO: 513022 - protein, 10 aa, Influenza virus
SQDTEISFTI

SEQ ID NO: 513023 - protein, 10 aa, Influenza virus
SQDTELSFTI

SEQ ID NO: 513024 - protein, 10 aa, Influenza virus
SQDTELSFTV

SEQ ID NO: 513025 - protein, 10 aa, Influenza virus
SQDTEVSFTI

SEQ ID NO: 513026 - protein, 10 aa, Influenza virus
SQETRVWWTS

SEQ ID NO: 513027 - protein, 10 aa, Influenza virus
SQFRALISWE

SEQ ID NO: 513028 - protein, 10 aa, Influenza virus
SQGEGTAADY

SEQ ID NO: 513029 - protein, 10 aa, Influenza virus
SQGSGYAADK

SEQ ID NO: 513030 - protein, 10 aa, Influenza virus
SQGSGYAADR

SEQ ID NO: 513031 - protein, 10 aa, Influenza virus
SQGTKRPYEQ

SEQ ID NO: 513032 - protein, 10 aa, Influenza virus
SQGTKRSHEQ

SEQ ID NO: 513033 - protein, 10 aa, Influenza virus
SQGTKRSYEQ

SEQ ID NO: 513034 - protein, 10 aa, Influenza virus
SQGTTIRGKH

SEQ ID NO: 513035 - protein, 10 aa, Influenza virus
SQGTTIRGRH

SEQ ID NO: 513036 - protein, 10 aa, Influenza virus
SQGTTLKGRH

SEQ ID NO: 513037 - protein, 10 aa, Influenza virus
SQGTTLRGQH

SEQ ID NO: 513038 - protein, 10 aa, Influenza virus
SQGTTLRGRH

SEQ ID NO: 513039 - protein, 10 aa, Influenza virus
SQGVKGWAFD

SEQ ID NO: 513040 - protein, 10 aa, Influenza virus
SQITNGTTGN

SEQ ID NO: 513041 - protein, 10 aa, Influenza virus
SQKGILEDEQ

SEQ ID NO: 513042 - protein, 10 aa, Influenza virus
SQKLFALSGV

SEQ ID NO: 513043 - protein, 10 aa, Influenza virus
SQKQEFKMNP

SEQ ID NO: 513044 - protein, 10 aa, Influenza virus
SQLEGFSAES

SEQ ID NO: 513045 - protein, 10 aa, Influenza virus
SQLIWMACHS

SEQ ID NO: 513046 - protein, 10 aa, Influenza virus
SQLKKQEIEG

SEQ ID NO: 513047 - protein, 10 aa, Influenza virus
SQLKRQEIEG

SEQ ID NO: 513048 - protein, 10 aa, Influenza virus
SQLVWMACHS

SEQ ID NO: 513049 - protein, 10 aa, Influenza virus
SQLVWMACNS

SEQ ID NO: 513050 - protein, 10 aa, Influenza virus
SQNILRTHES

SEQ ID NO: 513051 - protein, 10 aa, Influenza virus
SQNILRTQEP

SEQ ID NO: 513052 - protein, 10 aa, Influenza virus
SQNILRTQES

SEQ ID NO: 513053 - protein, 10 aa, Influenza virus
SQRGILEDEQ

SEQ ID NO: 513054 - protein, 10 aa, Influenza virus
SQRGVLEDEQ

SEQ ID NO: 513055 - protein, 10 aa, Influenza virus
SQRSKFLLMD

SEQ ID NO: 513056 - protein, 10 aa, Influenza virus
SQSGRISFYW

SEQ ID NO: 513057 - protein, 10 aa, Influenza virus
SQSRTREILT

SEQ ID NO: 513058 - protein, 10 aa, Influenza virus
SQSRTRGILT

SEQ ID NO: 513059 - protein, 10 aa, Influenza virus
SQTATKRIRM

SEQ ID NO: 513060 - protein, 10 aa, Influenza virus
SQTATKRLRM

SEQ ID NO: 513061 - protein, 10 aa, Influenza virus
SQTIINNYHN

SEQ ID NO: 513062 - protein, 10 aa, Influenza virus
SQTIINNYYN

SEQ ID NO: 513063 - protein, 10 aa, Influenza virus
SQTVINNYYN

SEQ ID NO: 513064 - protein, 10 aa, Influenza virus
SQVEQRINML

SEQ ID NO: 513065 - protein, 10 aa, Influenza virus
SQVERRINML

SEQ ID NO: 513066 - protein, 10 aa, Influenza virus
SQYICSPVLT

SEQ ID NO: 513067 - protein, 10 aa, Influenza virus
SQYLCTGILT

SEQ ID NO: 513068 - protein, 10 aa, Influenza virus
SQYLCTGVLT

SEQ ID NO: 513069 - protein, 10 aa, Influenza virus
SQYRALISWP

SEQ ID NO: 513070 - protein, 10 aa, Influenza virus
SQYRALVSWP

SEQ ID NO: 513071 - protein, 10 aa, Influenza virus
SQYREEALLN

SEQ ID NO: 513072 - protein, 10 aa, Influenza virus
SQYRSLISWP

SEQ ID NO: 513073 - protein, 10 aa, Influenza virus
SRADKICIGY

SEQ ID NO: 513074 - protein, 10 aa, Influenza virus
SRARIDARID

SEQ ID NO: 513075 - protein, 10 aa, Influenza virus
SRARIDARVD

SEQ ID NO: 513076 - protein, 10 aa, Influenza virus
SRARIKTRLF

SEQ ID NO: 513077 - protein, 10 aa, Influenza virus
SRAVGKCPRY

SEQ ID NO: 513078 - protein, 10 aa, Influenza virus
SRCRETRGLF

SEQ ID NO: 513079 - protein, 10 aa, Influenza virus
SRCRKTRGLF

SEQ ID NO: 513080 - protein, 10 aa, Influenza virus
SRDSRSGYET

SEQ ID NO: 513081 - protein, 10 aa, Influenza virus
SRERLGSWSW

SEQ ID NO: 513082 - protein, 10 aa, Influenza virus
SRFEAVAWSA

SEQ ID NO: 513083 - protein, 10 aa, Influenza virus
SRFESVAWSA

SEQ ID NO: 513084 - protein, 10 aa, Influenza virus
SRFQIQGVKL

SEQ ID NO: 513085 - protein, 10 aa, Influenza virus
SRGEVFVIRE

SEQ ID NO: 513086 - protein, 10 aa, Influenza virus
SRGHIFVIRE

SEQ ID NO: 513087 - protein, 10 aa, Influenza virus
SRGHVFVIRE

SEQ ID NO: 513088 - protein, 10 aa, Influenza virus
SRGLFGAIAG

SEQ ID NO: 513089 - protein, 10 aa, Influenza virus
SRGLFGAKAG

SEQ ID NO: 513090 - protein, 10 aa, Influenza virus
SRGYKMNIQI

SEQ ID NO: 513091 - protein, 10 aa, Influenza virus
SRGYKMNNQI

SEQ ID NO: 513092 - protein, 10 aa, Influenza virus
SRGYKMNTKI

SEQ ID NO: 513093 - protein, 10 aa, Influenza virus
SRGYKMNTQI

SEQ ID NO: 513094 - protein, 10 aa, Influenza virus
SRGYKMNTRI

SEQ ID NO: 513095 - protein, 10 aa, Influenza virus
SRHCSKYHWN

SEQ ID NO: 513096 - protein, 10 aa, Influenza virus
SRHHMGECPK

SEQ ID NO: 513097 - protein, 10 aa, Influenza virus
SRHYIGKCPK

SEQ ID NO: 513098 - protein, 10 aa, Influenza virus
SRHYMGECPE

SEQ ID NO: 513099 - protein, 10 aa, Influenza virus
SRHYMGECPK

SEQ ID NO: 513100 - protein, 10 aa, Influenza virus
SRHYMGECPN

SEQ ID NO: 513101 - protein, 10 aa, Influenza virus
SRIAIGNCPK

SEQ ID NO: 513102 - protein, 10 aa, Influenza virus
SRILTDTSRP

SEQ ID NO: 513103 - protein, 10 aa, Influenza virus
SRINGVKLEE

SEQ ID NO: 513104 - protein, 10 aa, Influenza virus
SRINMINSKI

SEQ ID NO: 513105 - protein, 10 aa, Influenza virus
SRINMINSQI

SEQ ID NO: 513106 - protein, 10 aa, Influenza virus
SRINRQEIEG

SEQ ID NO: 513107 - protein, 10 aa, Influenza virus
SRINTINSKI

SEQ ID NO: 513108 - protein, 10 aa, Influenza virus
SRISFYWTIV

SEQ ID NO: 513109 - protein, 10 aa, Influenza virus
SRKLLLIAQA

SEQ ID NO: 513110 - protein, 10 aa, Influenza virus
SRKLLLITQA

SEQ ID NO: 513111 - protein, 10 aa, Influenza virus
SRKLLLIVQA

SEQ ID NO: 513112 - protein, 10 aa, Influenza virus
SRKLLLVVQA

SEQ ID NO: 513113 - protein, 10 aa, Influenza virus
SRKMLLIVQA

SEQ ID NO: 513114 - protein, 10 aa, Influenza virus
SRLNRNEIKG

SEQ ID NO: 513115 - protein, 10 aa, Influenza virus
SRLNRQEIEG

SEQ ID NO: 513116 - protein, 10 aa, Influenza virus
SRLNWLTKAT

SEQ ID NO: 513117 - protein, 10 aa, Influenza virus
SRLNWLTKET

SEQ ID NO: 513118 - protein, 10 aa, Influenza virus
SRMGVDEYSS

SEQ ID NO: 513119 - protein, 10 aa, Influenza virus
SRMQFSSLAV

SEQ ID NO: 513120 - protein, 10 aa, Influenza virus
SRMQFSSLTV

SEQ ID NO: 513121 - protein, 10 aa, Influenza virus
SRMSICISGP

SEQ ID NO: 513122 - protein, 10 aa, Influenza virus
SRMSICMSGP

SEQ ID NO: 513123 - protein, 10 aa, Influenza virus
SRMSVCMSGP

SEQ ID NO: 513124 - protein, 10 aa, Influenza virus
SRNGFEMLKI

SEQ ID NO: 513125 - protein, 10 aa, Influenza virus
SRNGKWREQL

SEQ ID NO: 513126 - protein, 10 aa, Influenza virus
SRNPGNAEIE

SEQ ID NO: 513127 - protein, 10 aa, Influenza virus
SRPFQNASRH

SEQ ID NO: 513128 - protein, 10 aa, Influenza virus
SRPRVRNQSG

SEQ ID NO: 513129 - protein, 10 aa, Influenza virus
SRRYELEIGT

SEQ ID NO: 513130 - protein, 10 aa, Influenza virus
SRSGFEIIWD

SEQ ID NO: 513131 - protein, 10 aa, Influenza virus
SRSGFEILLI

SEQ ID NO: 513132 - protein, 10 aa, Influenza virus
SRSGFEMIWD

SEQ ID NO: 513133 - protein, 10 aa, Influenza virus
SRSGFEMLKI

SEQ ID NO: 513134 - protein, 10 aa, Influenza virus
SRSGFEMLKV

SEQ ID NO: 513135 - protein, 10 aa, Influenza virus
SRSGFEMLRI

SEQ ID NO: 513136 - protein, 10 aa, Influenza virus
SRSGFEMVWD

SEQ ID NO: 513137 - protein, 10 aa, Influenza virus
SRSGFEVLFI

SEQ ID NO: 513138 - protein, 10 aa, Influenza virus
SRSGFEVLLI

SEQ ID NO: 513139 - protein, 10 aa, Influenza virus
SRSGYEILKV

SEQ ID NO: 513140 - protein, 10 aa, Influenza virus
SRSGYEMLKV

SEQ ID NO: 513141 - protein, 10 aa, Influenza virus
SRSGYETFKV

SEQ ID NO: 513142 - protein, 10 aa, Influenza virus
SRSGYETFRV

SEQ ID NO: 513143 - protein, 10 aa, Influenza virus
SRSGYEVLKV

SEQ ID NO: 513144 - protein, 10 aa, Influenza virus
SRSIIFNMER

SEQ ID NO: 513145 - protein, 10 aa, Influenza virus
SRSLKLAIGL

SEQ ID NO: 513146 - protein, 10 aa, Influenza virus
SRSNIFNMER

SEQ ID NO: 513147 - protein, 10 aa, Influenza virus
SRSPGNAEIE

SEQ ID NO: 513148 - protein, 10 aa, Influenza virus
SRSSCHDGKA

SEQ ID NO: 513149 - protein, 10 aa, Influenza virus
SRSSFYAEMK

SEQ ID NO: 513150 - protein, 10 aa, Influenza virus
SRTELINPNK

SEQ ID NO: 513151 - protein, 10 aa, Influenza virus
SRTELINPSK

SEQ ID NO: 513152 - protein, 10 aa, Influenza virus
SRTELIPPSK

SEQ ID NO: 513153 - protein, 10 aa, Influenza virus
SRTELISPNK

SEQ ID NO: 513154 - protein, 10 aa, Influenza virus
SRTELISPSK

SEQ ID NO: 513155 - protein, 10 aa, Influenza virus
SRTHQYSEKG

SEQ ID NO: 513156 - protein, 10 aa, Influenza virus
SRTIINNYYN

SEQ ID NO: 513157 - protein, 10 aa, Influenza virus
SRTREILTKI

SEQ ID NO: 513158 - protein, 10 aa, Influenza virus
SRTREILTKT

SEQ ID NO: 513159 - protein, 10 aa, Influenza virus
SRTREILTRT

SEQ ID NO: 513160 - protein, 10 aa, Influenza virus
SRTRGILTKT

SEQ ID NO: 513161 - protein, 10 aa, Influenza virus
SRVDNHSMSD

SEQ ID NO: 513162 - protein, 10 aa, Influenza virus
SRVLTDTSRP

SEQ ID NO: 513163 - protein, 10 aa, Influenza virus
SRYGYEMLKV

SEQ ID NO: 513164 - protein, 10 aa, Influenza virus
SRYICSGLVG

SEQ ID NO: 513165 - protein, 10 aa, Influenza virus
SRYSKADKIC

SEQ ID NO: 513166 - protein, 10 aa, Influenza virus
SRYVCSGLVG

SEQ ID NO: 513167 - protein, 10 aa, Influenza virus
SRYVCTGILT

SEQ ID NO: 513168 - protein, 10 aa, Influenza virus
SRYWAIRTRS

SEQ ID NO: 513169 - protein, 10 aa, Influenza virus
SRYYMGECPK

SEQ ID NO: 513170 - protein, 10 aa, Influenza virus
SSAASYKRIR

SEQ ID NO: 513171 - protein, 10 aa, Influenza virus
SSAASYKRVR

SEQ ID NO: 513172 - protein, 10 aa, Influenza virus
SSACLRGGRN

SEQ ID NO: 513173 - protein, 10 aa, Influenza virus
SSAQEKNDLY

SEQ ID NO: 513174 - protein, 10 aa, Influenza virus
SSASCHDGRA

SEQ ID NO: 513175 - protein, 10 aa, Influenza virus
SSCAAMDDFQ

SEQ ID NO: 513176 - protein, 10 aa, Influenza virus
SSCFDGKEWL

SEQ ID NO: 513177 - protein, 10 aa, Influenza virus
SSCFDGKEWM

SEQ ID NO: 513178 - protein, 10 aa, Influenza virus
SSCFDGREWM

SEQ ID NO: 513179 - protein, 10 aa, Influenza virus
SSCHDGKAWL

SEQ ID NO: 513180 - protein, 10 aa, Influenza virus
SSCHDGKEWL

SEQ ID NO: 513181 - protein, 10 aa, Influenza virus
SSCHDGKSWL

SEQ ID NO: 513182 - protein, 10 aa, Influenza virus
SSCHDGNAWL

SEQ ID NO: 513183 - protein, 10 aa, Influenza virus
SSCHDGRAWL

SEQ ID NO: 513184 - protein, 10 aa, Influenza virus
SSCYDGKAWL

SEQ ID NO: 513185 - protein, 10 aa, Influenza virus
SSDDFALILN

SEQ ID NO: 513186 - protein, 10 aa, Influenza virus
SSDDFALIVN

SEQ ID NO: 513187 - protein, 10 aa, Influenza virus
SSDICYPGKF

SEQ ID NO: 513188 - protein, 10 aa, Influenza virus
SSDICYPGRF

SEQ ID NO: 513189 - protein, 10 aa, Influenza virus
SSDKVDTLLE

SEQ ID NO: 513190 - protein, 10 aa, Influenza virus
SSDNEQTDLY

SEQ ID NO: 513191 - protein, 10 aa, Influenza virus
SSDTVDTLTE

SEQ ID NO: 513192 - protein, 10 aa, Influenza virus
SSDVLVTREP

SEQ ID NO: 513193 - protein, 10 aa, Influenza virus
SSEAPGWSWD

SEQ ID NO: 513194 - protein, 10 aa, Influenza virus
SSEKVDTLLE

SEQ ID NO: 513195 - protein, 10 aa, Influenza virus
SSEKVNTLLE

SEQ ID NO: 513196 - protein, 10 aa, Influenza virus
SSEQAAEAIE

SEQ ID NO: 513197 - protein, 10 aa, Influenza virus
SSEQAAEAMD

SEQ ID NO: 513198 - protein, 10 aa, Influenza virus
SSEQAAEAME

SEQ ID NO: 513199 - protein, 10 aa, Influenza virus
SSERVDTLLE

SEQ ID NO: 513200 - protein, 10 aa, Influenza virus
SSEVPEWSWD

SEQ ID NO: 513201 - protein, 10 aa, Influenza virus
SSEVPGWSWD

SEQ ID NO: 513202 - protein, 10 aa, Influenza virus
SSEVPGWSWG

SEQ ID NO: 513203 - protein, 10 aa, Influenza virus
SSFEKFEIFP

SEQ ID NO: 513204 - protein, 10 aa, Influenza virus
SSFEQITFMQ

SEQ ID NO: 513205 - protein, 10 aa, Influenza virus
SSFERFEIFP

SEQ ID NO: 513206 - protein, 10 aa, Influenza virus
SSFERFEMFP

SEQ ID NO: 513207 - protein, 10 aa, Influenza virus
SSFFRNIVWL

SEQ ID NO: 513208 - protein, 10 aa, Influenza virus
SSFFRNMVWL

SEQ ID NO: 513209 - protein, 10 aa, Influenza virus
SSFFRNVVWL

SEQ ID NO: 513210 - protein, 10 aa, Influenza virus
SSFQVDCFIW

SEQ ID NO: 513211 - protein, 10 aa, Influenza virus
SSFQVDCFLW

SEQ ID NO: 513212 - protein, 10 aa, Influenza virus
SSFSFGGFTF

SEQ ID NO: 513213 - protein, 10 aa, Influenza virus
SSFYAEMEWL

SEQ ID NO: 513214 - protein, 10 aa, Influenza virus
SSFYAEMKWL

SEQ ID NO: 513215 - protein, 10 aa, Influenza virus
SSFYRNLLWI

SEQ ID NO: 513216 - protein, 10 aa, Influenza virus
SSFYRNLLWM

SEQ ID NO: 513217 - protein, 10 aa, Influenza virus
SSFYRNLVWI

SEQ ID NO: 513218 - protein, 10 aa, Influenza virus
SSFYRNVVWL

SEQ ID NO: 513219 - protein, 10 aa, Influenza virus
SSFYRSLLWI

SEQ ID NO: 513220 - protein, 10 aa, Influenza virus
SSFYSEMKWL

SEQ ID NO: 513221 - protein, 10 aa, Influenza virus
SSGGLLAPRY

SEQ ID NO: 513222 - protein, 10 aa, Influenza virus
SSGIAIALGI

SEQ ID NO: 513223 - protein, 10 aa, Influenza virus
SSGIAIVLGI

SEQ ID NO: 513224 - protein, 10 aa, Influenza virus
SSGNCRFNVC

SEQ ID NO: 513225 - protein, 10 aa, Influenza virus
SSGNCRFSVC

SEQ ID NO: 513226 - protein, 10 aa, Influenza virus
SSGNNQVFPQ

SEQ ID NO: 513227 - protein, 10 aa, Influenza virus
SSGSLEFIAE

SEQ ID NO: 513228 - protein, 10 aa, Influenza virus
SSGSLKLAIG

SEQ ID NO: 513229 - protein, 10 aa, Influenza virus
SSGTSKACNA

SEQ ID NO: 513230 - protein, 10 aa, Influenza virus
SSGTSKACSA

SEQ ID NO: 513231 - protein, 10 aa, Influenza virus
SSGTVKDRSP

SEQ ID NO: 513232 - protein, 10 aa, Influenza virus
SSGYKDIILW

SEQ ID NO: 513233 - protein, 10 aa, Influenza virus
SSGYKDVIIW

SEQ ID NO: 513234 - protein, 10 aa, Influenza virus
SSGYKDVILW

SEQ ID NO: 513235 - protein, 10 aa, Influenza virus
SSGYKEVILW

SEQ ID NO: 513236 - protein, 10 aa, Influenza virus
SSIAFCGVDS

SEQ ID NO: 513237 - protein, 10 aa, Influenza virus
SSIAFCGVNS

SEQ ID NO: 513238 - protein, 10 aa, Influenza virus
SSIDLVETNH

SEQ ID NO: 513239 - protein, 10 aa, Influenza virus
SSIGKVCRTL

SEQ ID NO: 513240 - protein, 10 aa, Influenza virus
SSIKEKDMTK

SEQ ID NO: 513241 - protein, 10 aa, Influenza virus
SSIKKYERVK

SEQ ID NO: 513242 - protein, 10 aa, Influenza virus
SSIKRYERVK

SEQ ID NO: 513243 - protein, 10 aa, Influenza virus
SSILTDSQTA

SEQ ID NO: 513244 - protein, 10 aa, Influenza virus
SSISFCGVDS

SEQ ID NO: 513245 - protein, 10 aa, Influenza virus
SSISFCGVNG

SEQ ID NO: 513246 - protein, 10 aa, Influenza virus
SSISFCGVNS

SEQ ID NO: 513247 - protein, 10 aa, Influenza virus
SSISFCGVSS

SEQ ID NO: 513248 - protein, 10 aa, Influenza virus
SSIVLVGLIL

SEQ ID NO: 513249 - protein, 10 aa, Influenza virus
SSIVMCGVDH

SEQ ID NO: 513250 - protein, 10 aa, Influenza virus
SSIVMCGVDY

SEQ ID NO: 513251 - protein, 10 aa, Influenza virus
SSIVMCGVEH

SEQ ID NO: 513252 - protein, 10 aa, Influenza virus
SSIVMCGVNY

SEQ ID NO: 513253 - protein, 10 aa, Influenza virus
SSIVMVGLIL

SEQ ID NO: 513254 - protein, 10 aa, Influenza virus
SSIVVFCGTS

SEQ ID NO: 513255 - protein, 10 aa, Influenza virus
SSIYIEVLHL

SEQ ID NO: 513256 - protein, 10 aa, Influenza virus
SSIYQNSFVP

SEQ ID NO: 513257 - protein, 10 aa, Influenza virus
SSKANQVFPQ

SEQ ID NO: 513258 - protein, 10 aa, Influenza virus
SSKCQQSFTP

SEQ ID NO: 513259 - protein, 10 aa, Influenza virus
SSKDNQVFPQ

SEQ ID NO: 513260 - protein, 10 aa, Influenza virus
SSKPFQNASR

SEQ ID NO: 513261 - protein, 10 aa, Influenza virus
SSKPFQNTSR

SEQ ID NO: 513262 - protein, 10 aa, Influenza virus
SSKPLQNASR

SEQ ID NO: 513263 - protein, 10 aa, Influenza virus
SSKYLQSFTP

SEQ ID NO: 513264 - protein, 10 aa, Influenza virus
SSKYQQSFSP

SEQ ID NO: 513265 - protein, 10 aa, Influenza virus
SSKYQQSFTP

SEQ ID NO: 513266 - protein, 10 aa, Influenza virus
SSKYRQSFSP

SEQ ID NO: 513267 - protein, 10 aa, Influenza virus
SSLAVNVRGS

SEQ ID NO: 513268 - protein, 10 aa, Influenza virus
SSLDEQNKLY

SEQ ID NO: 513269 - protein, 10 aa, Influenza virus
SSLILAAIIM

SEQ ID NO: 513270 - protein, 10 aa, Influenza virus
SSLILAALIM

SEQ ID NO: 513271 - protein, 10 aa, Influenza virus
SSLLLQANLC

SEQ ID NO: 513272 - protein, 10 aa, Influenza virus
SSLMWEINGP

SEQ ID NO: 513273 - protein, 10 aa, Influenza virus
SSLPFQNINP

SEQ ID NO: 513274 - protein, 10 aa, Influenza virus
SSLPFQNINS

SEQ ID NO: 513275 - protein, 10 aa, Influenza virus
SSLPFQNISP

SEQ ID NO: 513276 - protein, 10 aa, Influenza virus
SSLPLALGMK

SEQ ID NO: 513277 - protein, 10 aa, Influenza virus
SSLTHALREL

SEQ ID NO: 513278 - protein, 10 aa, Influenza virus
SSLTVNVRGS

SEQ ID NO: 513279 - protein, 10 aa, Influenza virus
SSLTVNVRGT

SEQ ID NO: 513280 - protein, 10 aa, Influenza virus
SSLTVSVRGS

SEQ ID NO: 513281 - protein, 10 aa, Influenza virus
SSLVLAAIIM

SEQ ID NO: 513282 - protein, 10 aa, Influenza virus
SSLVLAALIM

SEQ ID NO: 513283 - protein, 10 aa, Influenza virus
SSLVLAALNM

SEQ ID NO: 513284 - protein, 10 aa, Influenza virus
SSLVLIVSLG

SEQ ID NO: 513285 - protein, 10 aa, Influenza virus
SSLVLLFMII

SEQ ID NO: 513286 - protein, 10 aa, Influenza virus
SSLVLLLMII

SEQ ID NO: 513287 - protein, 10 aa, Influenza virus
SSLVLLVSLG

SEQ ID NO: 513288 - protein, 10 aa, Influenza virus
SSLVLVVSLG

SEQ ID NO: 513289 - protein, 10 aa, Influenza virus
SSMGEAMVSR

SEQ ID NO: 513290 - protein, 10 aa, Influenza virus
SSMGIYQILA

SEQ ID NO: 513291 - protein, 10 aa, Influenza virus
SSMGVYQILA

SEQ ID NO: 513292 - protein, 10 aa, Influenza virus
SSMGVYQILV

SEQ ID NO: 513293 - protein, 10 aa, Influenza virus
SSMMEAMVSR

SEQ ID NO: 513294 - protein, 10 aa, Influenza virus
SSMMWEINGP

SEQ ID NO: 513295 - protein, 10 aa, Influenza virus
SSMMWEVNGP

SEQ ID NO: 513296 - protein, 10 aa, Influenza virus
SSMNNQVFPQ

SEQ ID NO: 513297 - protein, 10 aa, Influenza virus
SSMPFHNIHP

SEQ ID NO: 513298 - protein, 10 aa, Influenza virus
SSMPFHNVHP

SEQ ID NO: 513299 - protein, 10 aa, Influenza virus
SSMPLHNIHP

SEQ ID NO: 513300 - protein, 10 aa, Influenza virus
SSMVEAMISR

SEQ ID NO: 513301 - protein, 10 aa, Influenza virus
SSMVEAMMSR

SEQ ID NO: 513302 - protein, 10 aa, Influenza virus
SSMVEAMVSR

SEQ ID NO: 513303 - protein, 10 aa, Influenza virus
SSNCKDPNNE

SEQ ID NO: 513304 - protein, 10 aa, Influenza virus
SSNCRDPNNE

SEQ ID NO: 513305 - protein, 10 aa, Influenza virus
SSNCRDSNNE

SEQ ID NO: 513306 - protein, 10 aa, Influenza virus
SSNCRNPNNE

SEQ ID NO: 513307 - protein, 10 aa, Influenza virus
SSNGAFIAPD

SEQ ID NO: 513308 - protein, 10 aa, Influenza virus
SSNYHQSFVP

SEQ ID NO: 513309 - protein, 10 aa, Influenza virus
SSNYQQSFVP

SEQ ID NO: 513310 - protein, 10 aa, Influenza virus
SSPMMWEING

SEQ ID NO: 513311 - protein, 10 aa, Influenza virus
SSPNAYQAKF

SEQ ID NO: 513312 - protein, 10 aa, Influenza virus
SSPNAYQARF

SEQ ID NO: 513313 - protein, 10 aa, Influenza virus
SSPPTVYNNR

SEQ ID NO: 513314 - protein, 10 aa, Influenza virus
SSPPTVYNSK

SEQ ID NO: 513315 - protein, 10 aa, Influenza virus
SSPPTVYNSR

SEQ ID NO: 513316 - protein, 10 aa, Influenza virus
SSPPTVYNTR

SEQ ID NO: 513317 - protein, 10 aa, Influenza virus
SSPPTVYSSR

SEQ ID NO: 513318 - protein, 10 aa, Influenza virus
SSQDTELSFT

SEQ ID NO: 513319 - protein, 10 aa, Influenza virus
SSQLEGFSAE

SEQ ID NO: 513320 - protein, 10 aa, Influenza virus
SSRHCSKYHW

SEQ ID NO: 513321 - protein, 10 aa, Influenza virus
SSRISFYWTI

SEQ ID NO: 513322 - protein, 10 aa, Influenza virus
SSRNGFEILL

SEQ ID NO: 513323 - protein, 10 aa, Influenza virus
SSRPFQNASR

SEQ ID NO: 513324 - protein, 10 aa, Influenza virus
SSRSGFEILL

SEQ ID NO: 513325 - protein, 10 aa, Influenza virus
SSRSGFEVLF

SEQ ID NO: 513326 - protein, 10 aa, Influenza virus
SSRSGFEVLL

SEQ ID NO: 513327 - protein, 10 aa, Influenza virus
SSSACLRGGR

SEQ ID NO: 513328 - protein, 10 aa, Influenza virus
SSSCFDGKEW

SEQ ID NO: 513329 - protein, 10 aa, Influenza virus
SSSCFDGREW

SEQ ID NO: 513330 - protein, 10 aa, Influenza virus
SSSCHDGKAW

SEQ ID NO: 513331 - protein, 10 aa, Influenza virus
SSSCHDGKSW

SEQ ID NO: 513332 - protein, 10 aa, Influenza virus
SSSCHDGNAW

SEQ ID NO: 513333 - protein, 10 aa, Influenza virus
SSSCHDGRAW

SEQ ID NO: 513334 - protein, 10 aa, Influenza virus
SSSCYDGKAW

SEQ ID NO: 513335 - protein, 10 aa, Influenza virus
SSSFSFGGFT

SEQ ID NO: 513336 - protein, 10 aa, Influenza virus
SSSFYAEMKW

SEQ ID NO: 513337 - protein, 10 aa, Influenza virus
SSSGNNQVFP

SEQ ID NO: 513338 - protein, 10 aa, Influenza virus
SSSGTSKACN

SEQ ID NO: 513339 - protein, 10 aa, Influenza virus
SSSIVMCGVD

SEQ ID NO: 513340 - protein, 10 aa, Influenza virus
SSSIVMCGVN

SEQ ID NO: 513341 - protein, 10 aa, Influenza virus
SSSLDEQNKL

SEQ ID NO: 513342 - protein, 10 aa, Influenza virus
SSSLMWEING

SEQ ID NO: 513343 - protein, 10 aa, Influenza virus
SSSLVLAGLI

SEQ ID NO: 513344 - protein, 10 aa, Influenza virus
SSSLVLMGLI

SEQ ID NO: 513345 - protein, 10 aa, Influenza virus
SSSLVLVGLI

SEQ ID NO: 513346 - protein, 10 aa, Influenza virus
SSSLVLVGLV

SEQ ID NO: 513347 - protein, 10 aa, Influenza virus
SSSMMWEING

SEQ ID NO: 513348 - protein, 10 aa, Influenza virus
SSSMMWEVNG

SEQ ID NO: 513349 - protein, 10 aa, Influenza virus
SSSMNNQVFP

SEQ ID NO: 513350 - protein, 10 aa, Influenza virus
SSSNAYQAKF

SEQ ID NO: 513351 - protein, 10 aa, Influenza virus
SSSNCKDPNN

SEQ ID NO: 513352 - protein, 10 aa, Influenza virus
SSSNCRDPNN

SEQ ID NO: 513353 - protein, 10 aa, Influenza virus
SSSNCRDSNN

SEQ ID NO: 513354 - protein, 10 aa, Influenza virus
SSSSCFDGKE

SEQ ID NO: 513355 - protein, 10 aa, Influenza virus
SSSSCFDGRE

SEQ ID NO: 513356 - protein, 10 aa, Influenza virus
SSSSCHDGKA

SEQ ID NO: 513357 - protein, 10 aa, Influenza virus
SSSSCHDGKS

SEQ ID NO: 513358 - protein, 10 aa, Influenza virus
SSSSCHDGNA

SEQ ID NO: 513359 - protein, 10 aa, Influenza virus
SSSSCHDGRA

SEQ ID NO: 513360 - protein, 10 aa, Influenza virus
SSSSCYDGKA

SEQ ID NO: 513361 - protein, 10 aa, Influenza virus
SSSSFYAEMK

SEQ ID NO: 513362 - protein, 10 aa, Influenza virus
SSSSIVMCGV

SEQ ID NO: 513363 - protein, 10 aa, Influenza virus
SSSSTVFCGV

SEQ ID NO: 513364 - protein, 10 aa, Influenza virus
SSSSVVMCGV

SEQ ID NO: 513365 - protein, 10 aa, Influenza virus
SSSTVFCGVS

SEQ ID NO: 513366 - protein, 10 aa, Influenza virus
SSSVLLVSLG

SEQ ID NO: 513367 - protein, 10 aa, Influenza virus
SSSVVMCGVD

SEQ ID NO: 513368 - protein, 10 aa, Influenza virus
SSSYRRPIGI

SEQ ID NO: 513369 - protein, 10 aa, Influenza virus
SSSYRRPVGI

SEQ ID NO: 513370 - protein, 10 aa, Influenza virus
SSTEFLGQWD

SEQ ID NO: 513371 - protein, 10 aa, Influenza virus
SSTEFLGQWN

SEQ ID NO: 513372 - protein, 10 aa, Influenza virus
SSTKEKNDLY

SEQ ID NO: 513373 - protein, 10 aa, Influenza virus
SSTKEKNELY

SEQ ID NO: 513374 - protein, 10 aa, Influenza virus
SSTQEKNDLY

SEQ ID NO: 513375 - protein, 10 aa, Influenza virus
SSTQERNDLY

SEQ ID NO: 513376 - protein, 10 aa, Influenza virus
SSTSCFDGKE

SEQ ID NO: 513377 - protein, 10 aa, Influenza virus
SSTSCHDGIG

SEQ ID NO: 513378 - protein, 10 aa, Influenza virus
SSTSCHDGIS

SEQ ID NO: 513379 - protein, 10 aa, Influenza virus
SSTSCHDGKA

SEQ ID NO: 513380 - protein, 10 aa, Influenza virus
SSTSCHDGKF

SEQ ID NO: 513381 - protein, 10 aa, Influenza virus
SSTSCHDGKS

SEQ ID NO: 513382 - protein, 10 aa, Influenza virus
SSTSCHDGKT

SEQ ID NO: 513383 - protein, 10 aa, Influenza virus
SSTSCHDGMS

SEQ ID NO: 513384 - protein, 10 aa, Influenza virus
SSTSCHDGRA

SEQ ID NO: 513385 - protein, 10 aa, Influenza virus
SSTSCHDGRS

SEQ ID NO: 513386 - protein, 10 aa, Influenza virus
SSTSCHDGVG

SEQ ID NO: 513387 - protein, 10 aa, Influenza virus
SSTSCHDGVS

SEQ ID NO: 513388 - protein, 10 aa, Influenza virus
SSTTCHDGIG

SEQ ID NO: 513389 - protein, 10 aa, Influenza virus
SSTVFCGVSG

SEQ ID NO: 513390 - protein, 10 aa, Influenza virus
SSTVFCGVSS

SEQ ID NO: 513391 - protein, 10 aa, Influenza virus
SSTVLVGLIL

SEQ ID NO: 513392 - protein, 10 aa, Influenza virus
SSTVMVGLIL

SEQ ID NO: 513393 - protein, 10 aa, Influenza virus
SSTYQNNFVP

SEQ ID NO: 513394 - protein, 10 aa, Influenza virus
SSTYQNSFVP

SEQ ID NO: 513395 - protein, 10 aa, Influenza virus
SSVASSLVLL

SEQ ID NO: 513396 - protein, 10 aa, Influenza virus
SSVDLVETNH

SEQ ID NO: 513397 - protein, 10 aa, Influenza virus
SSVKEKDLTK

SEQ ID NO: 513398 - protein, 10 aa, Influenza virus
SSVKEKDMTK

SEQ ID NO: 513399 - protein, 10 aa, Influenza virus
SSVKEKDMTR

SEQ ID NO: 513400 - protein, 10 aa, Influenza virus
SSVLLVSLGA

SEQ ID NO: 513401 - protein, 10 aa, Influenza virus
SSVNTNTINR

SEQ ID NO: 513402 - protein, 10 aa, Influenza virus
SSVREKDMTK

SEQ ID NO: 513403 - protein, 10 aa, Influenza virus
SSVSSFEKFE

SEQ ID NO: 513404 - protein, 10 aa, Influenza virus
SSVSSFERFE

SEQ ID NO: 513405 - protein, 10 aa, Influenza virus
SSVSSFKRFE

SEQ ID NO: 513406 - protein, 10 aa, Influenza virus
SSVTTNTINR

SEQ ID NO: 513407 - protein, 10 aa, Influenza virus
SSVVLVGLIL

SEQ ID NO: 513408 - protein, 10 aa, Influenza virus
SSVVLVGPIL

SEQ ID NO: 513409 - protein, 10 aa, Influenza virus
SSVVMCGVDH

SEQ ID NO: 513410 - protein, 10 aa, Influenza virus
SSVYIEVLHL

SEQ ID NO: 513411 - protein, 10 aa, Influenza virus
SSVYVEVLHL

SEQ ID NO: 513412 - protein, 10 aa, Influenza virus
SSWHILSKDN

SEQ ID NO: 513413 - protein, 10 aa, Influenza virus
SSWSQNILRT

SEQ ID NO: 513414 - protein, 10 aa, Influenza virus
SSYICSGLVG

SEQ ID NO: 513415 - protein, 10 aa, Influenza virus
SSYLCSGLVG

SEQ ID NO: 513416 - protein, 10 aa, Influenza virus
SSYMCSGLVG

SEQ ID NO: 513417 - protein, 10 aa, Influenza virus
SSYRRPIGIS

SEQ ID NO: 513418 - protein, 10 aa, Influenza virus
SSYRRPVGIS

SEQ ID NO: 513419 - protein, 10 aa, Influenza virus
SSYVCSGLVG

SEQ ID NO: 513420 - protein, 10 aa, Influenza virus
STAASSLALA

SEQ ID NO: 513421 - protein, 10 aa, Influenza virus
STASRSGYEM

SEQ ID NO: 513422 - protein, 10 aa, Influenza virus
STASRSGYEV

SEQ ID NO: 513423 - protein, 10 aa, Influenza virus
STAVAVIKYN

SEQ ID NO: 513424 - protein, 10 aa, Influenza virus
STCVVVMTDG

SEQ ID NO: 513425 - protein, 10 aa, Influenza virus
STDKDSNGVQ

SEQ ID NO: 513426 - protein, 10 aa, Influenza virus
STDKIDTLTE

SEQ ID NO: 513427 - protein, 10 aa, Influenza virus
STDKNSNGVQ

SEQ ID NO: 513428 - protein, 10 aa, Influenza virus
STDKVDTIIE

SEQ ID NO: 513429 - protein, 10 aa, Influenza virus
STDKVDTLTE

SEQ ID NO: 513430 - protein, 10 aa, Influenza virus
STDKVNTIIE

SEQ ID NO: 513431 - protein, 10 aa, Influenza virus
STDTVDTILE

SEQ ID NO: 513432 - protein, 10 aa, Influenza virus
STDTVDTLIE

SEQ ID NO: 513433 - protein, 10 aa, Influenza virus
STDTVDTLLE

SEQ ID NO: 513434 - protein, 10 aa, Influenza virus
STDTVDTLTE

SEQ ID NO: 513435 - protein, 10 aa, Influenza virus
STDTVDTVLE

SEQ ID NO: 513436 - protein, 10 aa, Influenza virus
STDTVDTVRE

SEQ ID NO: 513437 - protein, 10 aa, Influenza virus
STDTVNTLIE

SEQ ID NO: 513438 - protein, 10 aa, Influenza virus
STDTVNTLME

SEQ ID NO: 513439 - protein, 10 aa, Influenza virus
STDTVNTLTE

SEQ ID NO: 513440 - protein, 10 aa, Influenza virus
STEFLGQWDW

SEQ ID NO: 513441 - protein, 10 aa, Influenza virus
STEFLGQWNW

SEQ ID NO: 513442 - protein, 10 aa, Influenza virus
STEHVDTIME

SEQ ID NO: 513443 - protein, 10 aa, Influenza virus
STEKVDTIIE

SEQ ID NO: 513444 - protein, 10 aa, Influenza virus
STEKVDTLLE

SEQ ID NO: 513445 - protein, 10 aa, Influenza virus
STEQVDTIME

SEQ ID NO: 513446 - protein, 10 aa, Influenza virus
STERVDTIIE

SEQ ID NO: 513447 - protein, 10 aa, Influenza virus
STERVDTIME

SEQ ID NO: 513448 - protein, 10 aa, Influenza virus
STETVNTLIE

SEQ ID NO: 513449 - protein, 10 aa, Influenza virus
STETVNTLSE

SEQ ID NO: 513450 - protein, 10 aa, Influenza virus
STETVNTLTE

SEQ ID NO: 513451 - protein, 10 aa, Influenza virus
STGALASCMG

SEQ ID NO: 513452 - protein, 10 aa, Influenza virus
STGAQSFYRS

SEQ ID NO: 513453 - protein, 10 aa, Influenza virus
STGGQAFYRS

SEQ ID NO: 513454 - protein, 10 aa, Influenza virus
STGGQSFYRS

SEQ ID NO: 513455 - protein, 10 aa, Influenza virus
STGKDPKKTG

SEQ ID NO: 513456 - protein, 10 aa, Influenza virus
STGNFIAPEY

SEQ ID NO: 513457 - protein, 10 aa, Influenza virus
STGNHGSLVL

SEQ ID NO: 513458 - protein, 10 aa, Influenza virus
STGNLIAPEY

SEQ ID NO: 513459 - protein, 10 aa, Influenza virus
STGNLIAPRG

SEQ ID NO: 513460 - protein, 10 aa, Influenza virus
STGNLVAPEY

SEQ ID NO: 513461 - protein, 10 aa, Influenza virus
STIALFIGVG

SEQ ID NO: 513462 - protein, 10 aa, Influenza virus
STIALIIGVG

SEQ ID NO: 513463 - protein, 10 aa, Influenza virus
STIALLIGIG

SEQ ID NO: 513464 - protein, 10 aa, Influenza virus
STIALLIGVG

SEQ ID NO: 513465 - protein, 10 aa, Influenza virus
STIGDCPKYV

SEQ ID NO: 513466 - protein, 10 aa, Influenza virus
STISCDSPSN

SEQ ID NO: 513467 - protein, 10 aa, Influenza virus
STKEKNDLYG

SEQ ID NO: 513468 - protein, 10 aa, Influenza virus
STKEKNELYG

SEQ ID NO: 513469 - protein, 10 aa, Influenza virus
STKEWSKRYE

SEQ ID NO: 513470 - protein, 10 aa, Influenza virus
STKEWSRRYE

SEQ ID NO: 513471 - protein, 10 aa, Influenza virus
STKQVDTIME

SEQ ID NO: 513472 - protein, 10 aa, Influenza virus
STKSTVLKSD

SEQ ID NO: 513473 - protein, 10 aa, Influenza virus
STLGLDIRTA

SEQ ID NO: 513474 - protein, 10 aa, Influenza virus
STLKLATGMR

SEQ ID NO: 513475 - protein, 10 aa, Influenza virus
STLPRRSGAA

SEQ ID NO: 513476 - protein, 10 aa, Influenza virus
STLVLLVSLG

SEQ ID NO: 513477 - protein, 10 aa, Influenza virus
STMLNLYERV

SEQ ID NO: 513478 - protein, 10 aa, Influenza virus
STMSCDSPSN

SEQ ID NO: 513479 - protein, 10 aa, Influenza virus
STNAHDRICI

SEQ ID NO: 513480 - protein, 10 aa, Influenza virus
STNAYDRICI

SEQ ID NO: 513481 - protein, 10 aa, Influenza virus
STNSSDKVDT

SEQ ID NO: 513482 - protein, 10 aa, Influenza virus
STNSSEKVDT

SEQ ID NO: 513483 - protein, 10 aa, Influenza virus
STNSSEKVNT

SEQ ID NO: 513484 - protein, 10 aa, Influenza virus
STNSSERVDT

SEQ ID NO: 513485 - protein, 10 aa, Influenza virus
STNSTEKVDT

SEQ ID NO: 513486 - protein, 10 aa, Influenza virus
STNTVNTLIE

SEQ ID NO: 513487 - protein, 10 aa, Influenza virus
STPLGSPPIV

SEQ ID NO: 513488 - protein, 10 aa, Influenza virus
STPLGSPPMV

SEQ ID NO: 513489 - protein, 10 aa, Influenza virus
STPLGSPPVV

SEQ ID NO: 513490 - protein, 10 aa, Influenza virus
STPLGTPPTV

SEQ ID NO: 513491 - protein, 10 aa, Influenza virus
STPSAIDQIT

SEQ ID NO: 513492 - protein, 10 aa, Influenza virus
STQAAIDQIN

SEQ ID NO: 513493 - protein, 10 aa, Influenza virus
STQAAIDQIT

SEQ ID NO: 513494 - protein, 10 aa, Influenza virus
STQAAIDQMT

SEQ ID NO: 513495 - protein, 10 aa, Influenza virus
STQAAVDQIT

SEQ ID NO: 513496 - protein, 10 aa, Influenza virus
STQEAIDKIT

SEQ ID NO: 513497 - protein, 10 aa, Influenza virus
STQEAIEKIT

SEQ ID NO: 513498 - protein, 10 aa, Influenza virus
STQEAIGKIT

SEQ ID NO: 513499 - protein, 10 aa, Influenza virus
STQEAINKIT

SEQ ID NO: 513500 - protein, 10 aa, Influenza virus
STQEKNALYG

SEQ ID NO: 513501 - protein, 10 aa, Influenza virus
STQEKNDLYG

SEQ ID NO: 513502 - protein, 10 aa, Influenza virus
STQKAIDEIT

SEQ ID NO: 513503 - protein, 10 aa, Influenza virus
STQKAIDGIT

SEQ ID NO: 513504 - protein, 10 aa, Influenza virus
STQKAIDGVT

SEQ ID NO: 513505 - protein, 10 aa, Influenza virus
STQKAIDIMQ

SEQ ID NO: 513506 - protein, 10 aa, Influenza virus
STQKAIDNMQ

SEQ ID NO: 513507 - protein, 10 aa, Influenza virus
STQKAIDQIT

SEQ ID NO: 513508 - protein, 10 aa, Influenza virus
STQKAIDRIT

SEQ ID NO: 513509 - protein, 10 aa, Influenza virus
STQKAINEIT

SEQ ID NO: 513510 - protein, 10 aa, Influenza virus
STQKAINGIT

SEQ ID NO: 513511 - protein, 10 aa, Influenza virus
STQKAINGVT

SEQ ID NO: 513512 - protein, 10 aa, Influenza virus
STQKALNEIT

SEQ ID NO: 513513 - protein, 10 aa, Influenza virus
STQKAVDGIT

SEQ ID NO: 513514 - protein, 10 aa, Influenza virus
STQKTIDQVT

SEQ ID NO: 513515 - protein, 10 aa, Influenza virus
STQMAIDNMQ

SEQ ID NO: 513516 - protein, 10 aa, Influenza virus
STQPTFSVQR

SEQ ID NO: 513517 - protein, 10 aa, Influenza virus
STQRAIDGIT

SEQ ID NO: 513518 - protein, 10 aa, Influenza virus
STQRAIDGVT

SEQ ID NO: 513519 - protein, 10 aa, Influenza virus
STQRAIDNMQ

SEQ ID NO: 513520 - protein, 10 aa, Influenza virus
STQSAIDQIT

SEQ ID NO: 513521 - protein, 10 aa, Influenza virus
STQSAIDQVT

SEQ ID NO: 513522 - protein, 10 aa, Influenza virus
STQSAINQIT

SEQ ID NO: 513523 - protein, 10 aa, Influenza virus
STQSAVDQIT

SEQ ID NO: 513524 - protein, 10 aa, Influenza virus
STQSAVNQIT

SEQ ID NO: 513525 - protein, 10 aa, Influenza virus
STRGIQIASN

SEQ ID NO: 513526 - protein, 10 aa, Influenza virus
STRGVQIASN

SEQ ID NO: 513527 - protein, 10 aa, Influenza virus
STRGVQVASN

SEQ ID NO: 513528 - protein, 10 aa, Influenza virus
STRSDQISIV

SEQ ID NO: 513529 - protein, 10 aa, Influenza virus
STSCFDGKEW

SEQ ID NO: 513530 - protein, 10 aa, Influenza virus
STSCHDGIGR

SEQ ID NO: 513531 - protein, 10 aa, Influenza virus
STSCHDGISR

SEQ ID NO: 513532 - protein, 10 aa, Influenza virus
STSCHDGKAR

SEQ ID NO: 513533 - protein, 10 aa, Influenza virus
STSCHDGKFR

SEQ ID NO: 513534 - protein, 10 aa, Influenza virus
STSCHDGKSR

SEQ ID NO: 513535 - protein, 10 aa, Influenza virus
STSCHDGKTR

SEQ ID NO: 513536 - protein, 10 aa, Influenza virus
STSCHDGMSR

SEQ ID NO: 513537 - protein, 10 aa, Influenza virus
STSCHDGRAR

SEQ ID NO: 513538 - protein, 10 aa, Influenza virus
STSCHDGRSR

SEQ ID NO: 513539 - protein, 10 aa, Influenza virus
STSCHDGVGR

SEQ ID NO: 513540 - protein, 10 aa, Influenza virus
STSCHDGVSR

SEQ ID NO: 513541 - protein, 10 aa, Influenza virus
STTAKAMEQM

SEQ ID NO: 513542 - protein, 10 aa, Influenza virus
STTAKAMEQV

SEQ ID NO: 513543 - protein, 10 aa, Influenza virus
STTCHDGIGR

SEQ ID NO: 513544 - protein, 10 aa, Influenza virus
STTFPYTGDP

SEQ ID NO: 513545 - protein, 10 aa, Influenza virus
STTGMTLSVV

SEQ ID NO: 513546 - protein, 10 aa, Influenza virus
STTHDRTAFR

SEQ ID NO: 513547 - protein, 10 aa, Influenza virus
STVAASLCLA

SEQ ID NO: 513548 - protein, 10 aa, Influenza virus
STVASSLALA

SEQ ID NO: 513549 - protein, 10 aa, Influenza virus
STVASSLTLA

SEQ ID NO: 513550 - protein, 10 aa, Influenza virus
STVASSLVLA

SEQ ID NO: 513551 - protein, 10 aa, Influenza virus
STVFCGVSGE

SEQ ID NO: 513552 - protein, 10 aa, Influenza virus
STVFCGVSSE

SEQ ID NO: 513553 - protein, 10 aa, Influenza virus
STVLGVSILN

SEQ ID NO: 513554 - protein, 10 aa, Influenza virus
STVLGVSVLN

SEQ ID NO: 513555 - protein, 10 aa, Influenza virus
STVLKSDKRI

SEQ ID NO: 513556 - protein, 10 aa, Influenza virus
STVLVGLILA

SEQ ID NO: 513557 - protein, 10 aa, Influenza virus
STVMVGLILA

SEQ ID NO: 513558 - protein, 10 aa, Influenza virus
STVNEEALRQ

SEQ ID NO: 513559 - protein, 10 aa, Influenza virus
STVQVDTIME

SEQ ID NO: 513560 - protein, 10 aa, Influenza virus
STVSCDSPSN

SEQ ID NO: 513561 - protein, 10 aa, Influenza virus
STVSSFERFE

SEQ ID NO: 513562 - protein, 10 aa, Influenza virus
STVSSGLVLV

SEQ ID NO: 513563 - protein, 10 aa, Influenza virus
STVSSSLVLA

SEQ ID NO: 513564 - protein, 10 aa, Influenza virus
STVSSSLVLV

SEQ ID NO: 513565 - protein, 10 aa, Influenza virus
STVVNNITTT

SEQ ID NO: 513566 - protein, 10 aa, Influenza virus
STVVSSLALA

SEQ ID NO: 513567 - protein, 10 aa, Influenza virus
STWLGRTISP

SEQ ID NO: 513568 - protein, 10 aa, Influenza virus
STYHNSFVPV

SEQ ID NO: 513569 - protein, 10 aa, Influenza virus
STYKILSIYS

SEQ ID NO: 513570 - protein, 10 aa, Influenza virus
STYQNNFVPV

SEQ ID NO: 513571 - protein, 10 aa, Influenza virus
STYQNSFVPV

SEQ ID NO: 513572 - protein, 10 aa, Influenza virus
SVAGWLLGNP

SEQ ID NO: 513573 - protein, 10 aa, Influenza virus
SVAHKSCLPA

SEQ ID NO: 513574 - protein, 10 aa, Influenza virus
SVAPIMFSNK

SEQ ID NO: 513575 - protein, 10 aa, Influenza virus
SVASSLVLLF

SEQ ID NO: 513576 - protein, 10 aa, Influenza virus
SVASSLVLLL

SEQ ID NO: 513577 - protein, 10 aa, Influenza virus
SVAWSASACH

SEQ ID NO: 513578 - protein, 10 aa, Influenza virus
SVAWSATACH

SEQ ID NO: 513579 - protein, 10 aa, Influenza virus
SVAWSATACS

SEQ ID NO: 513580 - protein, 10 aa, Influenza virus
SVCISGPNNN

SEQ ID NO: 513581 - protein, 10 aa, Influenza virus
SVCMSGPNNN

SEQ ID NO: 513582 - protein, 10 aa, Influenza virus
SVCYNPCFYV

SEQ ID NO: 513583 - protein, 10 aa, Influenza virus
SVDLVETNHT

SEQ ID NO: 513584 - protein, 10 aa, Influenza virus
SVECVCRDNW

SEQ ID NO: 513585 - protein, 10 aa, Influenza virus
SVEGWVVIAK

SEQ ID NO: 513586 - protein, 10 aa, Influenza virus
SVENLEELRF

SEQ ID NO: 513587 - protein, 10 aa, Influenza virus
SVENQEELRS

SEQ ID NO: 513588 - protein, 10 aa, Influenza virus
SVEPKGLFGA

SEQ ID NO: 513589 - protein, 10 aa, Influenza virus
SVEPRGLFGA

SEQ ID NO: 513590 - protein, 10 aa, Influenza virus
SVESSTYQNN

SEQ ID NO: 513591 - protein, 10 aa, Influenza virus
SVEYASKTRI

SEQ ID NO: 513592 - protein, 10 aa, Influenza virus
SVFNCLYASP

SEQ ID NO: 513593 - protein, 10 aa, Influenza virus
SVFNSIYASP

SEQ ID NO: 513594 - protein, 10 aa, Influenza virus
SVFNSLYASP

SEQ ID NO: 513595 - protein, 10 aa, Influenza virus
SVFNSLYASS

SEQ ID NO: 513596 - protein, 10 aa, Influenza virus
SVFNSLYSSP

SEQ ID NO: 513597 - protein, 10 aa, Influenza virus
SVGGIDTNKT

SEQ ID NO: 513598 - protein, 10 aa, Influenza virus
SVGGINTNKT

SEQ ID NO: 513599 - protein, 10 aa, Influenza virus
SVGGINTNRT

SEQ ID NO: 513600 - protein, 10 aa, Influenza virus
SVGKEFSNLE

SEQ ID NO: 513601 - protein, 10 aa, Influenza virus
SVGSGSFPDG

SEQ ID NO: 513602 - protein, 10 aa, Influenza virus
SVGSSIYQNS

SEQ ID NO: 513603 - protein, 10 aa, Influenza virus
SVGSSTYQNN

SEQ ID NO: 513604 - protein, 10 aa, Influenza virus
SVGSSTYQNS

SEQ ID NO: 513605 - protein, 10 aa, Influenza virus
SVGSWSQNIL

SEQ ID NO: 513606 - protein, 10 aa, Influenza virus
SVGTSTLNLR

SEQ ID NO: 513607 - protein, 10 aa, Influenza virus
SVGTSTLNQK

SEQ ID NO: 513608 - protein, 10 aa, Influenza virus
SVGTSTLNQR

SEQ ID NO: 513609 - protein, 10 aa, Influenza virus
SVGWSATACH

SEQ ID NO: 513610 - protein, 10 aa, Influenza virus
SVHRNTIGDC

SEQ ID NO: 513611 - protein, 10 aa, Influenza virus
SVIEKMNIQF

SEQ ID NO: 513612 - protein, 10 aa, Influenza virus
SVIEKMNTQF

SEQ ID NO: 513613 - protein, 10 aa, Influenza virus
SVIPSGPLKA

SEQ ID NO: 513614 - protein, 10 aa, Influenza virus
SVIREPFISC

SEQ ID NO: 513615 - protein, 10 aa, Influenza virus
SVKLSSGYKD

SEQ ID NO: 513616 - protein, 10 aa, Influenza virus
SVKMEKIVLL

SEQ ID NO: 513617 - protein, 10 aa, Influenza virus
SVKNGTYDYP

SEQ ID NO: 513618 - protein, 10 aa, Influenza virus
SVKNGTYNYP

SEQ ID NO: 513619 - protein, 10 aa, Influenza virus
SVKTLTDNHV

SEQ ID NO: 513620 - protein, 10 aa, Influenza virus
SVLINTYQWI

SEQ ID NO: 513621 - protein, 10 aa, Influenza virus
SVLNLLIGIS

SEQ ID NO: 513622 - protein, 10 aa, Influenza virus
SVLNLLIGVS

SEQ ID NO: 513623 - protein, 10 aa, Influenza virus
SVLVNTYQWI

SEQ ID NO: 513624 - protein, 10 aa, Influenza virus
SVLVNTYQWV

SEQ ID NO: 513625 - protein, 10 aa, Influenza virus
SVNTNTINRS

SEQ ID NO: 513626 - protein, 10 aa, Influenza virus
SVNTVLSIIA

SEQ ID NO: 513627 - protein, 10 aa, Influenza virus
SVPASRYLID

SEQ ID NO: 513628 - protein, 10 aa, Influenza virus
SVPASRYLTD

SEQ ID NO: 513629 - protein, 10 aa, Influenza virus
SVPLGSSPNA

SEQ ID NO: 513630 - protein, 10 aa, Influenza virus
SVPLGSSSNA

SEQ ID NO: 513631 - protein, 10 aa, Influenza virus
SVPMGSSPNA

SEQ ID NO: 513632 - protein, 10 aa, Influenza virus
SVQPAFSVQR

SEQ ID NO: 513633 - protein, 10 aa, Influenza virus
SVQPTFSVQR

SEQ ID NO: 513634 - protein, 10 aa, Influenza virus
SVQRNLPFDK

SEQ ID NO: 513635 - protein, 10 aa, Influenza virus
SVQRNLPFEK

SEQ ID NO: 513636 - protein, 10 aa, Influenza virus
SVQRNLPFER

SEQ ID NO: 513637 - protein, 10 aa, Influenza virus
SVQRSLPFER

SEQ ID NO: 513638 - protein, 10 aa, Influenza virus
SVQSRGLFGA

SEQ ID NO: 513639 - protein, 10 aa, Influenza virus
SVRGSGMRIL

SEQ ID NO: 513640 - protein, 10 aa, Influenza virus
SVRIGSKGDV

SEQ ID NO: 513641 - protein, 10 aa, Influenza virus
SVRLSAGGDI

SEQ ID NO: 513642 - protein, 10 aa, Influenza virus
SVRLSASGDI

SEQ ID NO: 513643 - protein, 10 aa, Influenza virus
SVRNGTYDYP

SEQ ID NO: 513644 - protein, 10 aa, Influenza virus
SVSECRTFFL

SEQ ID NO: 513645 - protein, 10 aa, Influenza virus
SVSSFEKFEI

SEQ ID NO: 513646 - protein, 10 aa, Influenza virus
SVSSFERFEI

SEQ ID NO: 513647 - protein, 10 aa, Influenza virus
SVSSFERFEM

SEQ ID NO: 513648 - protein, 10 aa, Influenza virus
SVSSFKRFEI

SEQ ID NO: 513649 - protein, 10 aa, Influenza virus
SVTDGPAANS

SEQ ID NO: 513650 - protein, 10 aa, Influenza virus
SVTELWSYNA

SEQ ID NO: 513651 - protein, 10 aa, Influenza virus
SVTQTLVSNN

SEQ ID NO: 513652 - protein, 10 aa, Influenza virus
SVTTNTINRI

SEQ ID NO: 513653 - protein, 10 aa, Influenza virus
SVTTNTINRN

SEQ ID NO: 513654 - protein, 10 aa, Influenza virus
SVTTNTINRS

SEQ ID NO: 513655 - protein, 10 aa, Influenza virus
SVVEKMNTQF

SEQ ID NO: 513656 - protein, 10 aa, Influenza virus
SVVLVGLILA

SEQ ID NO: 513657 - protein, 10 aa, Influenza virus
SVVSCDSPSN

SEQ ID NO: 513658 - protein, 10 aa, Influenza virus
SVVVFCGTSG

SEQ ID NO: 513659 - protein, 10 aa, Influenza virus
SVYIEVLHLT

SEQ ID NO: 513660 - protein, 10 aa, Influenza virus
SVYKALSIYS

SEQ ID NO: 513661 - protein, 10 aa, Influenza virus
SVYSTVASSL

SEQ ID NO: 513662 - protein, 10 aa, Influenza virus
SVYVEVLHLT

SEQ ID NO: 513663 - protein, 10 aa, Influenza virus
SVYWTIVKPG

SEQ ID NO: 513664 - protein, 10 aa, Influenza virus
SVYWTVVKPG

SEQ ID NO: 513665 - protein, 10 aa, Influenza virus
SWAGNILRTQ

SEQ ID NO: 513666 - protein, 10 aa, Influenza virus
SWAGNVLRTQ

SEQ ID NO: 513667 - protein, 10 aa, Influenza virus
SWASNSIVTF

SEQ ID NO: 513668 - protein, 10 aa, Influenza virus
SWAVGRCPRY

SEQ ID NO: 513669 - protein, 10 aa, Influenza virus
SWDDGAILPF

SEQ ID NO: 513670 - protein, 10 aa, Influenza virus
SWDDGAILPL

SEQ ID NO: 513671 - protein, 10 aa, Influenza virus
SWEGNILRTQ

SEQ ID NO: 513672 - protein, 10 aa, Influenza virus
SWEMGLAPSP

SEQ ID NO: 513673 - protein, 10 aa, Influenza virus
SWEMGQAPSP

SEQ ID NO: 513674 - protein, 10 aa, Influenza virus
SWGMGQAPSP

SEQ ID NO: 513675 - protein, 10 aa, Influenza virus
SWHDGAEIIY

SEQ ID NO: 513676 - protein, 10 aa, Influenza virus
SWHDGAEITY

SEQ ID NO: 513677 - protein, 10 aa, Influenza virus
SWHDGAILPF

SEQ ID NO: 513678 - protein, 10 aa, Influenza virus
SWHDGAILPL

SEQ ID NO: 513679 - protein, 10 aa, Influenza virus
SWHDGAVLPF

SEQ ID NO: 513680 - protein, 10 aa, Influenza virus
SWHIFGKDNA

SEQ ID NO: 513681 - protein, 10 aa, Influenza virus
SWHIFSKDNA

SEQ ID NO: 513682 - protein, 10 aa, Influenza virus
SWHILSKDNA

SEQ ID NO: 513683 - protein, 10 aa, Influenza virus
SWHIYGKDNA

SEQ ID NO: 513684 - protein, 10 aa, Influenza virus
SWIPKRNRSI

SEQ ID NO: 513685 - protein, 10 aa, Influenza virus
SWKGNIMRTQ

SEQ ID NO: 513686 - protein, 10 aa, Influenza virus
SWKKQILRTQ

SEQ ID NO: 513687 - protein, 10 aa, Influenza virus
SWLGRTISKD

SEQ ID NO: 513688 - protein, 10 aa, Influenza virus
SWLGRTTSKD

SEQ ID NO: 513689 - protein, 10 aa, Influenza virus
SWLIIGISGP

SEQ ID NO: 513690 - protein, 10 aa, Influenza virus
SWLTIGISGP

SEQ ID NO: 513691 - protein, 10 aa, Influenza virus
SWLTIGVSGP

SEQ ID NO: 513692 - protein, 10 aa, Influenza virus
SWMKIYWHLM

SEQ ID NO: 513693 - protein, 10 aa, Influenza virus
SWMKLYWHLM

SEQ ID NO: 513694 - protein, 10 aa, Influenza virus
SWPDDAELPF

SEQ ID NO: 513695 - protein, 10 aa, Influenza virus
SWPDGADINF

SEQ ID NO: 513696 - protein, 10 aa, Influenza virus
SWPDGADLPF

SEQ ID NO: 513697 - protein, 10 aa, Influenza virus
SWPDGAELPF

SEQ ID NO: 513698 - protein, 10 aa, Influenza virus
SWPDGAELPS

SEQ ID NO: 513699 - protein, 10 aa, Influenza virus
SWPDGAEVPF

SEQ ID NO: 513700 - protein, 10 aa, Influenza virus
SWPDGAKLPF

SEQ ID NO: 513701 - protein, 10 aa, Influenza virus
SWPDGALFPL

SEQ ID NO: 513702 - protein, 10 aa, Influenza virus
SWPDGALLPF

SEQ ID NO: 513703 - protein, 10 aa, Influenza virus
SWPDGALLPL

SEQ ID NO: 513704 - protein, 10 aa, Influenza virus
SWPDGANIDF

SEQ ID NO: 513705 - protein, 10 aa, Influenza virus
SWPDGANINF

SEQ ID NO: 513706 - protein, 10 aa, Influenza virus
SWPDGANINL

SEQ ID NO: 513707 - protein, 10 aa, Influenza virus
SWPDGANISF

SEQ ID NO: 513708 - protein, 10 aa, Influenza virus
SWPDRAELPF

SEQ ID NO: 513709 - protein, 10 aa, Influenza virus
SWPLSSPPTV

SEQ ID NO: 513710 - protein, 10 aa, Influenza virus
SWPQSSPPTV

SEQ ID NO: 513711 - protein, 10 aa, Influenza virus
SWQDGAILPF

SEQ ID NO: 513712 - protein, 10 aa, Influenza virus
SWRKDILRTQ

SEQ ID NO: 513713 - protein, 10 aa, Influenza virus
SWRKKILRTQ

SEQ ID NO: 513714 - protein, 10 aa, Influenza virus
SWRKQILRTQ

SEQ ID NO: 513715 - protein, 10 aa, Influenza virus
SWRRDILRTQ

SEQ ID NO: 513716 - protein, 10 aa, Influenza virus
SWRRQILRTQ

SEQ ID NO: 513717 - protein, 10 aa, Influenza virus
SWSHNILRTQ

SEQ ID NO: 513718 - protein, 10 aa, Influenza virus
SWSKNILRTQ

SEQ ID NO: 513719 - protein, 10 aa, Influenza virus
SWSLNILRTQ

SEQ ID NO: 513720 - protein, 10 aa, Influenza virus
SWSLQCRICI

SEQ ID NO: 513721 - protein, 10 aa, Influenza virus
SWSQNILRTQ

SEQ ID NO: 513722 - protein, 10 aa, Influenza virus
SWSWHDGAEI

SEQ ID NO: 513723 - protein, 10 aa, Influenza virus
SWSWHDGAIL

SEQ ID NO: 513724 - protein, 10 aa, Influenza virus
SWSWHDGAVL

SEQ ID NO: 513725 - protein, 10 aa, Influenza virus
SWSWPDGALL

SEQ ID NO: 513726 - protein, 10 aa, Influenza virus
SWSYIVEKLN

SEQ ID NO: 513727 - protein, 10 aa, Influenza virus
SWSYIVEKPN

SEQ ID NO: 513728 - protein, 10 aa, Influenza virus
SWSYIVEKSN

SEQ ID NO: 513729 - protein, 10 aa, Influenza virus
SWSYIVEKTN

SEQ ID NO: 513730 - protein, 10 aa, Influenza virus
SWSYIVERPS

SEQ ID NO: 513731 - protein, 10 aa, Influenza virus
SWTPKRNRSI

SEQ ID NO: 513732 - protein, 10 aa, Influenza virus
SWTSNSIITF

SEQ ID NO: 513733 - protein, 10 aa, Influenza virus
SWTSNSIVTF

SEQ ID NO: 513734 - protein, 10 aa, Influenza virus
SWTSNSMVTF

SEQ ID NO: 513735 - protein, 10 aa, Influenza virus
SWVPILNTSQ

SEQ ID NO: 513736 - protein, 10 aa, Influenza virus
SWVPKRNRSI

SEQ ID NO: 513737 - protein, 10 aa, Influenza virus
SYCRATEYIM

SEQ ID NO: 513738 - protein, 10 aa, Influenza virus
SYFANLKGTR

SEQ ID NO: 513739 - protein, 10 aa, Influenza virus
SYFFGDNAED

SEQ ID NO: 513740 - protein, 10 aa, Influenza virus
SYFFGDNAEE

SEQ ID NO: 513741 - protein, 10 aa, Influenza virus
SYFFGDNAKE

SEQ ID NO: 513742 - protein, 10 aa, Influenza virus
SYFFGDSAEE

SEQ ID NO: 513743 - protein, 10 aa, Influenza virus
SYFQLFLVCV

SEQ ID NO: 513744 - protein, 10 aa, Influenza virus
SYGRIIQNED

SEQ ID NO: 513745 - protein, 10 aa, Influenza virus
SYICSGLVGD

SEQ ID NO: 513746 - protein, 10 aa, Influenza virus
SYIIRALTLN

SEQ ID NO: 513747 - protein, 10 aa, Influenza virus
SYINKTGTFE

SEQ ID NO: 513748 - protein, 10 aa, Influenza virus
SYINRTGTFE

SEQ ID NO: 513749 - protein, 10 aa, Influenza virus
SYIVERPKEI

SEQ ID NO: 513750 - protein, 10 aa, Influenza virus
SYIVERPKEM

SEQ ID NO: 513751 - protein, 10 aa, Influenza virus
SYIVERPSAP

SEQ ID NO: 513752 - protein, 10 aa, Influenza virus
SYIVERTKEM

SEQ ID NO: 513753 - protein, 10 aa, Influenza virus
SYKILSIYST

SEQ ID NO: 513754 - protein, 10 aa, Influenza virus
SYKRIRLFDY

SEQ ID NO: 513755 - protein, 10 aa, Influenza virus
SYKRVRLFDY

SEQ ID NO: 513756 - protein, 10 aa, Influenza virus
SYKVGYLCAG

SEQ ID NO: 513757 - protein, 10 aa, Influenza virus
SYLCSGLVGD

SEQ ID NO: 513758 - protein, 10 aa, Influenza virus
SYLECRTFFL

SEQ ID NO: 513759 - protein, 10 aa, Influenza virus
SYLIEDPAAP

SEQ ID NO: 513760 - protein, 10 aa, Influenza virus
SYLIEDPGAP

SEQ ID NO: 513761 - protein, 10 aa, Influenza virus
SYLIEDPNAP

SEQ ID NO: 513762 - protein, 10 aa, Influenza virus
SYLIEDPSAP

SEQ ID NO: 513763 - protein, 10 aa, Influenza virus
SYLIEDPTAP

SEQ ID NO: 513764 - protein, 10 aa, Influenza virus
SYLIRALTLN

SEQ ID NO: 513765 - protein, 10 aa, Influenza virus
SYLIRTLTLN

SEQ ID NO: 513766 - protein, 10 aa, Influenza virus
SYLLLNKSLC

SEQ ID NO: 513767 - protein, 10 aa, Influenza virus
SYLNVRCVCR

SEQ ID NO: 513768 - protein, 10 aa, Influenza virus
SYMCSGLVGD

SEQ ID NO: 513769 - protein, 10 aa, Influenza virus
SYNADLLVAM

SEQ ID NO: 513770 - protein, 10 aa, Influenza virus
SYNADVLVAL

SEQ ID NO: 513771 - protein, 10 aa, Influenza virus
SYNAEFLVAL

SEQ ID NO: 513772 - protein, 10 aa, Influenza virus
SYNAEFLVAV

SEQ ID NO: 513773 - protein, 10 aa, Influenza virus
SYNAEILVAL

SEQ ID NO: 513774 - protein, 10 aa, Influenza virus
SYNAELLIAM

SEQ ID NO: 513775 - protein, 10 aa, Influenza virus
SYNAELLVAI

SEQ ID NO: 513776 - protein, 10 aa, Influenza virus
SYNAELLVAL

SEQ ID NO: 513777 - protein, 10 aa, Influenza virus
SYNAELLVAM

SEQ ID NO: 513778 - protein, 10 aa, Influenza virus
SYNAGLLVAL

SEQ ID NO: 513779 - protein, 10 aa, Influenza virus
SYNAKLLVLI

SEQ ID NO: 513780 - protein, 10 aa, Influenza virus
SYNAKLLVLL

SEQ ID NO: 513781 - protein, 10 aa, Influenza virus
SYNAQLLVLL

SEQ ID NO: 513782 - protein, 10 aa, Influenza virus
SYNAQLLVWL

SEQ ID NO: 513783 - protein, 10 aa, Influenza virus
SYNARLLVLL

SEQ ID NO: 513784 - protein, 10 aa, Influenza virus
SYNNTNGEQI

SEQ ID NO: 513785 - protein, 10 aa, Influenza virus
SYNNTSGEQI

SEQ ID NO: 513786 - protein, 10 aa, Influenza virus
SYNNTSGEQM

SEQ ID NO: 513787 - protein, 10 aa, Influenza virus
SYNNTSGEQV

SEQ ID NO: 513788 - protein, 10 aa, Influenza virus
SYNNTSGKQM

SEQ ID NO: 513789 - protein, 10 aa, Influenza virus
SYPNVRCVCR

SEQ ID NO: 513790 - protein, 10 aa, Influenza virus
SYQVGYLCAG

SEQ ID NO: 513791 - protein, 10 aa, Influenza virus
SYRRPIGISS

SEQ ID NO: 513792 - protein, 10 aa, Influenza virus
SYRRPVGISS

SEQ ID NO: 513793 - protein, 10 aa, Influenza virus
SYRSLIRFPI

SEQ ID NO: 513794 - protein, 10 aa, Influenza virus
SYRTLLMNEL

SEQ ID NO: 513795 - protein, 10 aa, Influenza virus
SYRTLLMSEL

SEQ ID NO: 513796 - protein, 10 aa, Influenza virus
SYRVGYLCAG

SEQ ID NO: 513797 - protein, 10 aa, Influenza virus
SYSAGALASC

SEQ ID NO: 513798 - protein, 10 aa, Influenza virus
SYSTGALASC

SEQ ID NO: 513799 - protein, 10 aa, Influenza virus
SYSVGYLCAG

SEQ ID NO: 513800 - protein, 10 aa, Influenza virus
SYTVGYLCAG

SEQ ID NO: 513801 - protein, 10 aa, Influenza virus
SYVCSGLVGD

SEQ ID NO: 513802 - protein, 10 aa, Influenza virus
SYVRLYLWGV

SEQ ID NO: 513803 - protein, 10 aa, Influenza virus
SYWMCSNGSL

SEQ ID NO: 513804 - protein, 10 aa, Influenza virus
SYWWDGLQSS

SEQ ID NO: 513805 - protein, 10 aa, Influenza virus
TAADLKSTQA

SEQ ID NO: 513806 - protein, 10 aa, Influenza virus
TAADLKSTQT

SEQ ID NO: 513807 - protein, 10 aa, Influenza virus
TAADYKSTPS

SEQ ID NO: 513808 - protein, 10 aa, Influenza virus
TAADYKSTQA

SEQ ID NO: 513809 - protein, 10 aa, Influenza virus
TAADYKSTQS

SEQ ID NO: 513810 - protein, 10 aa, Influenza virus
TAAQKAMMDQ

SEQ ID NO: 513811 - protein, 10 aa, Influenza virus
TAAQRAMMDQ

SEQ ID NO: 513812 - protein, 10 aa, Influenza virus
TAAQRAMVDQ

SEQ ID NO: 513813 - protein, 10 aa, Influenza virus
TAASSLALAI

SEQ ID NO: 513814 - protein, 10 aa, Influenza virus
TACFEIFHKC

SEQ ID NO: 513815 - protein, 10 aa, Influenza virus
TACHDGKEWL

SEQ ID NO: 513816 - protein, 10 aa, Influenza virus
TACHDGKEWM

SEQ ID NO: 513817 - protein, 10 aa, Influenza virus
TACHDGKGWL

SEQ ID NO: 513818 - protein, 10 aa, Influenza virus
TACHDGKKWL

SEQ ID NO: 513819 - protein, 10 aa, Influenza virus
TACHDGKKWM

SEQ ID NO: 513820 - protein, 10 aa, Influenza virus
TACHDGKKWT

SEQ ID NO: 513821 - protein, 10 aa, Influenza virus
TACHDGNKWM

SEQ ID NO: 513822 - protein, 10 aa, Influenza virus
TACHDGRKWM

SEQ ID NO: 513823 - protein, 10 aa, Influenza virus
TACSDGPGWL

SEQ ID NO: 513824 - protein, 10 aa, Influenza virus
TACSDGSGWL

SEQ ID NO: 513825 - protein, 10 aa, Influenza virus
TADKDSNGVQ

SEQ ID NO: 513826 - protein, 10 aa, Influenza virus
TAEISHCRAT

SEQ ID NO: 513827 - protein, 10 aa, Influenza virus
TAEVSHCRAT

SEQ ID NO: 513828 - protein, 10 aa, Influenza virus
TAEVSYCRAT

SEQ ID NO: 513829 - protein, 10 aa, Influenza virus
TAFRGLISTP

SEQ ID NO: 513830 - protein, 10 aa, Influenza virus
TAFRGLMSTP

SEQ ID NO: 513831 - protein, 10 aa, Influenza virus
TAFSGMSANG

SEQ ID NO: 513832 - protein, 10 aa, Influenza virus
TAIDQINGKL

SEQ ID NO: 513833 - protein, 10 aa, Influenza virus
TAIDQITGKL

SEQ ID NO: 513834 - protein, 10 aa, Influenza virus
TAKAMEQMAG

SEQ ID NO: 513835 - protein, 10 aa, Influenza virus
TAKAMEQVAG

SEQ ID NO: 513836 - protein, 10 aa, Influenza virus
TAKHIEECSC

SEQ ID NO: 513837 - protein, 10 aa, Influenza virus
TAKHIEECSS

SEQ ID NO: 513838 - protein, 10 aa, Influenza virus
TALANTIEIF

SEQ ID NO: 513839 - protein, 10 aa, Influenza virus
TALANTIEVF

SEQ ID NO: 513840 - protein, 10 aa, Influenza virus
TALLNASCAA

SEQ ID NO: 513841 - protein, 10 aa, Influenza virus
TALSTIALLI

SEQ ID NO: 513842 - protein, 10 aa, Influenza virus
TALYKNANTL

SEQ ID NO: 513843 - protein, 10 aa, Influenza virus
TAMDDFQLIP

SEQ ID NO: 513844 - protein, 10 aa, Influenza virus
TAMLCLGHHA

SEQ ID NO: 513845 - protein, 10 aa, Influenza virus
TAMLNASCAA

SEQ ID NO: 513846 - protein, 10 aa, Influenza virus
TANSIIVFCG

SEQ ID NO: 513847 - protein, 10 aa, Influenza virus
TANTYRNTDS

SEQ ID NO: 513848 - protein, 10 aa, Influenza virus
TAPHGLCYPG

SEQ ID NO: 513849 - protein, 10 aa, Influenza virus
TAPILGNYKE

SEQ ID NO: 513850 - protein, 10 aa, Influenza virus
TAPVLGNYKE

SEQ ID NO: 513851 - protein, 10 aa, Influenza virus
TAPVLGNYRE

SEQ ID NO: 513852 - protein, 10 aa, Influenza virus
TAQIIKLLPF

SEQ ID NO: 513853 - protein, 10 aa, Influenza virus
TAQMALQLFI

SEQ ID NO: 513854 - protein, 10 aa, Influenza virus
TASLSPGMMM

SEQ ID NO: 513855 - protein, 10 aa, Influenza virus
TASRAGYEML

SEQ ID NO: 513856 - protein, 10 aa, Influenza virus
TASRSGYEML

SEQ ID NO: 513857 - protein, 10 aa, Influenza virus
TATKRIRLAI

SEQ ID NO: 513858 - protein, 10 aa, Influenza virus
TATKRIRMAI

SEQ ID NO: 513859 - protein, 10 aa, Influenza virus
TATKRIRMAT

SEQ ID NO: 513860 - protein, 10 aa, Influenza virus
TATKRLRMAI

SEQ ID NO: 513861 - protein, 10 aa, Influenza virus
TATLCLGHHA

SEQ ID NO: 513862 - protein, 10 aa, Influenza virus
TATREGKHIV

SEQ ID NO: 513863 - protein, 10 aa, Influenza virus
TATVYYDRRL

SEQ ID NO: 513864 - protein, 10 aa, Influenza virus
TATVYYERRL

SEQ ID NO: 513865 - protein, 10 aa, Influenza virus
TATVYYNGRL

SEQ ID NO: 513866 - protein, 10 aa, Influenza virus
TATVYYNKRL

SEQ ID NO: 513867 - protein, 10 aa, Influenza virus
TATVYYNRRL

SEQ ID NO: 513868 - protein, 10 aa, Influenza virus
TATVYYNRRP

SEQ ID NO: 513869 - protein, 10 aa, Influenza virus
TAVAVIKYNG

SEQ ID NO: 513870 - protein, 10 aa, Influenza virus
TAVAVLKYNG

SEQ ID NO: 513871 - protein, 10 aa, Influenza virus
TAVDTCYPFD

SEQ ID NO: 513872 - protein, 10 aa, Influenza virus
TAYELTDSSW

SEQ ID NO: 513873 - protein, 10 aa, Influenza virus
TAYERMCNIL

SEQ ID NO: 513874 - protein, 10 aa, Influenza virus
TAYSQITNGT

SEQ ID NO: 513875 - protein, 10 aa, Influenza virus
TAYWWDGLQS

SEQ ID NO: 513876 - protein, 10 aa, Influenza virus
TCAVVMTDGS

SEQ ID NO: 513877 - protein, 10 aa, Influenza virus
TCEQIADAQH

SEQ ID NO: 513878 - protein, 10 aa, Influenza virus
TCEQIADSHH

SEQ ID NO: 513879 - protein, 10 aa, Influenza virus
TCEQIADSQH

SEQ ID NO: 513880 - protein, 10 aa, Influenza virus
TCGCRDNWQG

SEQ ID NO: 513881 - protein, 10 aa, Influenza virus
TCHDGIGRMT

SEQ ID NO: 513882 - protein, 10 aa, Influenza virus
TCHDGVGRMT

SEQ ID NO: 513883 - protein, 10 aa, Influenza virus
TCICRDNWQG

SEQ ID NO: 513884 - protein, 10 aa, Influenza virus
TCIESIRNGT

SEQ ID NO: 513885 - protein, 10 aa, Influenza virus
TCIVAVTDGP

SEQ ID NO: 513886 - protein, 10 aa, Influenza virus
TCKLLGINMS

SEQ ID NO: 513887 - protein, 10 aa, Influenza virus
TCKLVGINMS

SEQ ID NO: 513888 - protein, 10 aa, Influenza virus
TCMETIRNGT

SEQ ID NO: 513889 - protein, 10 aa, Influenza virus
TCRDNWKGSN

SEQ ID NO: 513890 - protein, 10 aa, Influenza virus
TCRDNWQGSN

SEQ ID NO: 513891 - protein, 10 aa, Influenza virus
TCSALFVYSL

SEQ ID NO: 513892 - protein, 10 aa, Influenza virus
TCSNGSCRCT

SEQ ID NO: 513893 - protein, 10 aa, Influenza virus
TCTCRDNWQG

SEQ ID NO: 513894 - protein, 10 aa, Influenza virus
TCTVIMTDGS

SEQ ID NO: 513895 - protein, 10 aa, Influenza virus
TCTVVMTDGN

SEQ ID NO: 513896 - protein, 10 aa, Influenza virus
TCTVVMTDGS

SEQ ID NO: 513897 - protein, 10 aa, Influenza virus
TCVCRDNWHG

SEQ ID NO: 513898 - protein, 10 aa, Influenza virus
TCVCRDNWKS

SEQ ID NO: 513899 - protein, 10 aa, Influenza virus
TCVCRDNWQG

SEQ ID NO: 513900 - protein, 10 aa, Influenza virus
TCVCRDSWHG

SEQ ID NO: 513901 - protein, 10 aa, Influenza virus
TCVVAVTDGP

SEQ ID NO: 513902 - protein, 10 aa, Influenza virus
TCVVIMTDGP

SEQ ID NO: 513903 - protein, 10 aa, Influenza virus
TCVVIMTDGS

SEQ ID NO: 513904 - protein, 10 aa, Influenza virus
TCVVTVTDGP

SEQ ID NO: 513905 - protein, 10 aa, Influenza virus
TCVVVMTDGS

SEQ ID NO: 513906 - protein, 10 aa, Influenza virus
TCWEQLYTPG

SEQ ID NO: 513907 - protein, 10 aa, Influenza virus
TCWEQMYTPG

SEQ ID NO: 513908 - protein, 10 aa, Influenza virus
TCYPFDVPDH

SEQ ID NO: 513909 - protein, 10 aa, Influenza virus
TCYPFDVPDY

SEQ ID NO: 513910 - protein, 10 aa, Influenza virus
TCYPFDVPEY

SEQ ID NO: 513911 - protein, 10 aa, Influenza virus
TCYPFDVPGY

SEQ ID NO: 513912 - protein, 10 aa, Influenza virus
TCYPFDVPNY

SEQ ID NO: 513913 - protein, 10 aa, Influenza virus
TDAEMNKLFE

SEQ ID NO: 513914 - protein, 10 aa, Influenza virus
TDCVLEAMAF

SEQ ID NO: 513915 - protein, 10 aa, Influenza virus
TDCVLEAMAL

SEQ ID NO: 513916 - protein, 10 aa, Influenza virus
TDELCPSPLK

SEQ ID NO: 513917 - protein, 10 aa, Influenza virus
TDEYKNTGDS

SEQ ID NO: 513918 - protein, 10 aa, Influenza virus
TDEYKNTRDS

SEQ ID NO: 513919 - protein, 10 aa, Influenza virus
TDGATSACKR

SEQ ID NO: 513920 - protein, 10 aa, Influenza virus
TDGNASGKAD

SEQ ID NO: 513921 - protein, 10 aa, Influenza virus
TDGPAANNAD

SEQ ID NO: 513922 - protein, 10 aa, Influenza virus
TDGPAANSAD

SEQ ID NO: 513923 - protein, 10 aa, Influenza virus
TDGPADNKAD

SEQ ID NO: 513924 - protein, 10 aa, Influenza virus
TDGPANKQAS

SEQ ID NO: 513925 - protein, 10 aa, Influenza virus
TDGPANNQAS

SEQ ID NO: 513926 - protein, 10 aa, Influenza virus
TDGPANSQAS

SEQ ID NO: 513927 - protein, 10 aa, Influenza virus
TDGPANSQAY

SEQ ID NO: 513928 - protein, 10 aa, Influenza virus
TDGPASNQAS

SEQ ID NO: 513929 - protein, 10 aa, Influenza virus
TDGPASSQAY

SEQ ID NO: 513930 - protein, 10 aa, Influenza virus
TDGPSDAQAF

SEQ ID NO: 513931 - protein, 10 aa, Influenza virus
TDGPSNAQAF

SEQ ID NO: 513932 - protein, 10 aa, Influenza virus
TDGSANSQAY

SEQ ID NO: 513933 - protein, 10 aa, Influenza virus
TDGSASGKAD

SEQ ID NO: 513934 - protein, 10 aa, Influenza virus
TDGSASGKAE

SEQ ID NO: 513935 - protein, 10 aa, Influenza virus
TDGSASGRAD

SEQ ID NO: 513936 - protein, 10 aa, Influenza virus
TDGSASRKAD

SEQ ID NO: 513937 - protein, 10 aa, Influenza virus
TDGSASSQAH

SEQ ID NO: 513938 - protein, 10 aa, Influenza virus
TDGSASSQAY

SEQ ID NO: 513939 - protein, 10 aa, Influenza virus
TDGSATGPAD

SEQ ID NO: 513940 - protein, 10 aa, Influenza virus
TDGSATGPAE

SEQ ID NO: 513941 - protein, 10 aa, Influenza virus
TDIWAYNAEL

SEQ ID NO: 513942 - protein, 10 aa, Influenza virus
TDIWSYNAKL

SEQ ID NO: 513943 - protein, 10 aa, Influenza virus
TDIWSYNARL

SEQ ID NO: 513944 - protein, 10 aa, Influenza virus
TDIWTYQAEL

SEQ ID NO: 513945 - protein, 10 aa, Influenza virus
TDKDSNGVQD

SEQ ID NO: 513946 - protein, 10 aa, Influenza virus
TDKGSIQSDK

SEQ ID NO: 513947 - protein, 10 aa, Influenza virus
TDKIDTLTET

SEQ ID NO: 513948 - protein, 10 aa, Influenza virus
TDKNSNGVQD

SEQ ID NO: 513949 - protein, 10 aa, Influenza virus
TDKSSNGVQD

SEQ ID NO: 513950 - protein, 10 aa, Influenza virus
TDKVDTIIEN

SEQ ID NO: 513951 - protein, 10 aa, Influenza virus
TDKVDTLTEN

SEQ ID NO: 513952 - protein, 10 aa, Influenza virus
TDKVDTLTET

SEQ ID NO: 513953 - protein, 10 aa, Influenza virus
TDKVNTIIEN

SEQ ID NO: 513954 - protein, 10 aa, Influenza virus
TDLEALMEWI

SEQ ID NO: 513955 - protein, 10 aa, Influenza virus
TDLEALMEWL

SEQ ID NO: 513956 - protein, 10 aa, Influenza virus
TDLEVLMEWL

SEQ ID NO: 513957 - protein, 10 aa, Influenza virus
TDLGAPLELR

SEQ ID NO: 513958 - protein, 10 aa, Influenza virus
TDLGQCGILG

SEQ ID NO: 513959 - protein, 10 aa, Influenza virus
TDLGQCGLLG

SEQ ID NO: 513960 - protein, 10 aa, Influenza virus
TDLGSPLELR

SEQ ID NO: 513961 - protein, 10 aa, Influenza virus
TDLGTPLELR

SEQ ID NO: 513962 - protein, 10 aa, Influenza virus
TDLYKVATGR

SEQ ID NO: 513963 - protein, 10 aa, Influenza virus
TDMGQCGLLG

SEQ ID NO: 513964 - protein, 10 aa, Influenza virus
TDNHVEVVSA

SEQ ID NO: 513965 - protein, 10 aa, Influenza virus
TDNPRPNDPA

SEQ ID NO: 513966 - protein, 10 aa, Influenza virus
TDNPRPNDPN

SEQ ID NO: 513967 - protein, 10 aa, Influenza virus
TDNPRPNDPS

SEQ ID NO: 513968 - protein, 10 aa, Influenza virus
TDNPRPNDPT

SEQ ID NO: 513969 - protein, 10 aa, Influenza virus
TDNPRPNDPV

SEQ ID NO: 513970 - protein, 10 aa, Influenza virus
TDNYGVKGFG

SEQ ID NO: 513971 - protein, 10 aa, Influenza virus
TDSEMDKLFE

SEQ ID NO: 513972 - protein, 10 aa, Influenza virus
TDSEMNKLFD

SEQ ID NO: 513973 - protein, 10 aa, Influenza virus
TDSEMNKLFE

SEQ ID NO: 513974 - protein, 10 aa, Influenza virus
TDSEMNKLYE

SEQ ID NO: 513975 - protein, 10 aa, Influenza virus
TDSEMNRLFE

SEQ ID NO: 513976 - protein, 10 aa, Influenza virus
TDSEMSKLFE

SEQ ID NO: 513977 - protein, 10 aa, Influenza virus
TDSIKSWRKD

SEQ ID NO: 513978 - protein, 10 aa, Influenza virus
TDSIKSWRRD

SEQ ID NO: 513979 - protein, 10 aa, Influenza virus
TDSQTATKRI

SEQ ID NO: 513980 - protein, 10 aa, Influenza virus
TDSQTATKRL

SEQ ID NO: 513981 - protein, 10 aa, Influenza virus
TDTFKSWKGN

SEQ ID NO: 513982 - protein, 10 aa, Influenza virus
TDTLKSWKGN

SEQ ID NO: 513983 - protein, 10 aa, Influenza virus
TDTPRGEDSQ

SEQ ID NO: 513984 - protein, 10 aa, Influenza virus
TDTVDTILEK

SEQ ID NO: 513985 - protein, 10 aa, Influenza virus
TDTVDTLIEQ

SEQ ID NO: 513986 - protein, 10 aa, Influenza virus
TDTVDTLLEK

SEQ ID NO: 513987 - protein, 10 aa, Influenza virus
TDTVDTLTEN

SEQ ID NO: 513988 - protein, 10 aa, Influenza virus
TDTVDTVLEK

SEQ ID NO: 513989 - protein, 10 aa, Influenza virus
TDTVDTVLER

SEQ ID NO: 513990 - protein, 10 aa, Influenza virus
TDTVDTVREK

SEQ ID NO: 513991 - protein, 10 aa, Influenza virus
TDTVNTLIEQ

SEQ ID NO: 513992 - protein, 10 aa, Influenza virus
TDTVNTLMEQ

SEQ ID NO: 513993 - protein, 10 aa, Influenza virus
TDTVNTLTEQ

SEQ ID NO: 513994 - protein, 10 aa, Influenza virus
TDVIRSWRKQ

SEQ ID NO: 513995 - protein, 10 aa, Influenza virus
TDVVNFLSME

SEQ ID NO: 513996 - protein, 10 aa, Influenza virus
TDVVNFVSME

SEQ ID NO: 513997 - protein, 10 aa, Influenza virus
TDVVNYVSME

SEQ ID NO: 513998 - protein, 10 aa, Influenza virus
TDVVRSWKKQ

SEQ ID NO: 513999 - protein, 10 aa, Influenza virus
TDVVRSWRKK

SEQ ID NO: 514000 - protein, 10 aa, Influenza virus
TDVVRSWRKQ

SEQ ID NO: 514001 - protein, 10 aa, Influenza virus
TDVVRSWRRQ

SEQ ID NO: 514002 - protein, 10 aa, Influenza virus
TDVWSYNAKL

SEQ ID NO: 514003 - protein, 10 aa, Influenza virus
TDVYCICRDN

SEQ ID NO: 514004 - protein, 10 aa, Influenza virus
TDWSGYSGSF

SEQ ID NO: 514005 - protein, 10 aa, Influenza virus
TECQLNEGIM

SEQ ID NO: 514006 - protein, 10 aa, Influenza virus
TECQLNEGVI

SEQ ID NO: 514007 - protein, 10 aa, Influenza virus
TECQLNEGVM

SEQ ID NO: 514008 - protein, 10 aa, Influenza virus
TECRTFFLTQ

SEQ ID NO: 514009 - protein, 10 aa, Influenza virus
TEDNIYKILS

SEQ ID NO: 514010 - protein, 10 aa, Influenza virus
TEDNVYKILS

SEQ ID NO: 514011 - protein, 10 aa, Influenza virus
TEDNVYKVLA

SEQ ID NO: 514012 - protein, 10 aa, Influenza virus
TEDNVYKVLS

SEQ ID NO: 514013 - protein, 10 aa, Influenza virus
TEEQAVDICK

SEQ ID NO: 514014 - protein, 10 aa, Influenza virus
TEEQAVGICK

SEQ ID NO: 514015 - protein, 10 aa, Influenza virus
TEEQAVNICK

SEQ ID NO: 514016 - protein, 10 aa, Influenza virus
TEEVSHCRAT

SEQ ID NO: 514017 - protein, 10 aa, Influenza virus
TEFESIESEF

SEQ ID NO: 514018 - protein, 10 aa, Influenza virus
TEFLGQWDWP

SEQ ID NO: 514019 - protein, 10 aa, Influenza virus
TEFLGQWNWP

SEQ ID NO: 514020 - protein, 10 aa, Influenza virus
TEGHIEECSC

SEQ ID NO: 514021 - protein, 10 aa, Influenza virus
TEHQIGNVIN

SEQ ID NO: 514022 - protein, 10 aa, Influenza virus
TEIASWAGNI

SEQ ID NO: 514023 - protein, 10 aa, Influenza virus
TEIGAPQLNP

SEQ ID NO: 514024 - protein, 10 aa, Influenza virus
TEIIIRMMEN

SEQ ID NO: 514025 - protein, 10 aa, Influenza virus
TEINTWARNI

SEQ ID NO: 514026 - protein, 10 aa, Influenza virus
TEIPSWAGNI

SEQ ID NO: 514027 - protein, 10 aa, Influenza virus
TEIPSWAGNV

SEQ ID NO: 514028 - protein, 10 aa, Influenza virus
TEIPSWEGNI

SEQ ID NO: 514029 - protein, 10 aa, Influenza virus
TEIPTWAGNI

SEQ ID NO: 514030 - protein, 10 aa, Influenza virus
TEIRASVGKM

SEQ ID NO: 514031 - protein, 10 aa, Influenza virus
TEIRASVGRM

SEQ ID NO: 514032 - protein, 10 aa, Influenza virus
TEIRSSVGKM

SEQ ID NO: 514033 - protein, 10 aa, Influenza virus
TEIRTSVGRM

SEQ ID NO: 514034 - protein, 10 aa, Influenza virus
TEISFTITGD

SEQ ID NO: 514035 - protein, 10 aa, Influenza virus
TEIWSYNAEL

SEQ ID NO: 514036 - protein, 10 aa, Influenza virus
TEIYNETVRL

SEQ ID NO: 514037 - protein, 10 aa, Influenza virus
TEKGIEVVNA

SEQ ID NO: 514038 - protein, 10 aa, Influenza virus
TEKGVEVVNA

SEQ ID NO: 514039 - protein, 10 aa, Influenza virus
TEKVDTIIEN

SEQ ID NO: 514040 - protein, 10 aa, Influenza virus
TEKVDTIIES

SEQ ID NO: 514041 - protein, 10 aa, Influenza virus
TELGAPLVLD

SEQ ID NO: 514042 - protein, 10 aa, Influenza virus
TELGSPLVLD

SEQ ID NO: 514043 - protein, 10 aa, Influenza virus
TELINPNKWG

SEQ ID NO: 514044 - protein, 10 aa, Influenza virus
TELINPSKWG

SEQ ID NO: 514045 - protein, 10 aa, Influenza virus
TELIPPSKWG

SEQ ID NO: 514046 - protein, 10 aa, Influenza virus
TELISPNKWG

SEQ ID NO: 514047 - protein, 10 aa, Influenza virus
TELISPSKWG

SEQ ID NO: 514048 - protein, 10 aa, Influenza virus
TELLVLMENE

SEQ ID NO: 514049 - protein, 10 aa, Influenza virus
TELPFQNLSP

SEQ ID NO: 514050 - protein, 10 aa, Influenza virus
TELSFTITGD

SEQ ID NO: 514051 - protein, 10 aa, Influenza virus
TELSFTVTGD

SEQ ID NO: 514052 - protein, 10 aa, Influenza virus
TELWSYNAEL

SEQ ID NO: 514053 - protein, 10 aa, Influenza virus
TEMWSYNAEL

SEQ ID NO: 514054 - protein, 10 aa, Influenza virus
TEMYNETVRV

SEQ ID NO: 514055 - protein, 10 aa, Influenza virus
TENGVPVTSS

SEQ ID NO: 514056 - protein, 10 aa, Influenza virus
TENPVICLGH

SEQ ID NO: 514057 - protein, 10 aa, Influenza virus
TENSFEQITF

SEQ ID NO: 514058 - protein, 10 aa, Influenza virus
TEPLCDVSGF

SEQ ID NO: 514059 - protein, 10 aa, Influenza virus
TEPLCEVSGF

SEQ ID NO: 514060 - protein, 10 aa, Influenza virus
TEPLCNVSGF

SEQ ID NO: 514061 - protein, 10 aa, Influenza virus
TEQNVPVTQV

SEQ ID NO: 514062 - protein, 10 aa, Influenza virus
TEQTKLYKNT

SEQ ID NO: 514063 - protein, 10 aa, Influenza virus
TEQVDTIMEK

SEQ ID NO: 514064 - protein, 10 aa, Influenza virus
TEQVDTIMER

SEQ ID NO: 514065 - protein, 10 aa, Influenza virus
TEREVEVVNA

SEQ ID NO: 514066 - protein, 10 aa, Influenza virus
TERGIEVVNA

SEQ ID NO: 514067 - protein, 10 aa, Influenza virus
TERGVEVVDA

SEQ ID NO: 514068 - protein, 10 aa, Influenza virus
TERGVEVVNA

SEQ ID NO: 514069 - protein, 10 aa, Influenza virus
TERVDTIIES

SEQ ID NO: 514070 - protein, 10 aa, Influenza virus
TERVDTIMEK

SEQ ID NO: 514071 - protein, 10 aa, Influenza virus
TESLQNRIQI

SEQ ID NO: 514072 - protein, 10 aa, Influenza virus
TESRGLFGAI

SEQ ID NO: 514073 - protein, 10 aa, Influenza virus
TESSFEQITF

SEQ ID NO: 514074 - protein, 10 aa, Influenza virus
TETGALQLNP

SEQ ID NO: 514075 - protein, 10 aa, Influenza virus
TETGAPQLNP

SEQ ID NO: 514076 - protein, 10 aa, Influenza virus
TETGVPVTSS

SEQ ID NO: 514077 - protein, 10 aa, Influenza virus
TETKAPQLNP

SEQ ID NO: 514078 - protein, 10 aa, Influenza virus
TETVEITGID

SEQ ID NO: 514079 - protein, 10 aa, Influenza virus
TETVEITGIN

SEQ ID NO: 514080 - protein, 10 aa, Influenza virus
TETVNTLIEQ

SEQ ID NO: 514081 - protein, 10 aa, Influenza virus
TETVNTLSEQ

SEQ ID NO: 514082 - protein, 10 aa, Influenza virus
TETVNTLTEQ

SEQ ID NO: 514083 - protein, 10 aa, Influenza virus
TEVEGRIQDL

SEQ ID NO: 514084 - protein, 10 aa, Influenza virus
TEVEKQIGNV

SEQ ID NO: 514085 - protein, 10 aa, Influenza virus
TEVEQQIGNV

SEQ ID NO: 514086 - protein, 10 aa, Influenza virus
TEVETYVLSI

SEQ ID NO: 514087 - protein, 10 aa, Influenza virus
TEVETYVLSV

SEQ ID NO: 514088 - protein, 10 aa, Influenza virus
TEVSHCRATE

SEQ ID NO: 514089 - protein, 10 aa, Influenza virus
TEVWSYNADL

SEQ ID NO: 514090 - protein, 10 aa, Influenza virus
TEVWSYNAEL

SEQ ID NO: 514091 - protein, 10 aa, Influenza virus
TEVYNETVRL

SEQ ID NO: 514092 - protein, 10 aa, Influenza virus
TEVYNETVRV

SEQ ID NO: 514093 - protein, 10 aa, Influenza virus
TEVYSETVRV

SEQ ID NO: 514094 - protein, 10 aa, Influenza virus
TEWSGYSGSF

SEQ ID NO: 514095 - protein, 10 aa, Influenza virus
TEYRQEALQN

SEQ ID NO: 514096 - protein, 10 aa, Influenza virus
TFCGLDNEPG

SEQ ID NO: 514097 - protein, 10 aa, Influenza virus
TFCGLNNEPG

SEQ ID NO: 514098 - protein, 10 aa, Influenza virus
TFDSLNITAA

SEQ ID NO: 514099 - protein, 10 aa, Influenza virus
TFDWTLNRNQ

SEQ ID NO: 514100 - protein, 10 aa, Influenza virus
TFEFTSFFYR

SEQ ID NO: 514101 - protein, 10 aa, Influenza virus
TFESDGAFLA

SEQ ID NO: 514102 - protein, 10 aa, Influenza virus
TFESNGAFIA

SEQ ID NO: 514103 - protein, 10 aa, Influenza virus
TFESNGAFLA

SEQ ID NO: 514104 - protein, 10 aa, Influenza virus
TFESNGALLA

SEQ ID NO: 514105 - protein, 10 aa, Influenza virus
TFESNGGFLA

SEQ ID NO: 514106 - protein, 10 aa, Influenza virus
TFESNGGLIA

SEQ ID NO: 514107 - protein, 10 aa, Influenza virus
TFESNGGLLA

SEQ ID NO: 514108 - protein, 10 aa, Influenza virus
TFESSGGLLA

SEQ ID NO: 514109 - protein, 10 aa, Influenza virus
TFFITQGSLL

SEQ ID NO: 514110 - protein, 10 aa, Influenza virus
TFFLTHGALL

SEQ ID NO: 514111 - protein, 10 aa, Influenza virus
TFFLTHGSLL

SEQ ID NO: 514112 - protein, 10 aa, Influenza virus
TFFLTQGALL

SEQ ID NO: 514113 - protein, 10 aa, Influenza virus
TFFLTQGSLL

SEQ ID NO: 514114 - protein, 10 aa, Influenza virus
TFFLTQGSLP

SEQ ID NO: 514115 - protein, 10 aa, Influenza virus
TFGPVHFQNQ

SEQ ID NO: 514116 - protein, 10 aa, Influenza virus
TFGPVHFRNQ

SEQ ID NO: 514117 - protein, 10 aa, Influenza virus
TFGPVHFRSQ

SEQ ID NO: 514118 - protein, 10 aa, Influenza virus
TFIFNGAFIA

SEQ ID NO: 514119 - protein, 10 aa, Influenza virus
TFILWACQNG

SEQ ID NO: 514120 - protein, 10 aa, Influenza virus
TFIQALQLLL

SEQ ID NO: 514121 - protein, 10 aa, Influenza virus
TFKSWKGNIM

SEQ ID NO: 514122 - protein, 10 aa, Influenza virus
TFKVIGGWST

SEQ ID NO: 514123 - protein, 10 aa, Influenza virus
TFKVIGGWTT

SEQ ID NO: 514124 - protein, 10 aa, Influenza virus
TFLAMITYIT

SEQ ID NO: 514125 - protein, 10 aa, Influenza virus
TFLARSALIL

SEQ ID NO: 514126 - protein, 10 aa, Influenza virus
TFLHNGGLIA

SEQ ID NO: 514127 - protein, 10 aa, Influenza virus
TFLQALQLLL

SEQ ID NO: 514128 - protein, 10 aa, Influenza virus
TFLRSNAPSG

SEQ ID NO: 514129 - protein, 10 aa, Influenza virus
TFMQALQLLF

SEQ ID NO: 514130 - protein, 10 aa, Influenza virus
TFMQALQLLL

SEQ ID NO: 514131 - protein, 10 aa, Influenza virus
TFNFNGAFVA

SEQ ID NO: 514132 - protein, 10 aa, Influenza virus
TFNGAFIAPD

SEQ ID NO: 514133 - protein, 10 aa, Influenza virus
TFNGAFIAPN

SEQ ID NO: 514134 - protein, 10 aa, Influenza virus
TFPYTGDPPY

SEQ ID NO: 514135 - protein, 10 aa, Influenza virus
TFQNIDKNAL

SEQ ID NO: 514136 - protein, 10 aa, Influenza virus
TFQNIDRNAI

SEQ ID NO: 514137 - protein, 10 aa, Influenza virus
TFQNIDRNAL

SEQ ID NO: 514138 - protein, 10 aa, Influenza virus
TFQNIEKNAL

SEQ ID NO: 514139 - protein, 10 aa, Influenza virus
TFQNIERNAL

SEQ ID NO: 514140 - protein, 10 aa, Influenza virus
TFRGLISTPL

SEQ ID NO: 514141 - protein, 10 aa, Influenza virus
TFRVIGGWAT

SEQ ID NO: 514142 - protein, 10 aa, Influenza virus
TFRVIGGWTT

SEQ ID NO: 514143 - protein, 10 aa, Influenza virus
TFRVIGGWVT

SEQ ID NO: 514144 - protein, 10 aa, Influenza virus
TFSDNGGLIA

SEQ ID NO: 514145 - protein, 10 aa, Influenza virus
TFSFNGAFIA

SEQ ID NO: 514146 - protein, 10 aa, Influenza virus
TFSFNGAFVA

SEQ ID NO: 514147 - protein, 10 aa, Influenza virus
TFSFQLINNK

SEQ ID NO: 514148 - protein, 10 aa, Influenza virus
TFSHNGGLIA

SEQ ID NO: 514149 - protein, 10 aa, Influenza virus
TFSHNGGLVA

SEQ ID NO: 514150 - protein, 10 aa, Influenza virus
TFSHNGGRIA

SEQ ID NO: 514151 - protein, 10 aa, Influenza virus
TFSPRSRSGF

SEQ ID NO: 514152 - protein, 10 aa, Influenza virus
TFSVQRNLPF

SEQ ID NO: 514153 - protein, 10 aa, Influenza virus
TFSVQRSLPF

SEQ ID NO: 514154 - protein, 10 aa, Influenza virus
TFTFNGAFIA

SEQ ID NO: 514155 - protein, 10 aa, Influenza virus
TFVNITNVQN

SEQ ID NO: 514156 - protein, 10 aa, Influenza virus
TFVNVTHVQN

SEQ ID NO: 514157 - protein, 10 aa, Influenza virus
TFVNVTNVQN

SEQ ID NO: 514158 - protein, 10 aa, Influenza virus
TGALASCMGL

SEQ ID NO: 514159 - protein, 10 aa, Influenza virus
TGALQLNPID

SEQ ID NO: 514160 - protein, 10 aa, Influenza virus
TGAPQLNPID

SEQ ID NO: 514161 - protein, 10 aa, Influenza virus
TGAPQLNPVD

SEQ ID NO: 514162 - protein, 10 aa, Influenza virus
TGAQSFYRSI

SEQ ID NO: 514163 - protein, 10 aa, Influenza virus
TGARRIDFHW

SEQ ID NO: 514164 - protein, 10 aa, Influenza virus
TGCFEIFHKC

SEQ ID NO: 514165 - protein, 10 aa, Influenza virus
TGCFEIFHRC

SEQ ID NO: 514166 - protein, 10 aa, Influenza virus
TGCKMYALHQ

SEQ ID NO: 514167 - protein, 10 aa, Influenza virus
TGCQLNEGVM

SEQ ID NO: 514168 - protein, 10 aa, Influenza virus
TGDDKNATAS

SEQ ID NO: 514169 - protein, 10 aa, Influenza virus
TGDDRNATAS

SEQ ID NO: 514170 - protein, 10 aa, Influenza virus
TGDGCFEILH

SEQ ID NO: 514171 - protein, 10 aa, Influenza virus
TGDNTKWNEN

SEQ ID NO: 514172 - protein, 10 aa, Influenza virus
TGDPPYSHGT

SEQ ID NO: 514173 - protein, 10 aa, Influenza virus
TGFAPFSEDN

SEQ ID NO: 514174 - protein, 10 aa, Influenza virus
TGFAPFSKDN

SEQ ID NO: 514175 - protein, 10 aa, Influenza virus
TGFHFEECSC

SEQ ID NO: 514176 - protein, 10 aa, Influenza virus
TGFTYSGIRT

SEQ ID NO: 514177 - protein, 10 aa, Influenza virus
TGGQAFYRSI

SEQ ID NO: 514178 - protein, 10 aa, Influenza virus
TGGQSFYRSI

SEQ ID NO: 514179 - protein, 10 aa, Influenza virus
TGIAADKAST

SEQ ID NO: 514180 - protein, 10 aa, Influenza virus
TGIAADKEST

SEQ ID NO: 514181 - protein, 10 aa, Influenza virus
TGIAADKTST

SEQ ID NO: 514182 - protein, 10 aa, Influenza virus
TGIAADKVST

SEQ ID NO: 514183 - protein, 10 aa, Influenza virus
TGIAADRDST

SEQ ID NO: 514184 - protein, 10 aa, Influenza virus
TGIAADREST

SEQ ID NO: 514185 - protein, 10 aa, Influenza virus
TGIAADRGST

SEQ ID NO: 514186 - protein, 10 aa, Influenza virus
TGIAAEKEST

SEQ ID NO: 514187 - protein, 10 aa, Influenza virus
TGIDKVCTKG

SEQ ID NO: 514188 - protein, 10 aa, Influenza virus
TGILTDTSRP

SEQ ID NO: 514189 - protein, 10 aa, Influenza virus
TGINKVCTKG

SEQ ID NO: 514190 - protein, 10 aa, Influenza virus
TGIVADRDST

SEQ ID NO: 514191 - protein, 10 aa, Influenza virus
TGIWDTLIER

SEQ ID NO: 514192 - protein, 10 aa, Influenza virus
TGKDPKKTGG

SEQ ID NO: 514193 - protein, 10 aa, Influenza virus
TGKGCFDILH

SEQ ID NO: 514194 - protein, 10 aa, Influenza virus
TGKLNRFIEK

SEQ ID NO: 514195 - protein, 10 aa, Influenza virus
TGKLNRIIEK

SEQ ID NO: 514196 - protein, 10 aa, Influenza virus
TGKLNRLIDK

SEQ ID NO: 514197 - protein, 10 aa, Influenza virus
TGKLNRLIDR

SEQ ID NO: 514198 - protein, 10 aa, Influenza virus
TGKLNRLIEK

SEQ ID NO: 514199 - protein, 10 aa, Influenza virus
TGKLNRLIER

SEQ ID NO: 514200 - protein, 10 aa, Influenza virus
TGKLNRLIGK

SEQ ID NO: 514201 - protein, 10 aa, Influenza virus
TGKLNRLISK

SEQ ID NO: 514202 - protein, 10 aa, Influenza virus
TGKSHGRILK

SEQ ID NO: 514203 - protein, 10 aa, Influenza virus
TGKSHGRVLK

SEQ ID NO: 514204 - protein, 10 aa, Influenza virus
TGLIDGWYGY

SEQ ID NO: 514205 - protein, 10 aa, Influenza virus
TGLRNIPQIE

SEQ ID NO: 514206 - protein, 10 aa, Influenza virus
TGLRNIPSIQ

SEQ ID NO: 514207 - protein, 10 aa, Influenza virus
TGLRNIPSVQ

SEQ ID NO: 514208 - protein, 10 aa, Influenza virus
TGLRNVPQIE

SEQ ID NO: 514209 - protein, 10 aa, Influenza virus
TGLRNVPQME

SEQ ID NO: 514210 - protein, 10 aa, Influenza virus
TGLRNVPSIQ

SEQ ID NO: 514211 - protein, 10 aa, Influenza virus
TGMAADQKST

SEQ ID NO: 514212 - protein, 10 aa, Influenza virus
TGMAADRDST

SEQ ID NO: 514213 - protein, 10 aa, Influenza virus
TGMALSVVSL

SEQ ID NO: 514214 - protein, 10 aa, Influenza virus
TGMDPRMCSL

SEQ ID NO: 514215 - protein, 10 aa, Influenza virus
TGMIDGWYGY

SEQ ID NO: 514216 - protein, 10 aa, Influenza virus
TGMILSVVSL

SEQ ID NO: 514217 - protein, 10 aa, Influenza virus
TGMKNVPEIP

SEQ ID NO: 514218 - protein, 10 aa, Influenza virus
TGMKNVPETP

SEQ ID NO: 514219 - protein, 10 aa, Influenza virus
TGMRNIPEKP

SEQ ID NO: 514220 - protein, 10 aa, Influenza virus
TGMRNIPEKQ

SEQ ID NO: 514221 - protein, 10 aa, Influenza virus
TGMRNIPENP

SEQ ID NO: 514222 - protein, 10 aa, Influenza virus
TGMRNIPERQ

SEQ ID NO: 514223 - protein, 10 aa, Influenza virus
TGMRNIPGKQ

SEQ ID NO: 514224 - protein, 10 aa, Influenza virus
TGMRNVPEKP

SEQ ID NO: 514225 - protein, 10 aa, Influenza virus
TGMRNVPEKQ

SEQ ID NO: 514226 - protein, 10 aa, Influenza virus
TGMRNVPENP

SEQ ID NO: 514227 - protein, 10 aa, Influenza virus
TGMRNVPERQ

SEQ ID NO: 514228 - protein, 10 aa, Influenza virus
TGMRNVPETQ

SEQ ID NO: 514229 - protein, 10 aa, Influenza virus
TGMTLSVVNL

SEQ ID NO: 514230 - protein, 10 aa, Influenza virus
TGMTLSVVSL

SEQ ID NO: 514231 - protein, 10 aa, Influenza virus
TGMVDGWYGY

SEQ ID NO: 514232 - protein, 10 aa, Influenza virus
TGMVNGWYGY

SEQ ID NO: 514233 - protein, 10 aa, Influenza virus
TGMWDTLIER

SEQ ID NO: 514234 - protein, 10 aa, Influenza virus
TGNFIAPEYA

SEQ ID NO: 514235 - protein, 10 aa, Influenza virus
TGNGCFDILH

SEQ ID NO: 514236 - protein, 10 aa, Influenza virus
TGNGCFEFYH

SEQ ID NO: 514237 - protein, 10 aa, Influenza virus
TGNHGSLVLS

SEQ ID NO: 514238 - protein, 10 aa, Influenza virus
TGNKLITVGS

SEQ ID NO: 514239 - protein, 10 aa, Influenza virus
TGNLIAPEYG

SEQ ID NO: 514240 - protein, 10 aa, Influenza virus
TGNLIAPRGY

SEQ ID NO: 514241 - protein, 10 aa, Influenza virus
TGNLVAPEYG

SEQ ID NO: 514242 - protein, 10 aa, Influenza virus
TGNPIICLGH

SEQ ID NO: 514243 - protein, 10 aa, Influenza virus
TGNPVICLGH

SEQ ID NO: 514244 - protein, 10 aa, Influenza virus
TGNPVICMGH

SEQ ID NO: 514245 - protein, 10 aa, Influenza virus
TGPADTRIYY

SEQ ID NO: 514246 - protein, 10 aa, Influenza virus
TGPADTRVYY

SEQ ID NO: 514247 - protein, 10 aa, Influenza virus
TGPAETRIYY

SEQ ID NO: 514248 - protein, 10 aa, Influenza virus
TGPAETRVYY

SEQ ID NO: 514249 - protein, 10 aa, Influenza virus
TGPDATAVAV

SEQ ID NO: 514250 - protein, 10 aa, Influenza virus
TGPDSTAVAV

SEQ ID NO: 514251 - protein, 10 aa, Influenza virus
TGPDTTAVAV

SEQ ID NO: 514252 - protein, 10 aa, Influenza virus
TGPPQCDLFL

SEQ ID NO: 514253 - protein, 10 aa, Influenza virus
TGPPQCDQFL

SEQ ID NO: 514254 - protein, 10 aa, Influenza virus
TGPRNVPQIE

SEQ ID NO: 514255 - protein, 10 aa, Influenza virus
TGQAADLKST

SEQ ID NO: 514256 - protein, 10 aa, Influenza virus
TGQAADYEST

SEQ ID NO: 514257 - protein, 10 aa, Influenza virus
TGQAADYKST

SEQ ID NO: 514258 - protein, 10 aa, Influenza virus
TGRDVLVIWG

SEQ ID NO: 514259 - protein, 10 aa, Influenza virus
TGRDVLVLWG

SEQ ID NO: 514260 - protein, 10 aa, Influenza virus
TGRDVLVMWG

SEQ ID NO: 514261 - protein, 10 aa, Influenza virus
TGRGIEVVNA

SEQ ID NO: 514262 - protein, 10 aa, Influenza virus
TGRIFQSGIR

SEQ ID NO: 514263 - protein, 10 aa, Influenza virus
TGRIFQSGVR

SEQ ID NO: 514264 - protein, 10 aa, Influenza virus
TGRIFQSRIR

SEQ ID NO: 514265 - protein, 10 aa, Influenza virus
TGRNCTIPCF

SEQ ID NO: 514266 - protein, 10 aa, Influenza virus
TGRNCTVPCF

SEQ ID NO: 514267 - protein, 10 aa, Influenza virus
TGRSSFFRNV

SEQ ID NO: 514268 - protein, 10 aa, Influenza virus
TGRVTVSTRS

SEQ ID NO: 514269 - protein, 10 aa, Influenza virus
TGSFCSIDGK

SEQ ID NO: 514270 - protein, 10 aa, Influenza virus
TGSFCSINGK

SEQ ID NO: 514271 - protein, 10 aa, Influenza virus
TGSFCSINGR

SEQ ID NO: 514272 - protein, 10 aa, Influenza virus
TGSFCSLDGK

SEQ ID NO: 514273 - protein, 10 aa, Influenza virus
TGSIYIEVLH

SEQ ID NO: 514274 - protein, 10 aa, Influenza virus
TGSPGAPGVK

SEQ ID NO: 514275 - protein, 10 aa, Influenza virus
TGSPSAPGVK

SEQ ID NO: 514276 - protein, 10 aa, Influenza virus
TGSVYIEVLH

SEQ ID NO: 514277 - protein, 10 aa, Influenza virus
TGSWPDGADI

SEQ ID NO: 514278 - protein, 10 aa, Influenza virus
TGSWPDGANI

SEQ ID NO: 514279 - protein, 10 aa, Influenza virus
TGSYVRLYLW

SEQ ID NO: 514280 - protein, 10 aa, Influenza virus
TGTAADLKST

SEQ ID NO: 514281 - protein, 10 aa, Influenza virus
TGTAKHIEEC

SEQ ID NO: 514282 - protein, 10 aa, Influenza virus
TGTAKQNYLM

SEQ ID NO: 514283 - protein, 10 aa, Influenza virus
TGTFEFTSFF

SEQ ID NO: 514284 - protein, 10 aa, Influenza virus
TGTGYTMDTV

SEQ ID NO: 514285 - protein, 10 aa, Influenza virus
TGTLNRLIDK

SEQ ID NO: 514286 - protein, 10 aa, Influenza virus
TGTNRPILVI

SEQ ID NO: 514287 - protein, 10 aa, Influenza virus
TGTNRPVLII

SEQ ID NO: 514288 - protein, 10 aa, Influenza virus
TGTNRPVLVI

SEQ ID NO: 514289 - protein, 10 aa, Influenza virus
TGTNRPVLVV

SEQ ID NO: 514290 - protein, 10 aa, Influenza virus
TGTNSFYRNL

SEQ ID NO: 514291 - protein, 10 aa, Influenza virus
TGTSSFYRNL

SEQ ID NO: 514292 - protein, 10 aa, Influenza virus
TGTWDTLIER

SEQ ID NO: 514293 - protein, 10 aa, Influenza virus
TGTYCSLNGI

SEQ ID NO: 514294 - protein, 10 aa, Influenza virus
TGTYCSLNGV

SEQ ID NO: 514295 - protein, 10 aa, Influenza virus
TGTYDYPKYE

SEQ ID NO: 514296 - protein, 10 aa, Influenza virus
TGVDEYSSTE

SEQ ID NO: 514297 - protein, 10 aa, Influenza virus
TGVESAVLRG

SEQ ID NO: 514298 - protein, 10 aa, Influenza virus
TGVLTDTSRP

SEQ ID NO: 514299 - protein, 10 aa, Influenza virus
TGVPVTSSVD

SEQ ID NO: 514300 - protein, 10 aa, Influenza virus
TGVTLSVVSL

SEQ ID NO: 514301 - protein, 10 aa, Influenza virus
TGVWWTSNSI

SEQ ID NO: 514302 - protein, 10 aa, Influenza virus
TGWILGNPMC

SEQ ID NO: 514303 - protein, 10 aa, Influenza virus
TGWPWPDGAL

SEQ ID NO: 514304 - protein, 10 aa, Influenza virus
TGWSWPDGAL

SEQ ID NO: 514305 - protein, 10 aa, Influenza virus
TGYAQTDCVL

SEQ ID NO: 514306 - protein, 10 aa, Influenza virus
TGYEKNATAS

SEQ ID NO: 514307 - protein, 10 aa, Influenza virus
TGYHFEECSC

SEQ ID NO: 514308 - protein, 10 aa, Influenza virus
TGYICSKFHS

SEQ ID NO: 514309 - protein, 10 aa, Influenza virus
TGYTMDTVNR

SEQ ID NO: 514310 - protein, 10 aa, Influenza virus
TGYTMDTVSR

SEQ ID NO: 514311 - protein, 10 aa, Influenza virus
TGYVCSKFHS

SEQ ID NO: 514312 - protein, 10 aa, Influenza virus
THAKDILEKA

SEQ ID NO: 514313 - protein, 10 aa, Influenza virus
THAKDILEKT

SEQ ID NO: 514314 - protein, 10 aa, Influenza virus
THAKNILEKT

SEQ ID NO: 514315 - protein, 10 aa, Influenza virus
THALRELWQC

SEQ ID NO: 514316 - protein, 10 aa, Influenza virus
THAQDILEKT

SEQ ID NO: 514317 - protein, 10 aa, Influenza virus
THAQDILERT

SEQ ID NO: 514318 - protein, 10 aa, Influenza virus
THDRTAFRGL

SEQ ID NO: 514319 - protein, 10 aa, Influenza virus
THESECVCIN

SEQ ID NO: 514320 - protein, 10 aa, Influenza virus
THFHRKRRVR

SEQ ID NO: 514321 - protein, 10 aa, Influenza virus
THFQRKRRIR

SEQ ID NO: 514322 - protein, 10 aa, Influenza virus
THFQRKRRVR

SEQ ID NO: 514323 - protein, 10 aa, Influenza virus
THGALLNDKH

SEQ ID NO: 514324 - protein, 10 aa, Influenza virus
THGSLLNDKH

SEQ ID NO: 514325 - protein, 10 aa, Influenza virus
THHMRKKRGL

SEQ ID NO: 514326 - protein, 10 aa, Influenza virus
THIHIFSFNG

SEQ ID NO: 514327 - protein, 10 aa, Influenza virus
THIHIFSFTG

SEQ ID NO: 514328 - protein, 10 aa, Influenza virus
THIMIWHSNL

SEQ ID NO: 514329 - protein, 10 aa, Influenza virus
THISVGTSTL

SEQ ID NO: 514330 - protein, 10 aa, Influenza virus
THKQLTHHMR

SEQ ID NO: 514331 - protein, 10 aa, Influenza virus
THLEICFMYS

SEQ ID NO: 514332 - protein, 10 aa, Influenza virus
THLEVCFMYS

SEQ ID NO: 514333 - protein, 10 aa, Influenza virus
THLMIWHSNL

SEQ ID NO: 514334 - protein, 10 aa, Influenza virus
THMEVCFMYS

SEQ ID NO: 514335 - protein, 10 aa, Influenza virus
THMMIWHSNL

SEQ ID NO: 514336 - protein, 10 aa, Influenza virus
THNGKLCKLN

SEQ ID NO: 514337 - protein, 10 aa, Influenza virus
THNGKLCRLR

SEQ ID NO: 514338 - protein, 10 aa, Influenza virus
THNGKLCRLS

SEQ ID NO: 514339 - protein, 10 aa, Influenza virus
THQYSEKGKW

SEQ ID NO: 514340 - protein, 10 aa, Influenza virus
THQYSEKGRW

SEQ ID NO: 514341 - protein, 10 aa, Influenza virus
THQYSERGKW

SEQ ID NO: 514342 - protein, 10 aa, Influenza virus
THQYSERGRW

SEQ ID NO: 514343 - protein, 10 aa, Influenza virus
THSWIPKRNR

SEQ ID NO: 514344 - protein, 10 aa, Influenza virus
THSWTPKRNR

SEQ ID NO: 514345 - protein, 10 aa, Influenza virus
THSWVPILNT

SEQ ID NO: 514346 - protein, 10 aa, Influenza virus
THSWVPKRNR

SEQ ID NO: 514347 - protein, 10 aa, Influenza virus
THTERGVEVV

SEQ ID NO: 514348 - protein, 10 aa, Influenza virus
THTGTSKACN

SEQ ID NO: 514349 - protein, 10 aa, Influenza virus
THTSQYICSP

SEQ ID NO: 514350 - protein, 10 aa, Influenza virus
THVQNNYTTI

SEQ ID NO: 514351 - protein, 10 aa, Influenza virus
THVQNNYTTV

SEQ ID NO: 514352 - protein, 10 aa, Influenza virus
TIAGFIEGGW

SEQ ID NO: 514353 - protein, 10 aa, Influenza virus
TIALFIGVGN

SEQ ID NO: 514354 - protein, 10 aa, Influenza virus
TIALIIGVGN

SEQ ID NO: 514355 - protein, 10 aa, Influenza virus
TIALLIGIGN

SEQ ID NO: 514356 - protein, 10 aa, Influenza virus
TIALLIGVGN

SEQ ID NO: 514357 - protein, 10 aa, Influenza virus
TIASDILKRM

SEQ ID NO: 514358 - protein, 10 aa, Influenza virus
TIASDILTRM

SEQ ID NO: 514359 - protein, 10 aa, Influenza virus
TIASSLPFQN

SEQ ID NO: 514360 - protein, 10 aa, Influenza virus
TICIGYHANN

SEQ ID NO: 514361 - protein, 10 aa, Influenza virus
TICIQGNNDN

SEQ ID NO: 514362 - protein, 10 aa, Influenza virus
TICVGYHANN

SEQ ID NO: 514363 - protein, 10 aa, Influenza virus
TICVQGNNDN

SEQ ID NO: 514364 - protein, 10 aa, Influenza virus
TICVQGNNKN

SEQ ID NO: 514365 - protein, 10 aa, Influenza virus
TICVQGNNNN

SEQ ID NO: 514366 - protein, 10 aa, Influenza virus
TIDEESRARI

SEQ ID NO: 514367 - protein, 10 aa, Influenza virus
TIDLADSEMD

SEQ ID NO: 514368 - protein, 10 aa, Influenza virus
TIDLADSEML

SEQ ID NO: 514369 - protein, 10 aa, Influenza virus
TIDLADSEMN

SEQ ID NO: 514370 - protein, 10 aa, Influenza virus
TIDLAESEMN

SEQ ID NO: 514371 - protein, 10 aa, Influenza virus
TIDLANSEMN

SEQ ID NO: 514372 - protein, 10 aa, Influenza virus
TIDLTDAEMN

SEQ ID NO: 514373 - protein, 10 aa, Influenza virus
TIDLTDSEMN

SEQ ID NO: 514374 - protein, 10 aa, Influenza virus
TIDLTDSEMS

SEQ ID NO: 514375 - protein, 10 aa, Influenza virus
TIDLTNSEMN

SEQ ID NO: 514376 - protein, 10 aa, Influenza virus
TIDMADSEML

SEQ ID NO: 514377 - protein, 10 aa, Influenza virus
TIDMTDSEMN

SEQ ID NO: 514378 - protein, 10 aa, Influenza virus
TIDQVTGKLN

SEQ ID NO: 514379 - protein, 10 aa, Influenza virus
TIDVADSEMN

SEQ ID NO: 514380 - protein, 10 aa, Influenza virus
TIDVTDSEMD

SEQ ID NO: 514381 - protein, 10 aa, Influenza virus
TIDVTDSEMN

SEQ ID NO: 514382 - protein, 10 aa, Influenza virus
TIDVTDSEMS

SEQ ID NO: 514383 - protein, 10 aa, Influenza virus
TIEKMVLSAF

SEQ ID NO: 514384 - protein, 10 aa, Influenza virus
TIEMTDSEML

SEQ ID NO: 514385 - protein, 10 aa, Influenza virus
TIERMVLSAF

SEQ ID NO: 514386 - protein, 10 aa, Influenza virus
TIGDCPKYMN

SEQ ID NO: 514387 - protein, 10 aa, Influenza virus
TIGDCPKYVN

SEQ ID NO: 514388 - protein, 10 aa, Influenza virus
TIGECPKYIK

SEQ ID NO: 514389 - protein, 10 aa, Influenza virus
TIGECPKYVK

SEQ ID NO: 514390 - protein, 10 aa, Influenza virus
TIGECPKYVR

SEQ ID NO: 514391 - protein, 10 aa, Influenza virus
TIGECPRYVK

SEQ ID NO: 514392 - protein, 10 aa, Influenza virus
TIGISGPDDG

SEQ ID NO: 514393 - protein, 10 aa, Influenza virus
TIGISGPDNE

SEQ ID NO: 514394 - protein, 10 aa, Influenza virus
TIGISGPDNG

SEQ ID NO: 514395 - protein, 10 aa, Influenza virus
TIGISGPDSG

SEQ ID NO: 514396 - protein, 10 aa, Influenza virus
TIGITGPDAT

SEQ ID NO: 514397 - protein, 10 aa, Influenza virus
TIGKCPKYVK

SEQ ID NO: 514398 - protein, 10 aa, Influenza virus
TIGKCSKYVK

SEQ ID NO: 514399 - protein, 10 aa, Influenza virus
TIGLLLQIIS

SEQ ID NO: 514400 - protein, 10 aa, Influenza virus
TIGLLLQITS

SEQ ID NO: 514401 - protein, 10 aa, Influenza virus
TIGNCPKYVN

SEQ ID NO: 514402 - protein, 10 aa, Influenza virus
TIGNLIAPRG

SEQ ID NO: 514403 - protein, 10 aa, Influenza virus
TIGNLVAPRG

SEQ ID NO: 514404 - protein, 10 aa, Influenza virus
TIGPLLQITS

SEQ ID NO: 514405 - protein, 10 aa, Influenza virus
TIGSVSLIIA

SEQ ID NO: 514406 - protein, 10 aa, Influenza virus
TIGSVSLTIA

SEQ ID NO: 514407 - protein, 10 aa, Influenza virus
TIGSVSLTIT

SEQ ID NO: 514408 - protein, 10 aa, Influenza virus
TIGVSGPDNG

SEQ ID NO: 514409 - protein, 10 aa, Influenza virus
TIHDGTAFRG

SEQ ID NO: 514410 - protein, 10 aa, Influenza virus
TIHDRAAFRG

SEQ ID NO: 514411 - protein, 10 aa, Influenza virus
TIHDRIPHRT

SEQ ID NO: 514412 - protein, 10 aa, Influenza virus
TIHDRSPFRA

SEQ ID NO: 514413 - protein, 10 aa, Influenza virus
TIHDRSPHRT

SEQ ID NO: 514414 - protein, 10 aa, Influenza virus
TIHDRSPYRA

SEQ ID NO: 514415 - protein, 10 aa, Influenza virus
TIHDRSQFRA

SEQ ID NO: 514416 - protein, 10 aa, Influenza virus
TIHDRSQYRA

SEQ ID NO: 514417 - protein, 10 aa, Influenza virus
TIHDRSQYRS

SEQ ID NO: 514418 - protein, 10 aa, Influenza virus
TIHDRTAFRG

SEQ ID NO: 514419 - protein, 10 aa, Influenza virus
TIHDRTPHRT

SEQ ID NO: 514420 - protein, 10 aa, Influenza virus
TIHDRTTFRG

SEQ ID NO: 514421 - protein, 10 aa, Influenza virus
TIHLTDSEMN

SEQ ID NO: 514422 - protein, 10 aa, Influenza virus
TIIENNVTVT

SEQ ID NO: 514423 - protein, 10 aa, Influenza virus
TIIESNVTVT

SEQ ID NO: 514424 - protein, 10 aa, Influenza virus
TIIETGYVCS

SEQ ID NO: 514425 - protein, 10 aa, Influenza virus
TIIFEANGNL

SEQ ID NO: 514426 - protein, 10 aa, Influenza virus
TIIFEASGNL

SEQ ID NO: 514427 - protein, 10 aa, Influenza virus
TIIFEATGNL

SEQ ID NO: 514428 - protein, 10 aa, Influenza virus
TIIGPPQCDL

SEQ ID NO: 514429 - protein, 10 aa, Influenza virus
TIIGPPQCDS

SEQ ID NO: 514430 - protein, 10 aa, Influenza virus
TIIKTLTNEK

SEQ ID NO: 514431 - protein, 10 aa, Influenza virus
TIINNYHNET

SEQ ID NO: 514432 - protein, 10 aa, Influenza virus
TIINNYYNDT

SEQ ID NO: 514433 - protein, 10 aa, Influenza virus
TIINNYYNET

SEQ ID NO: 514434 - protein, 10 aa, Influenza virus
TIINNYYNKT

SEQ ID NO: 514435 - protein, 10 aa, Influenza virus
TIISNLPFQN

SEQ ID NO: 514436 - protein, 10 aa, Influenza virus
TIISSLPFQN

SEQ ID NO: 514437 - protein, 10 aa, Influenza virus
TIIYSSSMMW

SEQ ID NO: 514438 - protein, 10 aa, Influenza virus
TIKDRSPYRT

SEQ ID NO: 514439 - protein, 10 aa, Influenza virus
TIKNGTYDHK

SEQ ID NO: 514440 - protein, 10 aa, Influenza virus
TIKNGTYNHK

SEQ ID NO: 514441 - protein, 10 aa, Influenza virus
TIKNGTYNHQ

SEQ ID NO: 514442 - protein, 10 aa, Influenza virus
TIKNGTYNRK

SEQ ID NO: 514443 - protein, 10 aa, Influenza virus
TIKPWARNIL

SEQ ID NO: 514444 - protein, 10 aa, Influenza virus
TIKQNGKSGA

SEQ ID NO: 514445 - protein, 10 aa, Influenza virus
TIKTWAGKIL

SEQ ID NO: 514446 - protein, 10 aa, Influenza virus
TIKTWAGNIL

SEQ ID NO: 514447 - protein, 10 aa, Influenza virus
TIKTWAKNIL

SEQ ID NO: 514448 - protein, 10 aa, Influenza virus
TIKTWARNIL

SEQ ID NO: 514449 - protein, 10 aa, Influenza virus
TILEKNITVT

SEQ ID NO: 514450 - protein, 10 aa, Influenza virus
TILEKNVTVT

SEQ ID NO: 514451 - protein, 10 aa, Influenza virus
TILEQNVTVT

SEQ ID NO: 514452 - protein, 10 aa, Influenza virus
TILERNVTVT

SEQ ID NO: 514453 - protein, 10 aa, Influenza virus
TILETGYICS

SEQ ID NO: 514454 - protein, 10 aa, Influenza virus
TILETGYVCG

SEQ ID NO: 514455 - protein, 10 aa, Influenza virus
TILETGYVCS

SEQ ID NO: 514456 - protein, 10 aa, Influenza virus
TILETRYVCS

SEQ ID NO: 514457 - protein, 10 aa, Influenza virus
TILRTQESEC

SEQ ID NO: 514458 - protein, 10 aa, Influenza virus
TIMEKNITVT

SEQ ID NO: 514459 - protein, 10 aa, Influenza virus
TIMEKNVIFT

SEQ ID NO: 514460 - protein, 10 aa, Influenza virus
TIMEKNVTVT

SEQ ID NO: 514461 - protein, 10 aa, Influenza virus
TIMEKSVTVS

SEQ ID NO: 514462 - protein, 10 aa, Influenza virus
TIMERNVTVT

SEQ ID NO: 514463 - protein, 10 aa, Influenza virus
TINDRSPFRA

SEQ ID NO: 514464 - protein, 10 aa, Influenza virus
TINDRTAFRG

SEQ ID NO: 514465 - protein, 10 aa, Influenza virus
TINEEALRQK

SEQ ID NO: 514466 - protein, 10 aa, Influenza virus
TINFESTGNL

SEQ ID NO: 514467 - protein, 10 aa, Influenza virus
TINNITNVVL

SEQ ID NO: 514468 - protein, 10 aa, Influenza virus
TINRIFQPNI

SEQ ID NO: 514469 - protein, 10 aa, Influenza virus
TINRNFQPNI

SEQ ID NO: 514470 - protein, 10 aa, Influenza virus
TINRSFQPNI

SEQ ID NO: 514471 - protein, 10 aa, Influenza virus
TINRSFRPNI

SEQ ID NO: 514472 - protein, 10 aa, Influenza virus
TINSPLPFQN

SEQ ID NO: 514473 - protein, 10 aa, Influenza virus
TINSWHIFGK

SEQ ID NO: 514474 - protein, 10 aa, Influenza virus
TINSWHIYGK

SEQ ID NO: 514475 - protein, 10 aa, Influenza virus
TINYYNETFV

SEQ ID NO: 514476 - protein, 10 aa, Influenza virus
TIPCFWVEMI

SEQ ID NO: 514477 - protein, 10 aa, Influenza virus
TIQIIKLLPF

SEQ ID NO: 514478 - protein, 10 aa, Influenza virus
TIQNEDIPIG

SEQ ID NO: 514479 - protein, 10 aa, Influenza virus
TIRGKHSNGT

SEQ ID NO: 514480 - protein, 10 aa, Influenza virus
TIRGRHSNGT

SEQ ID NO: 514481 - protein, 10 aa, Influenza virus
TIRNGTYDHT

SEQ ID NO: 514482 - protein, 10 aa, Influenza virus
TIRNGTYNHA

SEQ ID NO: 514483 - protein, 10 aa, Influenza virus
TIRNGTYNHE

SEQ ID NO: 514484 - protein, 10 aa, Influenza virus
TIRNGTYNHI

SEQ ID NO: 514485 - protein, 10 aa, Influenza virus
TIRNGTYNHK

SEQ ID NO: 514486 - protein, 10 aa, Influenza virus
TIRNGTYNHQ

SEQ ID NO: 514487 - protein, 10 aa, Influenza virus
TIRNGTYNHR

SEQ ID NO: 514488 - protein, 10 aa, Influenza virus
TIRNGTYNHS

SEQ ID NO: 514489 - protein, 10 aa, Influenza virus
TIRNGTYNHT

SEQ ID NO: 514490 - protein, 10 aa, Influenza virus
TIRNKHSNGT

SEQ ID NO: 514491 - protein, 10 aa, Influenza virus
TIRNKHSNST

SEQ ID NO: 514492 - protein, 10 aa, Influenza virus
TIRNRHSNGT

SEQ ID NO: 514493 - protein, 10 aa, Influenza virus
TIRTGTYNHR

SEQ ID NO: 514494 - protein, 10 aa, Influenza virus
TIRTWAKNIL

SEQ ID NO: 514495 - protein, 10 aa, Influenza virus
TISFESTGNL

SEQ ID NO: 514496 - protein, 10 aa, Influenza virus
TISIASRSGY

SEQ ID NO: 514497 - protein, 10 aa, Influenza virus
TISKDLRSGY

SEQ ID NO: 514498 - protein, 10 aa, Influenza virus
TISKDSRSGY

SEQ ID NO: 514499 - protein, 10 aa, Influenza virus
TISKDTRSGY

SEQ ID NO: 514500 - protein, 10 aa, Influenza virus
TISLVKTTLF

SEQ ID NO: 514501 - protein, 10 aa, Influenza virus
TISMDSRSGY

SEQ ID NO: 514502 - protein, 10 aa, Influenza virus
TISPHSRSGF

SEQ ID NO: 514503 - protein, 10 aa, Influenza virus
TISPKLRSGF

SEQ ID NO: 514504 - protein, 10 aa, Influenza virus
TISPRLRSGF

SEQ ID NO: 514505 - protein, 10 aa, Influenza virus
TISPRSRNGF

SEQ ID NO: 514506 - protein, 10 aa, Influenza virus
TISPRSRSGF

SEQ ID NO: 514507 - protein, 10 aa, Influenza virus
TISRDSRSGY

SEQ ID NO: 514508 - protein, 10 aa, Influenza virus
TISTASRAGY

SEQ ID NO: 514509 - protein, 10 aa, Influenza virus
TISTASRSGY

SEQ ID NO: 514510 - protein, 10 aa, Influenza virus
TITFEATGNL

SEQ ID NO: 514511 - protein, 10 aa, Influenza virus
TITFSFNGAF

SEQ ID NO: 514512 - protein, 10 aa, Influenza virus
TITGDNTKWN

SEQ ID NO: 514513 - protein, 10 aa, Influenza virus
TITLHFKQNE

SEQ ID NO: 514514 - protein, 10 aa, Influenza virus
TITNPLIRHE

SEQ ID NO: 514515 - protein, 10 aa, Influenza virus
TITSNLPFQN

SEQ ID NO: 514516 - protein, 10 aa, Influenza virus
TITSPLPFQN

SEQ ID NO: 514517 - protein, 10 aa, Influenza virus
TITYSSPMMW

SEQ ID NO: 514518 - protein, 10 aa, Influenza virus
TITYSSSLMW

SEQ ID NO: 514519 - protein, 10 aa, Influenza virus
TITYSSSMMW

SEQ ID NO: 514520 - protein, 10 aa, Influenza virus
TIVEKNVTVT

SEQ ID NO: 514521 - protein, 10 aa, Influenza virus
TIVETGYVCS

SEQ ID NO: 514522 - protein, 10 aa, Influenza virus
TIVKTLTNEK

SEQ ID NO: 514523 - protein, 10 aa, Influenza virus
TIVKTLTNEQ

SEQ ID NO: 514524 - protein, 10 aa, Influenza virus
TIVKTLTSEK

SEQ ID NO: 514525 - protein, 10 aa, Influenza virus
TIVLDTDWSG

SEQ ID NO: 514526 - protein, 10 aa, Influenza virus
TIVLNTDWSG

SEQ ID NO: 514527 - protein, 10 aa, Influenza virus
TIVSNTDWSG

SEQ ID NO: 514528 - protein, 10 aa, Influenza virus
TIVSSLPFQN

SEQ ID NO: 514529 - protein, 10 aa, Influenza virus
TIVSSLPFQS

SEQ ID NO: 514530 - protein, 10 aa, Influenza virus
TIWASGSSIS

SEQ ID NO: 514531 - protein, 10 aa, Influenza virus
TIWTSASSIS

SEQ ID NO: 514532 - protein, 10 aa, Influenza virus
TIWTSGSIIS

SEQ ID NO: 514533 - protein, 10 aa, Influenza virus
TIWTSGSSIA

SEQ ID NO: 514534 - protein, 10 aa, Influenza virus
TIWTSGSSIS

SEQ ID NO: 514535 - protein, 10 aa, Influenza virus
TIWTSSSSIV

SEQ ID NO: 514536 - protein, 10 aa, Influenza virus
TIWTSSSSVV

SEQ ID NO: 514537 - protein, 10 aa, Influenza virus
TIYSTAASSL

SEQ ID NO: 514538 - protein, 10 aa, Influenza virus
TIYSTVASPL

SEQ ID NO: 514539 - protein, 10 aa, Influenza virus
TIYSTVASSF

SEQ ID NO: 514540 - protein, 10 aa, Influenza virus
TIYSTVASSI

SEQ ID NO: 514541 - protein, 10 aa, Influenza virus
TIYSTVASSL

SEQ ID NO: 514542 - protein, 10 aa, Influenza virus
TIYWWDGLQS

SEQ ID NO: 514543 - protein, 10 aa, Influenza virus
TKALLIGIGN

SEQ ID NO: 514544 - protein, 10 aa, Influenza virus
TKAPQLNPID

SEQ ID NO: 514545 - protein, 10 aa, Influenza virus
TKATKMEAIL

SEQ ID NO: 514546 - protein, 10 aa, Influenza virus
TKATKMKAII

SEQ ID NO: 514547 - protein, 10 aa, Influenza virus
TKATKMKAIL

SEQ ID NO: 514548 - protein, 10 aa, Influenza virus
TKATNGNYGP

SEQ ID NO: 514549 - protein, 10 aa, Influenza virus
TKCQLNEGVM

SEQ ID NO: 514550 - protein, 10 aa, Influenza virus
TKCQSPLGAI

SEQ ID NO: 514551 - protein, 10 aa, Influenza virus
TKCQTPLGAI

SEQ ID NO: 514552 - protein, 10 aa, Influenza virus
TKCQTPLGAL

SEQ ID NO: 514553 - protein, 10 aa, Influenza virus
TKCQTSLGGI

SEQ ID NO: 514554 - protein, 10 aa, Influenza virus
TKCQTSLGGV

SEQ ID NO: 514555 - protein, 10 aa, Influenza virus
TKCQTSMGGI

SEQ ID NO: 514556 - protein, 10 aa, Influenza virus
TKCQTSMGGV

SEQ ID NO: 514557 - protein, 10 aa, Influenza virus
TKCQTSVGGI

SEQ ID NO: 514558 - protein, 10 aa, Influenza virus
TKCQTYAGAI

SEQ ID NO: 514559 - protein, 10 aa, Influenza virus
TKCQTYAGAV

SEQ ID NO: 514560 - protein, 10 aa, Influenza virus
TKCQTYTGAI

SEQ ID NO: 514561 - protein, 10 aa, Influenza virus
TKDAERGKLK

SEQ ID NO: 514562 - protein, 10 aa, Influenza virus
TKDNSIRIGS

SEQ ID NO: 514563 - protein, 10 aa, Influenza virus
TKDNSIRLSA

SEQ ID NO: 514564 - protein, 10 aa, Influenza virus
TKDSITDIWT

SEQ ID NO: 514565 - protein, 10 aa, Influenza virus
TKEAQDVIME

SEQ ID NO: 514566 - protein, 10 aa, Influenza virus
TKEGRRKTNL

SEQ ID NO: 514567 - protein, 10 aa, Influenza virus
TKEGRRRTNL

SEQ ID NO: 514568 - protein, 10 aa, Influenza virus
TKEMEGICYP

SEQ ID NO: 514569 - protein, 10 aa, Influenza virus
TKENTGSYVR

SEQ ID NO: 514570 - protein, 10 aa, Influenza virus
TKEQTALYKN

SEQ ID NO: 514571 - protein, 10 aa, Influenza virus
TKEQTTLYKN

SEQ ID NO: 514572 - protein, 10 aa, Influenza virus
TKETNGNYGP

SEQ ID NO: 514573 - protein, 10 aa, Influenza virus
TKEWSKRYEL

SEQ ID NO: 514574 - protein, 10 aa, Influenza virus
TKEWSRRYEL

SEQ ID NO: 514575 - protein, 10 aa, Influenza virus
TKGDKICLGH

SEQ ID NO: 514576 - protein, 10 aa, Influenza virus
TKGEKANVLI

SEQ ID NO: 514577 - protein, 10 aa, Influenza virus
TKGILGFVFT

SEQ ID NO: 514578 - protein, 10 aa, Influenza virus
TKGKKAVDLG

SEQ ID NO: 514579 - protein, 10 aa, Influenza virus
TKGLCTINSW

SEQ ID NO: 514580 - protein, 10 aa, Influenza virus
TKGMLGFVFT

SEQ ID NO: 514581 - protein, 10 aa, Influenza virus
TKGVLGFVFT

SEQ ID NO: 514582 - protein, 10 aa, Influenza virus
TKHDRIPHRT

SEQ ID NO: 514583 - protein, 10 aa, Influenza virus
TKIDLWSYNA

SEQ ID NO: 514584 - protein, 10 aa, Influenza virus
TKILFIEEGK

SEQ ID NO: 514585 - protein, 10 aa, Influenza virus
TKILYFHKGL

SEQ ID NO: 514586 - protein, 10 aa, Influenza virus
TKIMYFHKGL

SEQ ID NO: 514587 - protein, 10 aa, Influenza virus
TKINNIIDKM

SEQ ID NO: 514588 - protein, 10 aa, Influenza virus
TKINNIIEKM

SEQ ID NO: 514589 - protein, 10 aa, Influenza virus
TKINTLTERG

SEQ ID NO: 514590 - protein, 10 aa, Influenza virus
TKITVDHMAI

SEQ ID NO: 514591 - protein, 10 aa, Influenza virus
TKKEPDTYDF

SEQ ID NO: 514592 - protein, 10 aa, Influenza virus
TKKKNPEAYN

SEQ ID NO: 514593 - protein, 10 aa, Influenza virus
TKKKPDIYDF

SEQ ID NO: 514594 - protein, 10 aa, Influenza virus
TKKKPDTYDF

SEQ ID NO: 514595 - protein, 10 aa, Influenza virus
TKKMTITFLI

SEQ ID NO: 514596 - protein, 10 aa, Influenza virus
TKKQLRENAE

SEQ ID NO: 514597 - protein, 10 aa, Influenza virus
TKLGSPLVLD

SEQ ID NO: 514598 - protein, 10 aa, Influenza virus
TKLPFQNLSP

SEQ ID NO: 514599 - protein, 10 aa, Influenza virus
TKLYGNGNKL

SEQ ID NO: 514600 - protein, 10 aa, Influenza virus
TKLYGSGNKL

SEQ ID NO: 514601 - protein, 10 aa, Influenza virus
TKLYGSGSKL

SEQ ID NO: 514602 - protein, 10 aa, Influenza virus
TKLYKNTNTL

SEQ ID NO: 514603 - protein, 10 aa, Influenza virus
TKLYVNKNPY

SEQ ID NO: 514604 - protein, 10 aa, Influenza virus
TKMEAILVVL

SEQ ID NO: 514605 - protein, 10 aa, Influenza virus
TKMKAIIVVL

SEQ ID NO: 514606 - protein, 10 aa, Influenza virus
TKMKAILVVL

SEQ ID NO: 514607 - protein, 10 aa, Influenza virus
TKPRPRRGLF

SEQ ID NO: 514608 - protein, 10 aa, Influenza virus
TKQMCIAWSS

SEQ ID NO: 514609 - protein, 10 aa, Influenza virus
TKQVCAAWSS

SEQ ID NO: 514610 - protein, 10 aa, Influenza virus
TKQVCIAWSS

SEQ ID NO: 514611 - protein, 10 aa, Influenza virus
TKQVCMAWSS

SEQ ID NO: 514612 - protein, 10 aa, Influenza virus
TKQVCVAWSS

SEQ ID NO: 514613 - protein, 10 aa, Influenza virus
TKQVDTIMEK

SEQ ID NO: 514614 - protein, 10 aa, Influenza virus
TKRLCTINSW

SEQ ID NO: 514615 - protein, 10 aa, Influenza virus
TKRQLRENAE

SEQ ID NO: 514616 - protein, 10 aa, Influenza virus
TKRSHEQMET

SEQ ID NO: 514617 - protein, 10 aa, Influenza virus
TKRSYEQMET

SEQ ID NO: 514618 - protein, 10 aa, Influenza virus
TKSLESRRGF

SEQ ID NO: 514619 - protein, 10 aa, Influenza virus
TKSLESRSGF

SEQ ID NO: 514620 - protein, 10 aa, Influenza virus
TKSTVLKSDK

SEQ ID NO: 514621 - protein, 10 aa, Influenza virus
TKSYFANLKG

SEQ ID NO: 514622 - protein, 10 aa, Influenza virus
TKTMTITFLI

SEQ ID NO: 514623 - protein, 10 aa, Influenza virus
TKTTVDHMAI

SEQ ID NO: 514624 - protein, 10 aa, Influenza virus
TKVDLWSYNA

SEQ ID NO: 514625 - protein, 10 aa, Influenza virus
TKVLYFHKGI

SEQ ID NO: 514626 - protein, 10 aa, Influenza virus
TKVLYFHKGL

SEQ ID NO: 514627 - protein, 10 aa, Influenza virus
TKVMYFHKGL

SEQ ID NO: 514628 - protein, 10 aa, Influenza virus
TKVNTLTEKG

SEQ ID NO: 514629 - protein, 10 aa, Influenza virus
TKVNTLTERG

SEQ ID NO: 514630 - protein, 10 aa, Influenza virus
TKWNENQNPR

SEQ ID NO: 514631 - protein, 10 aa, Influenza virus
TKWNVTHTGT

SEQ ID NO: 514632 - protein, 10 aa, Influenza virus
TKWNVTYTGI

SEQ ID NO: 514633 - protein, 10 aa, Influenza virus
TKWNVTYTGT

SEQ ID NO: 514634 - protein, 10 aa, Influenza virus
TLCICYHANN

SEQ ID NO: 514635 - protein, 10 aa, Influenza virus
TLCIGYHANN

SEQ ID NO: 514636 - protein, 10 aa, Influenza virus
TLCLGHHAVA

SEQ ID NO: 514637 - protein, 10 aa, Influenza virus
TLCLGHHAVP

SEQ ID NO: 514638 - protein, 10 aa, Influenza virus
TLCLGHHAVQ

SEQ ID NO: 514639 - protein, 10 aa, Influenza virus
TLCLGHHAVS

SEQ ID NO: 514640 - protein, 10 aa, Influenza virus
TLDEESRARI

SEQ ID NO: 514641 - protein, 10 aa, Influenza virus
TLDEHDANVR

SEQ ID NO: 514642 - protein, 10 aa, Influenza virus
TLDEHDSNVE

SEQ ID NO: 514643 - protein, 10 aa, Influenza virus
TLDEHDSNVK

SEQ ID NO: 514644 - protein, 10 aa, Influenza virus
TLDFHDSNVK

SEQ ID NO: 514645 - protein, 10 aa, Influenza virus
TLDFHDSNVR

SEQ ID NO: 514646 - protein, 10 aa, Influenza virus
TLDFHDSSVK

SEQ ID NO: 514647 - protein, 10 aa, Influenza virus
TLDKHDSNVK

SEQ ID NO: 514648 - protein, 10 aa, Influenza virus
TLDLHDANVK

SEQ ID NO: 514649 - protein, 10 aa, Influenza virus
TLDLHDANVR

SEQ ID NO: 514650 - protein, 10 aa, Influenza virus
TLDLHDSNVK

SEQ ID NO: 514651 - protein, 10 aa, Influenza virus
TLDLHDSNVR

SEQ ID NO: 514652 - protein, 10 aa, Influenza virus
TLDMHDANVK

SEQ ID NO: 514653 - protein, 10 aa, Influenza virus
TLDMHDANVR

SEQ ID NO: 514654 - protein, 10 aa, Influenza virus
TLDMHDVNVK

SEQ ID NO: 514655 - protein, 10 aa, Influenza virus
TLDNEHSNGT

SEQ ID NO: 514656 - protein, 10 aa, Influenza virus
TLDNKHSNDT

SEQ ID NO: 514657 - protein, 10 aa, Influenza virus
TLDNKHSNGT

SEQ ID NO: 514658 - protein, 10 aa, Influenza virus
TLDQHDANVK

SEQ ID NO: 514659 - protein, 10 aa, Influenza virus
TLDYHDSNVK

SEQ ID NO: 514660 - protein, 10 aa, Influenza virus
TLEHTSRYVC

SEQ ID NO: 514661 - protein, 10 aa, Influenza virus
TLELRSGYWA

SEQ ID NO: 514662 - protein, 10 aa, Influenza virus
TLELRSKYWA

SEQ ID NO: 514663 - protein, 10 aa, Influenza virus
TLELRSRYWA

SEQ ID NO: 514664 - protein, 10 aa, Influenza virus
TLENKHSNGT

SEQ ID NO: 514665 - protein, 10 aa, Influenza virus
TLFEKFFPSS

SEQ ID NO: 514666 - protein, 10 aa, Influenza virus
TLFQQMRDIL

SEQ ID NO: 514667 - protein, 10 aa, Influenza virus
TLFQQMRDVI

SEQ ID NO: 514668 - protein, 10 aa, Influenza virus
TLFQQMRDVL

SEQ ID NO: 514669 - protein, 10 aa, Influenza virus
TLGENMAPEK

SEQ ID NO: 514670 - protein, 10 aa, Influenza virus
TLGITGPDAT

SEQ ID NO: 514671 - protein, 10 aa, Influenza virus
TLGITGPDST

SEQ ID NO: 514672 - protein, 10 aa, Influenza virus
TLGITGPDTT

SEQ ID NO: 514673 - protein, 10 aa, Influenza virus
TLGLDIRTAT

SEQ ID NO: 514674 - protein, 10 aa, Influenza virus
TLGLHDANVR

SEQ ID NO: 514675 - protein, 10 aa, Influenza virus
TLHFKQHDCD

SEQ ID NO: 514676 - protein, 10 aa, Influenza virus
TLHFKQHECD

SEQ ID NO: 514677 - protein, 10 aa, Influenza virus
TLHFKQHECN

SEQ ID NO: 514678 - protein, 10 aa, Influenza virus
TLHFKQHKCD

SEQ ID NO: 514679 - protein, 10 aa, Influenza virus
TLHFKQNECS

SEQ ID NO: 514680 - protein, 10 aa, Influenza virus
TLIDALLGDP

SEQ ID NO: 514681 - protein, 10 aa, Influenza virus
TLIDAMLGDP

SEQ ID NO: 514682 - protein, 10 aa, Influenza virus
TLIENTYVNN

SEQ ID NO: 514683 - protein, 10 aa, Influenza virus
TLIEQKVPVT

SEQ ID NO: 514684 - protein, 10 aa, Influenza virus
TLIEQNIPVT

SEQ ID NO: 514685 - protein, 10 aa, Influenza virus
TLIEQNVPVT

SEQ ID NO: 514686 - protein, 10 aa, Influenza virus
TLISWEMGQA

SEQ ID NO: 514687 - protein, 10 aa, Influenza virus
TLITDGPSDA

SEQ ID NO: 514688 - protein, 10 aa, Influenza virus
TLITDGPSNA

SEQ ID NO: 514689 - protein, 10 aa, Influenza virus
TLKGRHANGT

SEQ ID NO: 514690 - protein, 10 aa, Influenza virus
TLKIRTNGNL

SEQ ID NO: 514691 - protein, 10 aa, Influenza virus
TLKLATGMRN

SEQ ID NO: 514692 - protein, 10 aa, Influenza virus
TLKLGQFPVQ

SEQ ID NO: 514693 - protein, 10 aa, Influenza virus
TLKSEQFPVQ

SEQ ID NO: 514694 - protein, 10 aa, Influenza virus
TLKSGQFPVQ

SEQ ID NO: 514695 - protein, 10 aa, Influenza virus
TLKSWKGNIM

SEQ ID NO: 514696 - protein, 10 aa, Influenza virus
TLKVESNGNL

SEQ ID NO: 514697 - protein, 10 aa, Influenza virus
TLLAKSVFNC

SEQ ID NO: 514698 - protein, 10 aa, Influenza virus
TLLAKSVFNN

SEQ ID NO: 514699 - protein, 10 aa, Influenza virus
TLLAKSVFNS

SEQ ID NO: 514700 - protein, 10 aa, Influenza virus
TLLEKNVTVT

SEQ ID NO: 514701 - protein, 10 aa, Influenza virus
TLLENDVPVT

SEQ ID NO: 514702 - protein, 10 aa, Influenza virus
TLLENGVPVT

SEQ ID NO: 514703 - protein, 10 aa, Influenza virus
TLLENNVPVT

SEQ ID NO: 514704 - protein, 10 aa, Influenza virus
TLLESDVPVT

SEQ ID NO: 514705 - protein, 10 aa, Influenza virus
TLLKHRFEII

SEQ ID NO: 514706 - protein, 10 aa, Influenza virus
TLLMNELGIP

SEQ ID NO: 514707 - protein, 10 aa, Influenza virus
TLLMNELGVP

SEQ ID NO: 514708 - protein, 10 aa, Influenza virus
TLLMNELGVS

SEQ ID NO: 514709 - protein, 10 aa, Influenza virus
TLLMSELGVP

SEQ ID NO: 514710 - protein, 10 aa, Influenza virus
TLMDALLGDP

SEQ ID NO: 514711 - protein, 10 aa, Influenza virus
TLMEQNVPVT

SEQ ID NO: 514712 - protein, 10 aa, Influenza virus
TLMSCPIGVA

SEQ ID NO: 514713 - protein, 10 aa, Influenza virus
TLMSCPIGVV

SEQ ID NO: 514714 - protein, 10 aa, Influenza virus
TLMSCPMGVA

SEQ ID NO: 514715 - protein, 10 aa, Influenza virus
TLMSCPVGVA

SEQ ID NO: 514716 - protein, 10 aa, Influenza virus
TLMTDGPSDA

SEQ ID NO: 514717 - protein, 10 aa, Influenza virus
TLNIESNGNL

SEQ ID NO: 514718 - protein, 10 aa, Influenza virus
TLNMHDANVR

SEQ ID NO: 514719 - protein, 10 aa, Influenza virus
TLNNKHSNGT

SEQ ID NO: 514720 - protein, 10 aa, Influenza virus
TLNRNQPAAT

SEQ ID NO: 514721 - protein, 10 aa, Influenza virus
TLNTASRSGY

SEQ ID NO: 514722 - protein, 10 aa, Influenza virus
TLNTMTKDAE

SEQ ID NO: 514723 - protein, 10 aa, Influenza virus
TLNVESNGNL

SEQ ID NO: 514724 - protein, 10 aa, Influenza virus
TLPFHNIHPL

SEQ ID NO: 514725 - protein, 10 aa, Influenza virus
TLPFHNVHPL

SEQ ID NO: 514726 - protein, 10 aa, Influenza virus
TLPRRSGAAG

SEQ ID NO: 514727 - protein, 10 aa, Influenza virus
TLRGQHANGT

SEQ ID NO: 514728 - protein, 10 aa, Influenza virus
TLRGRHANGT

SEQ ID NO: 514729 - protein, 10 aa, Influenza virus
TLRIISNGNL

SEQ ID NO: 514730 - protein, 10 aa, Influenza virus
TLRIRSNGNL

SEQ ID NO: 514731 - protein, 10 aa, Influenza virus
TLRSLVASSG

SEQ ID NO: 514732 - protein, 10 aa, Influenza virus
TLRTQESECA

SEQ ID NO: 514733 - protein, 10 aa, Influenza virus
TLRVKSNGNL

SEQ ID NO: 514734 - protein, 10 aa, Influenza virus
TLRVRSDGNL

SEQ ID NO: 514735 - protein, 10 aa, Influenza virus
TLRVRSNGNL

SEQ ID NO: 514736 - protein, 10 aa, Influenza virus
TLSEQNVPVT

SEQ ID NO: 514737 - protein, 10 aa, Influenza virus
TLSGVAIALS

SEQ ID NO: 514738 - protein, 10 aa, Influenza virus
TLSSGYKDII

SEQ ID NO: 514739 - protein, 10 aa, Influenza virus
TLSSVNTNTI

SEQ ID NO: 514740 - protein, 10 aa, Influenza virus
TLSSVTTNTI

SEQ ID NO: 514741 - protein, 10 aa, Influenza virus
TLSTIALFIG

SEQ ID NO: 514742 - protein, 10 aa, Influenza virus
TLSTIALIIG

SEQ ID NO: 514743 - protein, 10 aa, Influenza virus
TLSTIALLIG

SEQ ID NO: 514744 - protein, 10 aa, Influenza virus
TLTDNHVEVV

SEQ ID NO: 514745 - protein, 10 aa, Influenza virus
TLTEKGIEVV

SEQ ID NO: 514746 - protein, 10 aa, Influenza virus
TLTEKGVEVV

SEQ ID NO: 514747 - protein, 10 aa, Influenza virus
TLTENGVPVT

SEQ ID NO: 514748 - protein, 10 aa, Influenza virus
TLTEQNVPVT

SEQ ID NO: 514749 - protein, 10 aa, Influenza virus
TLTEREVEVV

SEQ ID NO: 514750 - protein, 10 aa, Influenza virus
TLTERGIEVV

SEQ ID NO: 514751 - protein, 10 aa, Influenza virus
TLTERGVEVV

SEQ ID NO: 514752 - protein, 10 aa, Influenza virus
TLTETGVPVT

SEQ ID NO: 514753 - protein, 10 aa, Influenza virus
TLTGRGIEVV

SEQ ID NO: 514754 - protein, 10 aa, Influenza virus
TLTLNTMTKD

SEQ ID NO: 514755 - protein, 10 aa, Influenza virus
TLTMGYKDII

SEQ ID NO: 514756 - protein, 10 aa, Influenza virus
TLTSVTTNTI

SEQ ID NO: 514757 - protein, 10 aa, Influenza virus
TLTVPSERGL

SEQ ID NO: 514758 - protein, 10 aa, Influenza virus
TLVANNDWSG

SEQ ID NO: 514759 - protein, 10 aa, Influenza virus
TLVDALLGDP

SEQ ID NO: 514760 - protein, 10 aa, Influenza virus
TLVLLVSLGA

SEQ ID NO: 514761 - protein, 10 aa, Influenza virus
TLVNPGDSII

SEQ ID NO: 514762 - protein, 10 aa, Influenza virus
TLVSNNDWSG

SEQ ID NO: 514763 - protein, 10 aa, Influenza virus
TLVSNSDWSG

SEQ ID NO: 514764 - protein, 10 aa, Influenza virus
TLVSTKEWSK

SEQ ID NO: 514765 - protein, 10 aa, Influenza virus
TLVSTKEWSR

SEQ ID NO: 514766 - protein, 10 aa, Influenza virus
TLVTDGPSDA

SEQ ID NO: 514767 - protein, 10 aa, Influenza virus
TLYFHDSNVK

SEQ ID NO: 514768 - protein, 10 aa, Influenza virus
TLYKNANTLS

SEQ ID NO: 514769 - protein, 10 aa, Influenza virus
TLYKNANTLT

SEQ ID NO: 514770 - protein, 10 aa, Influenza virus
TLYNKHSNGT

SEQ ID NO: 514771 - protein, 10 aa, Influenza virus
TMDTVNRTHQ

SEQ ID NO: 514772 - protein, 10 aa, Influenza virus
TMDTVSRTHQ

SEQ ID NO: 514773 - protein, 10 aa, Influenza virus
TMDYYWGILK

SEQ ID NO: 514774 - protein, 10 aa, Influenza virus
TMELVEAEKH

SEQ ID NO: 514775 - protein, 10 aa, Influenza virus
TMELVETEKH

SEQ ID NO: 514776 - protein, 10 aa, Influenza virus
TMELVETEKN

SEQ ID NO: 514777 - protein, 10 aa, Influenza virus
TMELVETKKH

SEQ ID NO: 514778 - protein, 10 aa, Influenza virus
TMGYKDIILW

SEQ ID NO: 514779 - protein, 10 aa, Influenza virus
TMHDRSPFRA

SEQ ID NO: 514780 - protein, 10 aa, Influenza virus
TMHQLLRHFQ

SEQ ID NO: 514781 - protein, 10 aa, Influenza virus
TMKDRSPYRT

SEQ ID NO: 514782 - protein, 10 aa, Influenza virus
TMLNLYERVR

SEQ ID NO: 514783 - protein, 10 aa, Influenza virus
TMTHTSQYIC

SEQ ID NO: 514784 - protein, 10 aa, Influenza virus
TMTITFLILL

SEQ ID NO: 514785 - protein, 10 aa, Influenza virus
TMTKDAERGK

SEQ ID NO: 514786 - protein, 10 aa, Influenza virus
TNADKICLGH

SEQ ID NO: 514787 - protein, 10 aa, Influenza virus
TNAHDRICIG

SEQ ID NO: 514788 - protein, 10 aa, Influenza virus
TNATETVENK

SEQ ID NO: 514789 - protein, 10 aa, Influenza virus
TNATETVESK

SEQ ID NO: 514790 - protein, 10 aa, Influenza virus
TNATETVESR

SEQ ID NO: 514791 - protein, 10 aa, Influenza virus
TNATETVEST

SEQ ID NO: 514792 - protein, 10 aa, Influenza virus
TNAYDRICIG

SEQ ID NO: 514793 - protein, 10 aa, Influenza virus
TNDKYHQIEK

SEQ ID NO: 514794 - protein, 10 aa, Influenza virus
TNEEALRQII

SEQ ID NO: 514795 - protein, 10 aa, Influenza virus
TNEKFHQIEK

SEQ ID NO: 514796 - protein, 10 aa, Influenza virus
TNEKYHQIEK

SEQ ID NO: 514797 - protein, 10 aa, Influenza virus
TNGEQILIIW

SEQ ID NO: 514798 - protein, 10 aa, Influenza virus
TNGNLIAPEF

SEQ ID NO: 514799 - protein, 10 aa, Influenza virus
TNGNLIAPEY

SEQ ID NO: 514800 - protein, 10 aa, Influenza virus
TNGNYGPINV

SEQ ID NO: 514801 - protein, 10 aa, Influenza virus
TNGTIVKTLT

SEQ ID NO: 514802 - protein, 10 aa, Influenza virus
TNGTSKIKMK

SEQ ID NO: 514803 - protein, 10 aa, Influenza virus
TNGTSKVKMK

SEQ ID NO: 514804 - protein, 10 aa, Influenza virus
TNGTTGNPII

SEQ ID NO: 514805 - protein, 10 aa, Influenza virus
TNHQFELIDN

SEQ ID NO: 514806 - protein, 10 aa, Influenza virus
TNHTDELCPS

SEQ ID NO: 514807 - protein, 10 aa, Influenza virus
TNHTGTYCSL

SEQ ID NO: 514808 - protein, 10 aa, Influenza virus
TNINIREWSY

SEQ ID NO: 514809 - protein, 10 aa, Influenza virus
TNKFAAICTH

SEQ ID NO: 514810 - protein, 10 aa, Influenza virus
TNKFAAVCTH

SEQ ID NO: 514811 - protein, 10 aa, Influenza virus
TNKFASICTH

SEQ ID NO: 514812 - protein, 10 aa, Influenza virus
TNKINNIVDK

SEQ ID NO: 514813 - protein, 10 aa, Influenza virus
TNKINSIIDK

SEQ ID NO: 514814 - protein, 10 aa, Influenza virus
TNKLAAICTH

SEQ ID NO: 514815 - protein, 10 aa, Influenza virus
TNKQFELIDN

SEQ ID NO: 514816 - protein, 10 aa, Influenza virus
TNKTFQNASP

SEQ ID NO: 514817 - protein, 10 aa, Influenza virus
TNKTFQNIDK

SEQ ID NO: 514818 - protein, 10 aa, Influenza virus
TNKTFQNIDR

SEQ ID NO: 514819 - protein, 10 aa, Influenza virus
TNKTFQNIEK

SEQ ID NO: 514820 - protein, 10 aa, Influenza virus
TNKTFQNIER

SEQ ID NO: 514821 - protein, 10 aa, Influenza virus
TNKTFQNISP

SEQ ID NO: 514822 - protein, 10 aa, Influenza virus
TNKTFQNVSP

SEQ ID NO: 514823 - protein, 10 aa, Influenza virus
TNKVNNIVDK

SEQ ID NO: 514824 - protein, 10 aa, Influenza virus
TNKVNSIIDK

SEQ ID NO: 514825 - protein, 10 aa, Influenza virus
TNKVNSIINK

SEQ ID NO: 514826 - protein, 10 aa, Influenza virus
TNLGLNIGLH

SEQ ID NO: 514827 - protein, 10 aa, Influenza virus
TNLYGFIIKG

SEQ ID NO: 514828 - protein, 10 aa, Influenza virus
TNLYGFIVKG

SEQ ID NO: 514829 - protein, 10 aa, Influenza virus
TNLYVNKNPY

SEQ ID NO: 514830 - protein, 10 aa, Influenza virus
TNMINDKIDD

SEQ ID NO: 514831 - protein, 10 aa, Influenza virus
TNNSTDTVNT

SEQ ID NO: 514832 - protein, 10 aa, Influenza virus
TNNSTETVNT

SEQ ID NO: 514833 - protein, 10 aa, Influenza virus
TNNYGVKGFG

SEQ ID NO: 514834 - protein, 10 aa, Influenza virus
TNPLIKHENR

SEQ ID NO: 514835 - protein, 10 aa, Influenza virus
TNPLIRHENR

SEQ ID NO: 514836 - protein, 10 aa, Influenza virus
TNQQFELIDN

SEQ ID NO: 514837 - protein, 10 aa, Influenza virus
TNQQFELIDS

SEQ ID NO: 514838 - protein, 10 aa, Influenza virus
TNQQFELINN

SEQ ID NO: 514839 - protein, 10 aa, Influenza virus
TNQQFEMIDN

SEQ ID NO: 514840 - protein, 10 aa, Influenza virus
TNQQFGLIDN

SEQ ID NO: 514841 - protein, 10 aa, Influenza virus
TNQQFKLIDN

SEQ ID NO: 514842 - protein, 10 aa, Influenza virus
TNRTFQNIDK

SEQ ID NO: 514843 - protein, 10 aa, Influenza virus
TNRTFQNIDR

SEQ ID NO: 514844 - protein, 10 aa, Influenza virus
TNRTFQNVSP

SEQ ID NO: 514845 - protein, 10 aa, Influenza virus
TNSEMNKLYE

SEQ ID NO: 514846 - protein, 10 aa, Influenza virus
TNSIVVFCGT

SEQ ID NO: 514847 - protein, 10 aa, Influenza virus
TNSSDKVDTL

SEQ ID NO: 514848 - protein, 10 aa, Influenza virus
TNSSEKVDTL

SEQ ID NO: 514849 - protein, 10 aa, Influenza virus
TNSSEKVNTL

SEQ ID NO: 514850 - protein, 10 aa, Influenza virus
TNSSERVDTL

SEQ ID NO: 514851 - protein, 10 aa, Influenza virus
TNSTEKVDTL

SEQ ID NO: 514852 - protein, 10 aa, Influenza virus
TNTEFESIES

SEQ ID NO: 514853 - protein, 10 aa, Influenza virus
TNTINRIFQP

SEQ ID NO: 514854 - protein, 10 aa, Influenza virus
TNTINRNFQP

SEQ ID NO: 514855 - protein, 10 aa, Influenza virus
TNTINRSFQP

SEQ ID NO: 514856 - protein, 10 aa, Influenza virus
TNTINRSFRP

SEQ ID NO: 514857 - protein, 10 aa, Influenza virus
TNTLSSVTTN

SEQ ID NO: 514858 - protein, 10 aa, Influenza virus
TNTQFELIDN

SEQ ID NO: 514859 - protein, 10 aa, Influenza virus
TNTVNTLIEQ

SEQ ID NO: 514860 - protein, 10 aa, Influenza virus
TNVQNDYTTV

SEQ ID NO: 514861 - protein, 10 aa, Influenza virus
TNVQNNYTTI

SEQ ID NO: 514862 - protein, 10 aa, Influenza virus
TNVQNNYTTV

SEQ ID NO: 514863 - protein, 10 aa, Influenza virus
TNWSGYSGSF

SEQ ID NO: 514864 - protein, 10 aa, Influenza virus
TNYYNETFVN

SEQ ID NO: 514865 - protein, 10 aa, Influenza virus
TPACDLHLTG

SEQ ID NO: 514866 - protein, 10 aa, Influenza virus
TPACDLYLTG

SEQ ID NO: 514867 - protein, 10 aa, Influenza virus
TPCVLLNDKH

SEQ ID NO: 514868 - protein, 10 aa, Influenza virus
TPDPGVKGFA

SEQ ID NO: 514869 - protein, 10 aa, Influenza virus
TPEWSYIVEK

SEQ ID NO: 514870 - protein, 10 aa, Influenza virus
TPGMQIRGFV

SEQ ID NO: 514871 - protein, 10 aa, Influenza virus
TPHRTLLMNE

SEQ ID NO: 514872 - protein, 10 aa, Influenza virus
TPIAFLTSSI

SEQ ID NO: 514873 - protein, 10 aa, Influenza virus
TPKRNRSILN

SEQ ID NO: 514874 - protein, 10 aa, Influenza virus
TPLELRDCKI

SEQ ID NO: 514875 - protein, 10 aa, Influenza virus
TPLGAINTTL

SEQ ID NO: 514876 - protein, 10 aa, Influenza virus
TPLGALNTTL

SEQ ID NO: 514877 - protein, 10 aa, Influenza virus
TPLGSPPIVS

SEQ ID NO: 514878 - protein, 10 aa, Influenza virus
TPLGSPPMVS

SEQ ID NO: 514879 - protein, 10 aa, Influenza virus
TPLGSPPVVS

SEQ ID NO: 514880 - protein, 10 aa, Influenza virus
TPLGTPPTVS

SEQ ID NO: 514881 - protein, 10 aa, Influenza virus
TPNGSIPNDK

SEQ ID NO: 514882 - protein, 10 aa, Influenza virus
TPNGSIPNEK

SEQ ID NO: 514883 - protein, 10 aa, Influenza virus
TPNGSIPNGK

SEQ ID NO: 514884 - protein, 10 aa, Influenza virus
TPNGSIPNNK

SEQ ID NO: 514885 - protein, 10 aa, Influenza virus
TPNGSISNDK

SEQ ID NO: 514886 - protein, 10 aa, Influenza virus
TPPLELGDCS

SEQ ID NO: 514887 - protein, 10 aa, Influenza virus
TPPTVSNSDF

SEQ ID NO: 514888 - protein, 10 aa, Influenza virus
TPRNDDSSSN

SEQ ID NO: 514889 - protein, 10 aa, Influenza virus
TPRNDDSSSS

SEQ ID NO: 514890 - protein, 10 aa, Influenza virus
TPRNEDGSSS

SEQ ID NO: 514891 - protein, 10 aa, Influenza virus
TPRNEDSSSN

SEQ ID NO: 514892 - protein, 10 aa, Influenza virus
TPRNEDSSSS

SEQ ID NO: 514893 - protein, 10 aa, Influenza virus
TPSAIDQITG

SEQ ID NO: 514894 - protein, 10 aa, Influenza virus
TPSIDPKGLF

SEQ ID NO: 514895 - protein, 10 aa, Influenza virus
TPSIEPKGLF

SEQ ID NO: 514896 - protein, 10 aa, Influenza virus
TPSIEPRGLF

SEQ ID NO: 514897 - protein, 10 aa, Influenza virus
TPSVEPKGLF

SEQ ID NO: 514898 - protein, 10 aa, Influenza virus
TPSVEPRGLF

SEQ ID NO: 514899 - protein, 10 aa, Influenza virus
TPTKSYFANL

SEQ ID NO: 514900 - protein, 10 aa, Influenza virus
TPVCDPHLTG

SEQ ID NO: 514901 - protein, 10 aa, Influenza virus
TPYRSLIKFP

SEQ ID NO: 514902 - protein, 10 aa, Influenza virus
TPYRSLIQFP

SEQ ID NO: 514903 - protein, 10 aa, Influenza virus
TPYRSLIRFP

SEQ ID NO: 514904 - protein, 10 aa, Influenza virus
TPYRTLLMNE

SEQ ID NO: 514905 - protein, 10 aa, Influenza virus
TQAAIDQING

SEQ ID NO: 514906 - protein, 10 aa, Influenza virus
TQAAIDQITG

SEQ ID NO: 514907 - protein, 10 aa, Influenza virus
TQAAIDQVNG

SEQ ID NO: 514908 - protein, 10 aa, Influenza virus
TQAAINQING

SEQ ID NO: 514909 - protein, 10 aa, Influenza virus
TQAAVDQITG

SEQ ID NO: 514910 - protein, 10 aa, Influenza virus
TQAMELVEAE

SEQ ID NO: 514911 - protein, 10 aa, Influenza virus
TQATIDQITG

SEQ ID NO: 514912 - protein, 10 aa, Influenza virus
TQCQITGFAP

SEQ ID NO: 514913 - protein, 10 aa, Influenza virus
TQCQTPLGAI

SEQ ID NO: 514914 - protein, 10 aa, Influenza virus
TQDAMTEVWS

SEQ ID NO: 514915 - protein, 10 aa, Influenza virus
TQDSECVSHN

SEQ ID NO: 514916 - protein, 10 aa, Influenza virus
TQEAIDKITN

SEQ ID NO: 514917 - protein, 10 aa, Influenza virus
TQEAIEKITN

SEQ ID NO: 514918 - protein, 10 aa, Influenza virus
TQEAIGKITN

SEQ ID NO: 514919 - protein, 10 aa, Influenza virus
TQEAINKITN

SEQ ID NO: 514920 - protein, 10 aa, Influenza virus
TQESECACAN

SEQ ID NO: 514921 - protein, 10 aa, Influenza virus
TQESECACIN

SEQ ID NO: 514922 - protein, 10 aa, Influenza virus
TQESECACVN

SEQ ID NO: 514923 - protein, 10 aa, Influenza virus
TQESECICIN

SEQ ID NO: 514924 - protein, 10 aa, Influenza virus
TQESECQCID

SEQ ID NO: 514925 - protein, 10 aa, Influenza virus
TQESECQCIG

SEQ ID NO: 514926 - protein, 10 aa, Influenza virus
TQESECQCIS

SEQ ID NO: 514927 - protein, 10 aa, Influenza virus
TQESECQCLY

SEQ ID NO: 514928 - protein, 10 aa, Influenza virus
TQESECQRID

SEQ ID NO: 514929 - protein, 10 aa, Influenza virus
TQESECVCHD

SEQ ID NO: 514930 - protein, 10 aa, Influenza virus
TQESECVCHK

SEQ ID NO: 514931 - protein, 10 aa, Influenza virus
TQESECVCHN

SEQ ID NO: 514932 - protein, 10 aa, Influenza virus
TQESECVCHS

SEQ ID NO: 514933 - protein, 10 aa, Influenza virus
TQESECVCID

SEQ ID NO: 514934 - protein, 10 aa, Influenza virus
TQESECVCIN

SEQ ID NO: 514935 - protein, 10 aa, Influenza virus
TQESECVCIS

SEQ ID NO: 514936 - protein, 10 aa, Influenza virus
TQESECVCMN

SEQ ID NO: 514937 - protein, 10 aa, Influenza virus
TQESECVCQD

SEQ ID NO: 514938 - protein, 10 aa, Influenza virus
TQESECVCQN

SEQ ID NO: 514939 - protein, 10 aa, Influenza virus
TQESECVCVN

SEQ ID NO: 514940 - protein, 10 aa, Influenza virus
TQESECVRHN

SEQ ID NO: 514941 - protein, 10 aa, Influenza virus
TQESSCTCIK

SEQ ID NO: 514942 - protein, 10 aa, Influenza virus
TQESSCTCIL

SEQ ID NO: 514943 - protein, 10 aa, Influenza virus
TQESSCTCIQ

SEQ ID NO: 514944 - protein, 10 aa, Influenza virus
TQESSCTCIR

SEQ ID NO: 514945 - protein, 10 aa, Influenza virus
TQESSCVCIK

SEQ ID NO: 514946 - protein, 10 aa, Influenza virus
TQESSCVCMK

SEQ ID NO: 514947 - protein, 10 aa, Influenza virus
TQESSCVCMN

SEQ ID NO: 514948 - protein, 10 aa, Influenza virus
TQESSCVCVK

SEQ ID NO: 514949 - protein, 10 aa, Influenza virus
TQFEAIGREF

SEQ ID NO: 514950 - protein, 10 aa, Influenza virus
TQFEAVGKEF

SEQ ID NO: 514951 - protein, 10 aa, Influenza virus
TQFEAVGREF

SEQ ID NO: 514952 - protein, 10 aa, Influenza virus
TQFELIDNEF

SEQ ID NO: 514953 - protein, 10 aa, Influenza virus
TQFTAVGKEF

SEQ ID NO: 514954 - protein, 10 aa, Influenza virus
TQFTSVGKEF

SEQ ID NO: 514955 - protein, 10 aa, Influenza virus
TQFTVVGKEF

SEQ ID NO: 514956 - protein, 10 aa, Influenza virus
TQGACWEQLY

SEQ ID NO: 514957 - protein, 10 aa, Influenza virus
TQGALLNDKH

SEQ ID NO: 514958 - protein, 10 aa, Influenza virus
TQGALLNDRH

SEQ ID NO: 514959 - protein, 10 aa, Influenza virus
TQGEGTAADY

SEQ ID NO: 514960 - protein, 10 aa, Influenza virus
TQGRQTFDWT

SEQ ID NO: 514961 - protein, 10 aa, Influenza virus
TQGRQTYDWT

SEQ ID NO: 514962 - protein, 10 aa, Influenza virus
TQGSLLNDKH

SEQ ID NO: 514963 - protein, 10 aa, Influenza virus
TQGSLLNDRH

SEQ ID NO: 514964 - protein, 10 aa, Influenza virus
TQGTCWEQLY

SEQ ID NO: 514965 - protein, 10 aa, Influenza virus
TQGTCWEQMY

SEQ ID NO: 514966 - protein, 10 aa, Influenza virus
TQGVKGWAFD

SEQ ID NO: 514967 - protein, 10 aa, Influenza virus
TQGYKDIILW

SEQ ID NO: 514968 - protein, 10 aa, Influenza virus
TQGYKDVILW

SEQ ID NO: 514969 - protein, 10 aa, Influenza virus
TQIIKLLPFA

SEQ ID NO: 514970 - protein, 10 aa, Influenza virus
TQIIVILVLG

SEQ ID NO: 514971 - protein, 10 aa, Influenza virus
TQKAIDEITT

SEQ ID NO: 514972 - protein, 10 aa, Influenza virus
TQKAIDGITN

SEQ ID NO: 514973 - protein, 10 aa, Influenza virus
TQKAIDGVTN

SEQ ID NO: 514974 - protein, 10 aa, Influenza virus
TQKAIDIMQN

SEQ ID NO: 514975 - protein, 10 aa, Influenza virus
TQKAIDNMQN

SEQ ID NO: 514976 - protein, 10 aa, Influenza virus
TQKAIDQITT

SEQ ID NO: 514977 - protein, 10 aa, Influenza virus
TQKAIDRITT

SEQ ID NO: 514978 - protein, 10 aa, Influenza virus
TQKAINEITT

SEQ ID NO: 514979 - protein, 10 aa, Influenza virus
TQKAINGVTN

SEQ ID NO: 514980 - protein, 10 aa, Influenza virus
TQKALNEITT

SEQ ID NO: 514981 - protein, 10 aa, Influenza virus
TQKTIDQVTG

SEQ ID NO: 514982 - protein, 10 aa, Influenza virus
TQMAIDNMQN

SEQ ID NO: 514983 - protein, 10 aa, Influenza virus
TQNNTTLIEN

SEQ ID NO: 514984 - protein, 10 aa, Influenza virus
TQNNTTVVEN

SEQ ID NO: 514985 - protein, 10 aa, Influenza virus
TQPLSISVGS

SEQ ID NO: 514986 - protein, 10 aa, Influenza virus
TQPTFSVQRN

SEQ ID NO: 514987 - protein, 10 aa, Influenza virus
TQQVCIAWSS

SEQ ID NO: 514988 - protein, 10 aa, Influenza virus
TQRAIDGVTN

SEQ ID NO: 514989 - protein, 10 aa, Influenza virus
TQRAIDNMQN

SEQ ID NO: 514990 - protein, 10 aa, Influenza virus
TQRTIGKKKH

SEQ ID NO: 514991 - protein, 10 aa, Influenza virus
TQRTIGKKKQ

SEQ ID NO: 514992 - protein, 10 aa, Influenza virus
TQRTIGKRKQ

SEQ ID NO: 514993 - protein, 10 aa, Influenza virus
TQRTMGKKKQ

SEQ ID NO: 514994 - protein, 10 aa, Influenza virus
TQRTVGKKKQ

SEQ ID NO: 514995 - protein, 10 aa, Influenza virus
TQSAIDQITG

SEQ ID NO: 514996 - protein, 10 aa, Influenza virus
TQSAIDQITR

SEQ ID NO: 514997 - protein, 10 aa, Influenza virus
TQSAIDQVTG

SEQ ID NO: 514998 - protein, 10 aa, Influenza virus
TQSAINQITG

SEQ ID NO: 514999 - protein, 10 aa, Influenza virus
TQSAVDQITG

SEQ ID NO: 515000 - protein, 10 aa, Influenza virus
TQSAVNQITG

SEQ ID NO: 515001 - protein, 10 aa, Influenza virus
TQSLSISIGS

SEQ ID NO: 515002 - protein, 10 aa, Influenza virus
TQSLSISVES

SEQ ID NO: 515003 - protein, 10 aa, Influenza virus
TQSLSISVGS

SEQ ID NO: 515004 - protein, 10 aa, Influenza virus
TQTAIDQING

SEQ ID NO: 515005 - protein, 10 aa, Influenza virus
TQTAIDQITG

SEQ ID NO: 515006 - protein, 10 aa, Influenza virus
TQTLVANNDW

SEQ ID NO: 515007 - protein, 10 aa, Influenza virus
TQTLVSNDDW

SEQ ID NO: 515008 - protein, 10 aa, Influenza virus
TQTLVSNNDW

SEQ ID NO: 515009 - protein, 10 aa, Influenza virus
TQTLVSNSDW

SEQ ID NO: 515010 - protein, 10 aa, Influenza virus
TQTMELVEAE

SEQ ID NO: 515011 - protein, 10 aa, Influenza virus
TQTMELVETE

SEQ ID NO: 515012 - protein, 10 aa, Influenza virus
TQTMELVETK

SEQ ID NO: 515013 - protein, 10 aa, Influenza virus
TQTRGIFGAI

SEQ ID NO: 515014 - protein, 10 aa, Influenza virus
TQVEELVHGG

SEQ ID NO: 515015 - protein, 10 aa, Influenza virus
TQVEELVHGQ

SEQ ID NO: 515016 - protein, 10 aa, Influenza virus
TQVEELVHRG

SEQ ID NO: 515017 - protein, 10 aa, Influenza virus
TQYREEALLN

SEQ ID NO: 515018 - protein, 10 aa, Influenza virus
TRALVRSGMD

SEQ ID NO: 515019 - protein, 10 aa, Influenza virus
TRALVRTGMD

SEQ ID NO: 515020 - protein, 10 aa, Influenza virus
TRCQTPLGAI

SEQ ID NO: 515021 - protein, 10 aa, Influenza virus
TRCQTSVGGI

SEQ ID NO: 515022 - protein, 10 aa, Influenza virus
TRDAMTEIWS

SEQ ID NO: 515023 - protein, 10 aa, Influenza virus
TRDAMTEVWS

SEQ ID NO: 515024 - protein, 10 aa, Influenza virus
TRDSITEVWS

SEQ ID NO: 515025 - protein, 10 aa, Influenza virus
TRDSLTEIWS

SEQ ID NO: 515026 - protein, 10 aa, Influenza virus
TRDSMTEIWS

SEQ ID NO: 515027 - protein, 10 aa, Influenza virus
TRDSMTEVMV

SEQ ID NO: 515028 - protein, 10 aa, Influenza virus
TRDSMTEVWS

SEQ ID NO: 515029 - protein, 10 aa, Influenza virus
TRDSVTELWS

SEQ ID NO: 515030 - protein, 10 aa, Influenza virus
TREGKHIVER

SEQ ID NO: 515031 - protein, 10 aa, Influenza virus
TREGRRKTNL

SEQ ID NO: 515032 - protein, 10 aa, Influenza virus
TREILTKITV

SEQ ID NO: 515033 - protein, 10 aa, Influenza virus
TREILTKTTV

SEQ ID NO: 515034 - protein, 10 aa, Influenza virus
TREILTRTTV

SEQ ID NO: 515035 - protein, 10 aa, Influenza virus
TRELCTINSW

SEQ ID NO: 515036 - protein, 10 aa, Influenza virus
TREPFISCSH

SEQ ID NO: 515037 - protein, 10 aa, Influenza virus
TREPYISCDN

SEQ ID NO: 515038 - protein, 10 aa, Influenza virus
TREPYLSCDP

SEQ ID NO: 515039 - protein, 10 aa, Influenza virus
TREPYLSCGP

SEQ ID NO: 515040 - protein, 10 aa, Influenza virus
TREPYVSCDN

SEQ ID NO: 515041 - protein, 10 aa, Influenza virus
TREPYVSCDP

SEQ ID NO: 515042 - protein, 10 aa, Influenza virus
TREPYVSCDS

SEQ ID NO: 515043 - protein, 10 aa, Influenza virus
TREPYVSCDT

SEQ ID NO: 515044 - protein, 10 aa, Influenza virus
TREPYVSCDY

SEQ ID NO: 515045 - protein, 10 aa, Influenza virus
TREPYVSCEP

SEQ ID NO: 515046 - protein, 10 aa, Influenza virus
TREPYVSCGP

SEQ ID NO: 515047 - protein, 10 aa, Influenza virus
TREPYVSCSL

SEQ ID NO: 515048 - protein, 10 aa, Influenza virus
TREPYVSCSP

SEQ ID NO: 515049 - protein, 10 aa, Influenza virus
TREWSYLIED

SEQ ID NO: 515050 - protein, 10 aa, Influenza virus
TRFLPVAGGT

SEQ ID NO: 515051 - protein, 10 aa, Influenza virus
TRFLPVSGGT

SEQ ID NO: 515052 - protein, 10 aa, Influenza virus
TRFLPVTGGT

SEQ ID NO: 515053 - protein, 10 aa, Influenza virus
TRGAYERMCN

SEQ ID NO: 515054 - protein, 10 aa, Influenza virus
TRGIFGAIAG

SEQ ID NO: 515055 - protein, 10 aa, Influenza virus
TRGILTKTTV

SEQ ID NO: 515056 - protein, 10 aa, Influenza virus
TRGIQIASNE

SEQ ID NO: 515057 - protein, 10 aa, Influenza virus
TRGLCKINSW

SEQ ID NO: 515058 - protein, 10 aa, Influenza virus
TRGLCTINSW

SEQ ID NO: 515059 - protein, 10 aa, Influenza virus
TRGLFGAIAG

SEQ ID NO: 515060 - protein, 10 aa, Influenza virus
TRGVQIASNE

SEQ ID NO: 515061 - protein, 10 aa, Influenza virus
TRGVQVASNE

SEQ ID NO: 515062 - protein, 10 aa, Influenza virus
TRIAYERMCN

SEQ ID NO: 515063 - protein, 10 aa, Influenza virus
TRIGDGQRSW

SEQ ID NO: 515064 - protein, 10 aa, Influenza virus
TRILFIEEGK

SEQ ID NO: 515065 - protein, 10 aa, Influenza virus
TRILFIKEGK

SEQ ID NO: 515066 - protein, 10 aa, Influenza virus
TRILFIREGK

SEQ ID NO: 515067 - protein, 10 aa, Influenza virus
TRILFVKEGK

SEQ ID NO: 515068 - protein, 10 aa, Influenza virus
TRINMINSKI

SEQ ID NO: 515069 - protein, 10 aa, Influenza virus
TRKEPALIVW

SEQ ID NO: 515070 - protein, 10 aa, Influenza virus
TRKQLRENAE

SEQ ID NO: 515071 - protein, 10 aa, Influenza virus
TRLFTIRQEL

SEQ ID NO: 515072 - protein, 10 aa, Influenza virus
TRLFTIRQEM

SEQ ID NO: 515073 - protein, 10 aa, Influenza virus
TRLPFQNLSP

SEQ ID NO: 515074 - protein, 10 aa, Influenza virus
TRLYIWGVHH

SEQ ID NO: 515075 - protein, 10 aa, Influenza virus
TRLYVNKNPY

SEQ ID NO: 515076 - protein, 10 aa, Influenza virus
TRPGYNGQKS

SEQ ID NO: 515077 - protein, 10 aa, Influenza virus
TRPILSPLTK

SEQ ID NO: 515078 - protein, 10 aa, Influenza virus
TRQASPSCLV

SEQ ID NO: 515079 - protein, 10 aa, Influenza virus
TRQVCIAWSS

SEQ ID NO: 515080 - protein, 10 aa, Influenza virus
TRQVCMAWSS

SEQ ID NO: 515081 - protein, 10 aa, Influenza virus
TRQVCVAWSS

SEQ ID NO: 515082 - protein, 10 aa, Influenza virus
TRREIHIYYL

SEQ ID NO: 515083 - protein, 10 aa, Influenza virus
TRREVHIYYL

SEQ ID NO: 515084 - protein, 10 aa, Influenza virus
TRREVHMYYL

SEQ ID NO: 515085 - protein, 10 aa, Influenza virus
TRREVHTYYL

SEQ ID NO: 515086 - protein, 10 aa, Influenza virus
TRREVHVYYL

SEQ ID NO: 515087 - protein, 10 aa, Influenza virus
TRRIDFHWLL

SEQ ID NO: 515088 - protein, 10 aa, Influenza virus
TRRQKRGLFG

SEQ ID NO: 515089 - protein, 10 aa, Influenza virus
TRRQLRENAE

SEQ ID NO: 515090 - protein, 10 aa, Influenza virus
TRSAYERMCN

SEQ ID NO: 515091 - protein, 10 aa, Influenza virus
TRSDQISIVP

SEQ ID NO: 515092 - protein, 10 aa, Influenza virus
TRSGQNHGIC

SEQ ID NO: 515093 - protein, 10 aa, Influenza virus
TRSGTSKACN

SEQ ID NO: 515094 - protein, 10 aa, Influenza virus
TRSGYEMLKV

SEQ ID NO: 515095 - protein, 10 aa, Influenza virus
TRTAYERMCN

SEQ ID NO: 515096 - protein, 10 aa, Influenza virus
TRTTVDHMAI

SEQ ID NO: 515097 - protein, 10 aa, Influenza virus
TRVAYERMCN

SEQ ID NO: 515098 - protein, 10 aa, Influenza virus
TRVDKLTQGR

SEQ ID NO: 515099 - protein, 10 aa, Influenza virus
TRVDRLTQGR

SEQ ID NO: 515100 - protein, 10 aa, Influenza virus
TRVKRQLREN

SEQ ID NO: 515101 - protein, 10 aa, Influenza virus
TRVWWTSNSI

SEQ ID NO: 515102 - protein, 10 aa, Influenza virus
TRWMKIIRVG

SEQ ID NO: 515103 - protein, 10 aa, Influenza virus
TRYVCSKFHS

SEQ ID NO: 515104 - protein, 10 aa, Influenza virus
TSACKRTVSS

SEQ ID NO: 515105 - protein, 10 aa, Influenza virus
TSARQEKNPA

SEQ ID NO: 515106 - protein, 10 aa, Influenza virus
TSCFDGKEWM

SEQ ID NO: 515107 - protein, 10 aa, Influenza virus
TSCHDGIGRM

SEQ ID NO: 515108 - protein, 10 aa, Influenza virus
TSCHDGISRM

SEQ ID NO: 515109 - protein, 10 aa, Influenza virus
TSCHDGKARM

SEQ ID NO: 515110 - protein, 10 aa, Influenza virus
TSCHDGKFRM

SEQ ID NO: 515111 - protein, 10 aa, Influenza virus
TSCHDGKSRM

SEQ ID NO: 515112 - protein, 10 aa, Influenza virus
TSCHDGKTRM

SEQ ID NO: 515113 - protein, 10 aa, Influenza virus
TSCHDGMSRM

SEQ ID NO: 515114 - protein, 10 aa, Influenza virus
TSCHDGRARM

SEQ ID NO: 515115 - protein, 10 aa, Influenza virus
TSCHDGRSRM

SEQ ID NO: 515116 - protein, 10 aa, Influenza virus
TSCHDGVGRM

SEQ ID NO: 515117 - protein, 10 aa, Influenza virus
TSCHDGVSRM

SEQ ID NO: 515118 - protein, 10 aa, Influenza virus
TSFFYRYGFV

SEQ ID NO: 515119 - protein, 10 aa, Influenza virus
TSFQVDCYLW

SEQ ID NO: 515120 - protein, 10 aa, Influenza virus
TSGEQMLIIW

SEQ ID NO: 515121 - protein, 10 aa, Influenza virus
TSGEQMLVIW

SEQ ID NO: 515122 - protein, 10 aa, Influenza virus
TSGKQMLIIW

SEQ ID NO: 515123 - protein, 10 aa, Influenza virus
TSGNLIAPEY

SEQ ID NO: 515124 - protein, 10 aa, Influenza virus
TSGRQEKNPA

SEQ ID NO: 515125 - protein, 10 aa, Influenza virus
TSGRQEKNPS

SEQ ID NO: 515126 - protein, 10 aa, Influenza virus
TSGSIISFCG

SEQ ID NO: 515127 - protein, 10 aa, Influenza virus
TSGSSIAFCG

SEQ ID NO: 515128 - protein, 10 aa, Influenza virus
TSGSSISFCG

SEQ ID NO: 515129 - protein, 10 aa, Influenza virus
TSGTYGAGSW

SEQ ID NO: 515130 - protein, 10 aa, Influenza virus
TSGTYGSGSW

SEQ ID NO: 515131 - protein, 10 aa, Influenza virus
TSGTYGTGSW

SEQ ID NO: 515132 - protein, 10 aa, Influenza virus
TSGTYGTGTW

SEQ ID NO: 515133 - protein, 10 aa, Influenza virus
TSHRTLLMNE

SEQ ID NO: 515134 - protein, 10 aa, Influenza virus
TSHTGTYCSL

SEQ ID NO: 515135 - protein, 10 aa, Influenza virus
TSIRNNTYDH

SEQ ID NO: 515136 - protein, 10 aa, Influenza virus
TSISCLYKLS

SEQ ID NO: 515137 - protein, 10 aa, Influenza virus
TSIVVFCGTS

SEQ ID NO: 515138 - protein, 10 aa, Influenza virus
TSIWTSSSSM

SEQ ID NO: 515139 - protein, 10 aa, Influenza virus
TSIWTSSSST

SEQ ID NO: 515140 - protein, 10 aa, Influenza virus
TSKACNALTG

SEQ ID NO: 515141 - protein, 10 aa, Influenza virus
TSKACNASTG

SEQ ID NO: 515142 - protein, 10 aa, Influenza virus
TSKACSASTG

SEQ ID NO: 515143 - protein, 10 aa, Influenza virus
TSKDSRSGYE

SEQ ID NO: 515144 - protein, 10 aa, Influenza virus
TSKHYIGKCP

SEQ ID NO: 515145 - protein, 10 aa, Influenza virus
TSKIKMKWGM

SEQ ID NO: 515146 - protein, 10 aa, Influenza virus
TSKPFQNICK

SEQ ID NO: 515147 - protein, 10 aa, Influenza virus
TSKPFQNTSK

SEQ ID NO: 515148 - protein, 10 aa, Influenza virus
TSKPFQNTSR

SEQ ID NO: 515149 - protein, 10 aa, Influenza virus
TSKPLQNTSK

SEQ ID NO: 515150 - protein, 10 aa, Influenza virus
TSKVKMKWGM

SEQ ID NO: 515151 - protein, 10 aa, Influenza virus
TSLCSIWFSH

SEQ ID NO: 515152 - protein, 10 aa, Influenza virus
TSLLLATGMR

SEQ ID NO: 515153 - protein, 10 aa, Influenza virus
TSLTSLPFQN

SEQ ID NO: 515154 - protein, 10 aa, Influenza virus
TSNLPFQNVN

SEQ ID NO: 515155 - protein, 10 aa, Influenza virus
TSNQDSFYRS

SEQ ID NO: 515156 - protein, 10 aa, Influenza virus
TSNQGSFYRS

SEQ ID NO: 515157 - protein, 10 aa, Influenza virus
TSNRGSFYRS

SEQ ID NO: 515158 - protein, 10 aa, Influenza virus
TSNSIAVFCG

SEQ ID NO: 515159 - protein, 10 aa, Influenza virus
TSNSIIAFCG

SEQ ID NO: 515160 - protein, 10 aa, Influenza virus
TSNSIIVFCG

SEQ ID NO: 515161 - protein, 10 aa, Influenza virus
TSNSIIVLCG

SEQ ID NO: 515162 - protein, 10 aa, Influenza virus
TSNSIVAFCG

SEQ ID NO: 515163 - protein, 10 aa, Influenza virus
TSNSIVALCG

SEQ ID NO: 515164 - protein, 10 aa, Influenza virus
TSNSIVSMCS

SEQ ID NO: 515165 - protein, 10 aa, Influenza virus
TSNSIVTFCG

SEQ ID NO: 515166 - protein, 10 aa, Influenza virus
TSNSIVVFCG

SEQ ID NO: 515167 - protein, 10 aa, Influenza virus
TSNSLIALCG

SEQ ID NO: 515168 - protein, 10 aa, Influenza virus
TSNSLVALCG

SEQ ID NO: 515169 - protein, 10 aa, Influenza virus
TSNSMVTFCG

SEQ ID NO: 515170 - protein, 10 aa, Influenza virus
TSNSVVVFCG

SEQ ID NO: 515171 - protein, 10 aa, Influenza virus
TSPCLTDKGS

SEQ ID NO: 515172 - protein, 10 aa, Influenza virus
TSPLPFQNIN

SEQ ID NO: 515173 - protein, 10 aa, Influenza virus
TSQRGILEDE

SEQ ID NO: 515174 - protein, 10 aa, Influenza virus
TSQRGVLEDE

SEQ ID NO: 515175 - protein, 10 aa, Influenza virus
TSQYICSPVL

SEQ ID NO: 515176 - protein, 10 aa, Influenza virus
TSQYLCTGIL

SEQ ID NO: 515177 - protein, 10 aa, Influenza virus
TSQYLCTGVL

SEQ ID NO: 515178 - protein, 10 aa, Influenza virus
TSRHYIGKCP

SEQ ID NO: 515179 - protein, 10 aa, Influenza virus
TSRHYMGECP

SEQ ID NO: 515180 - protein, 10 aa, Influenza virus
TSRYVCTGIL

SEQ ID NO: 515181 - protein, 10 aa, Influenza virus
TSSGTSKACN

SEQ ID NO: 515182 - protein, 10 aa, Influenza virus
TSSGTSKACS

SEQ ID NO: 515183 - protein, 10 aa, Influenza virus
TSSIDLVETN

SEQ ID NO: 515184 - protein, 10 aa, Influenza virus
TSSIYIEVLH

SEQ ID NO: 515185 - protein, 10 aa, Influenza virus
TSSSIVVFCG

SEQ ID NO: 515186 - protein, 10 aa, Influenza virus
TSSSSIVMCG

SEQ ID NO: 515187 - protein, 10 aa, Influenza virus
TSSSSTVFCG

SEQ ID NO: 515188 - protein, 10 aa, Influenza virus
TSSSSVVMCG

SEQ ID NO: 515189 - protein, 10 aa, Influenza virus
TSSVDLVETN

SEQ ID NO: 515190 - protein, 10 aa, Influenza virus
TSSVYIEVLH

SEQ ID NO: 515191 - protein, 10 aa, Influenza virus
TSSVYVEVLH

SEQ ID NO: 515192 - protein, 10 aa, Influenza virus
TSTASRSGYE

SEQ ID NO: 515193 - protein, 10 aa, Influenza virus
TSTQKAINEI

SEQ ID NO: 515194 - protein, 10 aa, Influenza virus
TSVGGIDTNK

SEQ ID NO: 515195 - protein, 10 aa, Influenza virus
TSVGGINTNK

SEQ ID NO: 515196 - protein, 10 aa, Influenza virus
TSVGGINTNR

SEQ ID NO: 515197 - protein, 10 aa, Influenza virus
TSVKTLTDNH

SEQ ID NO: 515198 - protein, 10 aa, Influenza virus
TSVTTNTINR

SEQ ID NO: 515199 - protein, 10 aa, Influenza virus
TSWSWPDGAL

SEQ ID NO: 515200 - protein, 10 aa, Influenza virus
TSWSYIVEKL

SEQ ID NO: 515201 - protein, 10 aa, Influenza virus
TSWSYIVEKP

SEQ ID NO: 515202 - protein, 10 aa, Influenza virus
TSWSYIVEKS

SEQ ID NO: 515203 - protein, 10 aa, Influenza virus
TSWSYIVERP

SEQ ID NO: 515204 - protein, 10 aa, Influenza virus
TSYKILSIYS

SEQ ID NO: 515205 - protein, 10 aa, Influenza virus
TSYRSLIRFP

SEQ ID NO: 515206 - protein, 10 aa, Influenza virus
TSYWWDGLQS

SEQ ID NO: 515207 - protein, 10 aa, Influenza virus
TTAKAMEQMA

SEQ ID NO: 515208 - protein, 10 aa, Influenza virus
TTAKAMEQVA

SEQ ID NO: 515209 - protein, 10 aa, Influenza virus
TTASCQNRGA

SEQ ID NO: 515210 - protein, 10 aa, Influenza virus
TTAVAVLKYN

SEQ ID NO: 515211 - protein, 10 aa, Influenza virus
TTCHDGIGRM

SEQ ID NO: 515212 - protein, 10 aa, Influenza virus
TTDWSGYSGS

SEQ ID NO: 515213 - protein, 10 aa, Influenza virus
TTEINTWARN

SEQ ID NO: 515214 - protein, 10 aa, Influenza virus
TTEIYNETVR

SEQ ID NO: 515215 - protein, 10 aa, Influenza virus
TTEMYNETVR

SEQ ID NO: 515216 - protein, 10 aa, Influenza virus
TTEVSHCRAT

SEQ ID NO: 515217 - protein, 10 aa, Influenza virus
TTEVYNETVR

SEQ ID NO: 515218 - protein, 10 aa, Influenza virus
TTEVYSETVR

SEQ ID NO: 515219 - protein, 10 aa, Influenza virus
TTFPYTGDPP

SEQ ID NO: 515220 - protein, 10 aa, Influenza virus
TTGKSHGRIL

SEQ ID NO: 515221 - protein, 10 aa, Influenza virus
TTGNPIICLG

SEQ ID NO: 515222 - protein, 10 aa, Influenza virus
TTGRDVLVIW

SEQ ID NO: 515223 - protein, 10 aa, Influenza virus
TTGRDVLVLW

SEQ ID NO: 515224 - protein, 10 aa, Influenza virus
TTGRDVLVMW

SEQ ID NO: 515225 - protein, 10 aa, Influenza virus
TTGRNCTIPC

SEQ ID NO: 515226 - protein, 10 aa, Influenza virus
TTGRNCTVPC

SEQ ID NO: 515227 - protein, 10 aa, Influenza virus
TTGWPWPDGA

SEQ ID NO: 515228 - protein, 10 aa, Influenza virus
TTGWSWPDGA

SEQ ID NO: 515229 - protein, 10 aa, Influenza virus
TTHDRTAFRG

SEQ ID NO: 515230 - protein, 10 aa, Influenza virus
TTHFHRKRRV

SEQ ID NO: 515231 - protein, 10 aa, Influenza virus
TTHFQRKRRI

SEQ ID NO: 515232 - protein, 10 aa, Influenza virus
TTHFQRKRRV

SEQ ID NO: 515233 - protein, 10 aa, Influenza virus
TTHSWIPKRN

SEQ ID NO: 515234 - protein, 10 aa, Influenza virus
TTHSWTPKRN

SEQ ID NO: 515235 - protein, 10 aa, Influenza virus
TTHSWVPILN

SEQ ID NO: 515236 - protein, 10 aa, Influenza virus
TTHSWVPKRN

SEQ ID NO: 515237 - protein, 10 aa, Influenza virus
TTHTGTYCSL

SEQ ID NO: 515238 - protein, 10 aa, Influenza virus
TTIGLLLQII

SEQ ID NO: 515239 - protein, 10 aa, Influenza virus
TTIGLLLQIT

SEQ ID NO: 515240 - protein, 10 aa, Influenza virus
TTIGPLLQIT

SEQ ID NO: 515241 - protein, 10 aa, Influenza virus
TTIKPWARNI

SEQ ID NO: 515242 - protein, 10 aa, Influenza virus
TTIKTWAGKI

SEQ ID NO: 515243 - protein, 10 aa, Influenza virus
TTIKTWAGNI

SEQ ID NO: 515244 - protein, 10 aa, Influenza virus
TTIKTWAKNI

SEQ ID NO: 515245 - protein, 10 aa, Influenza virus
TTIKTWARNI

SEQ ID NO: 515246 - protein, 10 aa, Influenza virus
TTINNITNVV

SEQ ID NO: 515247 - protein, 10 aa, Influenza virus
TTIRGKHSNG

SEQ ID NO: 515248 - protein, 10 aa, Influenza virus
TTIRGRHSNG

SEQ ID NO: 515249 - protein, 10 aa, Influenza virus
TTIRNKHSNG

SEQ ID NO: 515250 - protein, 10 aa, Influenza virus
TTIRNKHSNS

SEQ ID NO: 515251 - protein, 10 aa, Influenza virus
TTIRNRHSNG

SEQ ID NO: 515252 - protein, 10 aa, Influenza virus
TTIRTWAKNI

SEQ ID NO: 515253 - protein, 10 aa, Influenza virus
TTITLHFKQN

SEQ ID NO: 515254 - protein, 10 aa, Influenza virus
TTIWTSGSSI

SEQ ID NO: 515255 - protein, 10 aa, Influenza virus
TTKINNIIDK

SEQ ID NO: 515256 - protein, 10 aa, Influenza virus
TTKINNIIEK

SEQ ID NO: 515257 - protein, 10 aa, Influenza virus
TTKPRPRRGL

SEQ ID NO: 515258 - protein, 10 aa, Influenza virus
TTLDNEHSNG

SEQ ID NO: 515259 - protein, 10 aa, Influenza virus
TTLDNKHSND

SEQ ID NO: 515260 - protein, 10 aa, Influenza virus
TTLDNKHSNG

SEQ ID NO: 515261 - protein, 10 aa, Influenza virus
TTLENKHSNG

SEQ ID NO: 515262 - protein, 10 aa, Influenza virus
TTLIENTYVN

SEQ ID NO: 515263 - protein, 10 aa, Influenza virus
TTLKGRHANG

SEQ ID NO: 515264 - protein, 10 aa, Influenza virus
TTLNNKHSNG

SEQ ID NO: 515265 - protein, 10 aa, Influenza virus
TTLPFHNIHP

SEQ ID NO: 515266 - protein, 10 aa, Influenza virus
TTLPFHNVHP

SEQ ID NO: 515267 - protein, 10 aa, Influenza virus
TTLRGQHANG

SEQ ID NO: 515268 - protein, 10 aa, Influenza virus
TTLRGRHANG

SEQ ID NO: 515269 - protein, 10 aa, Influenza virus
TTLSTIALFI

SEQ ID NO: 515270 - protein, 10 aa, Influenza virus
TTLSTIALII

SEQ ID NO: 515271 - protein, 10 aa, Influenza virus
TTLSTIALLI

SEQ ID NO: 515272 - protein, 10 aa, Influenza virus
TTLYKNANTL

SEQ ID NO: 515273 - protein, 10 aa, Influenza virus
TTLYNKHSNG

SEQ ID NO: 515274 - protein, 10 aa, Influenza virus
TTNPLIKHEN

SEQ ID NO: 515275 - protein, 10 aa, Influenza virus
TTNPLIRHEN

SEQ ID NO: 515276 - protein, 10 aa, Influenza virus
TTNSIVVFCG

SEQ ID NO: 515277 - protein, 10 aa, Influenza virus
TTNTINRIFQ

SEQ ID NO: 515278 - protein, 10 aa, Influenza virus
TTNTINRNFQ

SEQ ID NO: 515279 - protein, 10 aa, Influenza virus
TTNTINRSFQ

SEQ ID NO: 515280 - protein, 10 aa, Influenza virus
TTNTINRSFR

SEQ ID NO: 515281 - protein, 10 aa, Influenza virus
TTNTYRNTDP

SEQ ID NO: 515282 - protein, 10 aa, Influenza virus
TTNTYRNTDS

SEQ ID NO: 515283 - protein, 10 aa, Influenza virus
TTNTYRNTDT

SEQ ID NO: 515284 - protein, 10 aa, Influenza virus
TTNYYNETFV

SEQ ID NO: 515285 - protein, 10 aa, Influenza virus
TTPTKSYFAN

SEQ ID NO: 515286 - protein, 10 aa, Influenza virus
TTQIIKLLPF

SEQ ID NO: 515287 - protein, 10 aa, Influenza virus
TTRGVQIASN

SEQ ID NO: 515288 - protein, 10 aa, Influenza virus
TTRQASPSCL

SEQ ID NO: 515289 - protein, 10 aa, Influenza virus
TTSKDSRSGY

SEQ ID NO: 515290 - protein, 10 aa, Influenza virus
TTSTASRSGY

SEQ ID NO: 515291 - protein, 10 aa, Influenza virus
TTSWSWPDGA

SEQ ID NO: 515292 - protein, 10 aa, Influenza virus
TTTIKPWARN

SEQ ID NO: 515293 - protein, 10 aa, Influenza virus
TTTIKTWAGK

SEQ ID NO: 515294 - protein, 10 aa, Influenza virus
TTTIKTWAGN

SEQ ID NO: 515295 - protein, 10 aa, Influenza virus
TTTIKTWAKN

SEQ ID NO: 515296 - protein, 10 aa, Influenza virus
TTTIKTWARN

SEQ ID NO: 515297 - protein, 10 aa, Influenza virus
TTTIRTWAKN

SEQ ID NO: 515298 - protein, 10 aa, Influenza virus
TTTNPLIRHE

SEQ ID NO: 515299 - protein, 10 aa, Influenza virus
TTTPTKSYFA

SEQ ID NO: 515300 - protein, 10 aa, Influenza virus
TTTTIINNNT

SEQ ID NO: 515301 - protein, 10 aa, Influenza virus
TTTVKTWAGN

SEQ ID NO: 515302 - protein, 10 aa, Influenza virus
TTVDHMAIIK

SEQ ID NO: 515303 - protein, 10 aa, Influenza virus
TTVGLLLQII

SEQ ID NO: 515304 - protein, 10 aa, Influenza virus
TTVGLLLQIT

SEQ ID NO: 515305 - protein, 10 aa, Influenza virus
TTVGWSWPDG

SEQ ID NO: 515306 - protein, 10 aa, Influenza virus
TTVKTWAGNI

SEQ ID NO: 515307 - protein, 10 aa, Influenza virus
TTVNEEALRQ

SEQ ID NO: 515308 - protein, 10 aa, Influenza virus
TTVTLHFKQH

SEQ ID NO: 515309 - protein, 10 aa, Influenza virus
TTVTLHFKQN

SEQ ID NO: 515310 - protein, 10 aa, Influenza virus
TTVVENTYVN

SEQ ID NO: 515311 - protein, 10 aa, Influenza virus
TTVWWTSNSI

SEQ ID NO: 515312 - protein, 10 aa, Influenza virus
TTWDVFIERP

SEQ ID NO: 515313 - protein, 10 aa, Influenza virus
TTYKILSIYS

SEQ ID NO: 515314 - protein, 10 aa, Influenza virus
TTYQRTRALV

SEQ ID NO: 515315 - protein, 10 aa, Influenza virus
TTYRILSIYS

SEQ ID NO: 515316 - protein, 10 aa, Influenza virus
TTYWWDGLQS

SEQ ID NO: 515317 - protein, 10 aa, Influenza virus
TVAASLCLAI

SEQ ID NO: 515318 - protein, 10 aa, Influenza virus
TVAASLCLAV

SEQ ID NO: 515319 - protein, 10 aa, Influenza virus
TVAGSLSLAI

SEQ ID NO: 515320 - protein, 10 aa, Influenza virus
TVASSLALAI

SEQ ID NO: 515321 - protein, 10 aa, Influenza virus
TVASSLTLAI

SEQ ID NO: 515322 - protein, 10 aa, Influenza virus
TVASSLVLAI

SEQ ID NO: 515323 - protein, 10 aa, Influenza virus
TVDHMAIIKK

SEQ ID NO: 515324 - protein, 10 aa, Influenza virus
TVDTILEKNV

SEQ ID NO: 515325 - protein, 10 aa, Influenza virus
TVDTILERNV

SEQ ID NO: 515326 - protein, 10 aa, Influenza virus
TVDTLLEKNV

SEQ ID NO: 515327 - protein, 10 aa, Influenza virus
TVDTLTENGV

SEQ ID NO: 515328 - protein, 10 aa, Influenza virus
TVDTVLEKNV

SEQ ID NO: 515329 - protein, 10 aa, Influenza virus
TVDTVLERNV

SEQ ID NO: 515330 - protein, 10 aa, Influenza virus
TVDTVREKNV

SEQ ID NO: 515331 - protein, 10 aa, Influenza virus
TVEITGIDKV

SEQ ID NO: 515332 - protein, 10 aa, Influenza virus
TVEITGINKV

SEQ ID NO: 515333 - protein, 10 aa, Influenza virus
TVERMVLSAF

SEQ ID NO: 515334 - protein, 10 aa, Influenza virus
TVFCGVSGEV

SEQ ID NO: 515335 - protein, 10 aa, Influenza virus
TVFCGVSSEA

SEQ ID NO: 515336 - protein, 10 aa, Influenza virus
TVFCGVSSEV

SEQ ID NO: 515337 - protein, 10 aa, Influenza virus
TVGKCPRYIK

SEQ ID NO: 515338 - protein, 10 aa, Influenza virus
TVGKCPRYVK

SEQ ID NO: 515339 - protein, 10 aa, Influenza virus
TVGLLLQIIS

SEQ ID NO: 515340 - protein, 10 aa, Influenza virus
TVGLLLQITS

SEQ ID NO: 515341 - protein, 10 aa, Influenza virus
TVGQCPKYVK

SEQ ID NO: 515342 - protein, 10 aa, Influenza virus
TVGQCPKYVN

SEQ ID NO: 515343 - protein, 10 aa, Influenza virus
TVGQCPKYVS

SEQ ID NO: 515344 - protein, 10 aa, Influenza virus
TVGRCPRYVK

SEQ ID NO: 515345 - protein, 10 aa, Influenza virus
TVGSSKYQQS

SEQ ID NO: 515346 - protein, 10 aa, Influenza virus
TVGSSKYRQS

SEQ ID NO: 515347 - protein, 10 aa, Influenza virus
TVGSSNYQQS

SEQ ID NO: 515348 - protein, 10 aa, Influenza virus
TVHDRIPHRT

SEQ ID NO: 515349 - protein, 10 aa, Influenza virus
TVIKNNMINN

SEQ ID NO: 515350 - protein, 10 aa, Influenza virus
TVIKNNMVNN

SEQ ID NO: 515351 - protein, 10 aa, Influenza virus
TVIMIDGSAS

SEQ ID NO: 515352 - protein, 10 aa, Influenza virus
TVIMTDGSAS

SEQ ID NO: 515353 - protein, 10 aa, Influenza virus
TVINNITTTI

SEQ ID NO: 515354 - protein, 10 aa, Influenza virus
TVINNYYNET

SEQ ID NO: 515355 - protein, 10 aa, Influenza virus
TVIRNNMINN

SEQ ID NO: 515356 - protein, 10 aa, Influenza virus
TVKDRSPFRT

SEQ ID NO: 515357 - protein, 10 aa, Influenza virus
TVKDRSPYRA

SEQ ID NO: 515358 - protein, 10 aa, Influenza virus
TVKDRSPYRT

SEQ ID NO: 515359 - protein, 10 aa, Influenza virus
TVKIKTNGNL

SEQ ID NO: 515360 - protein, 10 aa, Influenza virus
TVKIQTNGNL

SEQ ID NO: 515361 - protein, 10 aa, Influenza virus
TVKIQTSGNL

SEQ ID NO: 515362 - protein, 10 aa, Influenza virus
TVKQDGKSSA

SEQ ID NO: 515363 - protein, 10 aa, Influenza virus
TVKQNGKSGA

SEQ ID NO: 515364 - protein, 10 aa, Influenza virus
TVKQNGKSSA

SEQ ID NO: 515365 - protein, 10 aa, Influenza virus
TVKTWAGNIL

SEQ ID NO: 515366 - protein, 10 aa, Influenza virus
TVLEKNVTVT

SEQ ID NO: 515367 - protein, 10 aa, Influenza virus
TVLERNVTVT

SEQ ID NO: 515368 - protein, 10 aa, Influenza virus
TVLGVSILNL

SEQ ID NO: 515369 - protein, 10 aa, Influenza virus
TVLGVSVLNL

SEQ ID NO: 515370 - protein, 10 aa, Influenza virus
TVLKSDKRIG

SEQ ID NO: 515371 - protein, 10 aa, Influenza virus
TVLSIIALLI

SEQ ID NO: 515372 - protein, 10 aa, Influenza virus
TVLVGLILAF

SEQ ID NO: 515373 - protein, 10 aa, Influenza virus
TVMVGLILAF

SEQ ID NO: 515374 - protein, 10 aa, Influenza virus
TVNEEALRQK

SEQ ID NO: 515375 - protein, 10 aa, Influenza virus
TVNEGALRQK

SEQ ID NO: 515376 - protein, 10 aa, Influenza virus
TVNFSFNGAF

SEQ ID NO: 515377 - protein, 10 aa, Influenza virus
TVNRTHQYSE

SEQ ID NO: 515378 - protein, 10 aa, Influenza virus
TVNTLIEQNI

SEQ ID NO: 515379 - protein, 10 aa, Influenza virus
TVNTLIEQNV

SEQ ID NO: 515380 - protein, 10 aa, Influenza virus
TVNTLSEQNV

SEQ ID NO: 515381 - protein, 10 aa, Influenza virus
TVNTLTEQNV

SEQ ID NO: 515382 - protein, 10 aa, Influenza virus
TVNVRGSGLR

SEQ ID NO: 515383 - protein, 10 aa, Influenza virus
TVNVRGSGMR

SEQ ID NO: 515384 - protein, 10 aa, Influenza virus
TVNVRGTGMR

SEQ ID NO: 515385 - protein, 10 aa, Influenza virus
TVPCFWVEMI

SEQ ID NO: 515386 - protein, 10 aa, Influenza virus
TVPSERGLQR

SEQ ID NO: 515387 - protein, 10 aa, Influenza virus
TVQIIKLLPF

SEQ ID NO: 515388 - protein, 10 aa, Influenza virus
TVQVDTIMEK

SEQ ID NO: 515389 - protein, 10 aa, Influenza virus
TVQVIKLLPF

SEQ ID NO: 515390 - protein, 10 aa, Influenza virus
TVSADPLASL

SEQ ID NO: 515391 - protein, 10 aa, Influenza virus
TVSADPLLSL

SEQ ID NO: 515392 - protein, 10 aa, Influenza virus
TVSADPLVSL

SEQ ID NO: 515393 - protein, 10 aa, Influenza virus
TVSIDRFLRV

SEQ ID NO: 515394 - protein, 10 aa, Influenza virus
TVSLSPGMMM

SEQ ID NO: 515395 - protein, 10 aa, Influenza virus
TVSSFERFEI

SEQ ID NO: 515396 - protein, 10 aa, Influenza virus
TVSSFYSEMK

SEQ ID NO: 515397 - protein, 10 aa, Influenza virus
TVSSGLVLVG

SEQ ID NO: 515398 - protein, 10 aa, Influenza virus
TVSSSLVLAG

SEQ ID NO: 515399 - protein, 10 aa, Influenza virus
TVSSSLVLVG

SEQ ID NO: 515400 - protein, 10 aa, Influenza virus
TVSTRSDQIS

SEQ ID NO: 515401 - protein, 10 aa, Influenza virus
TVSVRGSGMR

SEQ ID NO: 515402 - protein, 10 aa, Influenza virus
TVTDGPAANS

SEQ ID NO: 515403 - protein, 10 aa, Influenza virus
TVTFIFNGAF

SEQ ID NO: 515404 - protein, 10 aa, Influenza virus
TVTFNFNGAF

SEQ ID NO: 515405 - protein, 10 aa, Influenza virus
TVTFSFNGAF

SEQ ID NO: 515406 - protein, 10 aa, Influenza virus
TVTFTFNGAF

SEQ ID NO: 515407 - protein, 10 aa, Influenza virus
TVTHAKDILE

SEQ ID NO: 515408 - protein, 10 aa, Influenza virus
TVTHAKNILE

SEQ ID NO: 515409 - protein, 10 aa, Influenza virus
TVTHAQDILE

SEQ ID NO: 515410 - protein, 10 aa, Influenza virus
TVTHAQDILG

SEQ ID NO: 515411 - protein, 10 aa, Influenza virus
TVTHAQDLLE

SEQ ID NO: 515412 - protein, 10 aa, Influenza virus
TVTHAQNILE

SEQ ID NO: 515413 - protein, 10 aa, Influenza virus
TVTHSIELLE

SEQ ID NO: 515414 - protein, 10 aa, Influenza virus
TVTHSINLLE

SEQ ID NO: 515415 - protein, 10 aa, Influenza virus
TVTHSVDLLE

SEQ ID NO: 515416 - protein, 10 aa, Influenza virus
TVTHSVELLE

SEQ ID NO: 515417 - protein, 10 aa, Influenza virus
TVTHSVNILE

SEQ ID NO: 515418 - protein, 10 aa, Influenza virus
TVTHSVNLLE

SEQ ID NO: 515419 - protein, 10 aa, Influenza virus
TVTLHFKQHD

SEQ ID NO: 515420 - protein, 10 aa, Influenza virus
TVTLHFKQHE

SEQ ID NO: 515421 - protein, 10 aa, Influenza virus
TVTLHFKQHK

SEQ ID NO: 515422 - protein, 10 aa, Influenza virus
TVTLHFKQNE

SEQ ID NO: 515423 - protein, 10 aa, Influenza virus
TVTSSIELVE

SEQ ID NO: 515424 - protein, 10 aa, Influenza virus
TVTSSVELVE

SEQ ID NO: 515425 - protein, 10 aa, Influenza virus
TVVENKYVNN

SEQ ID NO: 515426 - protein, 10 aa, Influenza virus
TVVENTYVNN

SEQ ID NO: 515427 - protein, 10 aa, Influenza virus
TVVKTLTNEH

SEQ ID NO: 515428 - protein, 10 aa, Influenza virus
TVVLNTDWSG

SEQ ID NO: 515429 - protein, 10 aa, Influenza virus
TVVMTDGNAS

SEQ ID NO: 515430 - protein, 10 aa, Influenza virus
TVVMTDGSAS

SEQ ID NO: 515431 - protein, 10 aa, Influenza virus
TVVMTDGSVS

SEQ ID NO: 515432 - protein, 10 aa, Influenza virus
TVVNNITTTI

SEQ ID NO: 515433 - protein, 10 aa, Influenza virus
TVVSSLALAI

SEQ ID NO: 515434 - protein, 10 aa, Influenza virus
TVWSSKYQQS

SEQ ID NO: 515435 - protein, 10 aa, Influenza virus
TVWSSKYQRS

SEQ ID NO: 515436 - protein, 10 aa, Influenza virus
TVWSSKYRRS

SEQ ID NO: 515437 - protein, 10 aa, Influenza virus
TVWTSGSSIS

SEQ ID NO: 515438 - protein, 10 aa, Influenza virus
TVWTSSSSIV

SEQ ID NO: 515439 - protein, 10 aa, Influenza virus
TVWWTSNSIV

SEQ ID NO: 515440 - protein, 10 aa, Influenza virus
TVYWWDGLQS

SEQ ID NO: 515441 - protein, 10 aa, Influenza virus
TVYYDRRLTT

SEQ ID NO: 515442 - protein, 10 aa, Influenza virus
TVYYERRLTT

SEQ ID NO: 515443 - protein, 10 aa, Influenza virus
TVYYNGRLTT

SEQ ID NO: 515444 - protein, 10 aa, Influenza virus
TVYYNKRLTT

SEQ ID NO: 515445 - protein, 10 aa, Influenza virus
TVYYNRRLTT

SEQ ID NO: 515446 - protein, 10 aa, Influenza virus
TVYYNRRPTT

SEQ ID NO: 515447 - protein, 10 aa, Influenza virus
TWAGKILRTQ

SEQ ID NO: 515448 - protein, 10 aa, Influenza virus
TWAGNILRTQ

SEQ ID NO: 515449 - protein, 10 aa, Influenza virus
TWAIHHPPTS

SEQ ID NO: 515450 - protein, 10 aa, Influenza virus
TWAIHHPPTT

SEQ ID NO: 515451 - protein, 10 aa, Influenza virus
TWAKNILRTQ

SEQ ID NO: 515452 - protein, 10 aa, Influenza virus
TWARNILRTQ

SEQ ID NO: 515453 - protein, 10 aa, Influenza virus
TWDTLIERDN

SEQ ID NO: 515454 - protein, 10 aa, Influenza virus
TWDTLIEREN

SEQ ID NO: 515455 - protein, 10 aa, Influenza virus
TWDTLIERGS

SEQ ID NO: 515456 - protein, 10 aa, Influenza virus
TWDVFIERPT

SEQ ID NO: 515457 - protein, 10 aa, Influenza virus
TWLGGTISPR

SEQ ID NO: 515458 - protein, 10 aa, Influenza virus
TWLGRTFSPR

SEQ ID NO: 515459 - protein, 10 aa, Influenza virus
TWLGRTISIA

SEQ ID NO: 515460 - protein, 10 aa, Influenza virus
TWLGRTISPH

SEQ ID NO: 515461 - protein, 10 aa, Influenza virus
TWLGRTISPK

SEQ ID NO: 515462 - protein, 10 aa, Influenza virus
TWLGRTISPR

SEQ ID NO: 515463 - protein, 10 aa, Influenza virus
TWLGRTISTA

SEQ ID NO: 515464 - protein, 10 aa, Influenza virus
TWLGRTTSTA

SEQ ID NO: 515465 - protein, 10 aa, Influenza virus
TWLHVCVTGD

SEQ ID NO: 515466 - protein, 10 aa, Influenza virus
TWNGVKVDGS

SEQ ID NO: 515467 - protein, 10 aa, Influenza virus
TWSQNILRTQ

SEQ ID NO: 515468 - protein, 10 aa, Influenza virus
TWVGRTISIA

SEQ ID NO: 515469 - protein, 10 aa, Influenza virus
TYAGAINSSK

SEQ ID NO: 515470 - protein, 10 aa, Influenza virus
TYAGAINSSR

SEQ ID NO: 515471 - protein, 10 aa, Influenza virus
TYAGAVNSSK

SEQ ID NO: 515472 - protein, 10 aa, Influenza virus
TYCSLNGISP

SEQ ID NO: 515473 - protein, 10 aa, Influenza virus
TYCSLNGVSP

SEQ ID NO: 515474 - protein, 10 aa, Influenza virus
TYDHAQYREE

SEQ ID NO: 515475 - protein, 10 aa, Influenza virus
TYDHKDFEEE

SEQ ID NO: 515476 - protein, 10 aa, Influenza virus
TYDHKDYEEE

SEQ ID NO: 515477 - protein, 10 aa, Influenza virus
TYDHKEFEEE

SEQ ID NO: 515478 - protein, 10 aa, Influenza virus
TYDHKEFEKE

SEQ ID NO: 515479 - protein, 10 aa, Influenza virus
TYDHKEYEEE

SEQ ID NO: 515480 - protein, 10 aa, Influenza virus
TYDHNIYRDE

SEQ ID NO: 515481 - protein, 10 aa, Influenza virus
TYDHSHYREE

SEQ ID NO: 515482 - protein, 10 aa, Influenza virus
TYDHSQYREE

SEQ ID NO: 515483 - protein, 10 aa, Influenza virus
TYDHTQYREE

SEQ ID NO: 515484 - protein, 10 aa, Influenza virus
TYDWTLNRNQ

SEQ ID NO: 515485 - protein, 10 aa, Influenza virus
TYDYPKYEEE

SEQ ID NO: 515486 - protein, 10 aa, Influenza virus
TYDYPKYEKE

SEQ ID NO: 515487 - protein, 10 aa, Influenza virus
TYDYPKYSEE

SEQ ID NO: 515488 - protein, 10 aa, Influenza virus
TYDYPKYSKE

SEQ ID NO: 515489 - protein, 10 aa, Influenza virus
TYDYSKYEEE

SEQ ID NO: 515490 - protein, 10 aa, Influenza virus
TYGAGSWPDG

SEQ ID NO: 515491 - protein, 10 aa, Influenza virus
TYGSGSWPDG

SEQ ID NO: 515492 - protein, 10 aa, Influenza virus
TYGTGSWPDG

SEQ ID NO: 515493 - protein, 10 aa, Influenza virus
TYGTGTWPDG

SEQ ID NO: 515494 - protein, 10 aa, Influenza virus
TYHNSFVPVV

SEQ ID NO: 515495 - protein, 10 aa, Influenza virus
TYISIGTSTL

SEQ ID NO: 515496 - protein, 10 aa, Influenza virus
TYISVGTSTL

SEQ ID NO: 515497 - protein, 10 aa, Influenza virus
TYIWTYQAEL

SEQ ID NO: 515498 - protein, 10 aa, Influenza virus
TYKILSIYSS

SEQ ID NO: 515499 - protein, 10 aa, Influenza virus
TYKILSIYST

SEQ ID NO: 515500 - protein, 10 aa, Influenza virus
TYKILTIYST

SEQ ID NO: 515501 - protein, 10 aa, Influenza virus
TYNAELFVLM

SEQ ID NO: 515502 - protein, 10 aa, Influenza virus
TYNAELLILL

SEQ ID NO: 515503 - protein, 10 aa, Influenza virus
TYNAELLVAM

SEQ ID NO: 515504 - protein, 10 aa, Influenza virus
TYNAELLVLI

SEQ ID NO: 515505 - protein, 10 aa, Influenza virus
TYNAELLVLL

SEQ ID NO: 515506 - protein, 10 aa, Influenza virus
TYNAELLVLM

SEQ ID NO: 515507 - protein, 10 aa, Influenza virus
TYNAEVLVLM

SEQ ID NO: 515508 - protein, 10 aa, Influenza virus
TYNGIRTNGA

SEQ ID NO: 515509 - protein, 10 aa, Influenza virus
TYNHEDYKEE

SEQ ID NO: 515510 - protein, 10 aa, Influenza virus
TYNHEDYREE

SEQ ID NO: 515511 - protein, 10 aa, Influenza virus
TYNHKDYEEE

SEQ ID NO: 515512 - protein, 10 aa, Influenza virus
TYNHKEYEEE

SEQ ID NO: 515513 - protein, 10 aa, Influenza virus
TYNHTEYRQE

SEQ ID NO: 515514 - protein, 10 aa, Influenza virus
TYNHTQYREE

SEQ ID NO: 515515 - protein, 10 aa, Influenza virus
TYNKTVINNI

SEQ ID NO: 515516 - protein, 10 aa, Influenza virus
TYNNTTGRDV

SEQ ID NO: 515517 - protein, 10 aa, Influenza virus
TYNNTVINNI

SEQ ID NO: 515518 - protein, 10 aa, Influenza virus
TYNNTVINNM

SEQ ID NO: 515519 - protein, 10 aa, Influenza virus
TYNNTVVNNI

SEQ ID NO: 515520 - protein, 10 aa, Influenza virus
TYNRKEYEEE

SEQ ID NO: 515521 - protein, 10 aa, Influenza virus
TYNSTVVNNI

SEQ ID NO: 515522 - protein, 10 aa, Influenza virus
TYNTELLVLM

SEQ ID NO: 515523 - protein, 10 aa, Influenza virus
TYNVELLVLM

SEQ ID NO: 515524 - protein, 10 aa, Influenza virus
TYNYPKYEEE

SEQ ID NO: 515525 - protein, 10 aa, Influenza virus
TYNYPKYSEE

SEQ ID NO: 515526 - protein, 10 aa, Influenza virus
TYQAELLIAM

SEQ ID NO: 515527 - protein, 10 aa, Influenza virus
TYQAELLVAM

SEQ ID NO: 515528 - protein, 10 aa, Influenza virus
TYQILSIYST

SEQ ID NO: 515529 - protein, 10 aa, Influenza virus
TYQKRMGVQM

SEQ ID NO: 515530 - protein, 10 aa, Influenza virus
TYQNNFVPVI

SEQ ID NO: 515531 - protein, 10 aa, Influenza virus
TYQNNFVPVM

SEQ ID NO: 515532 - protein, 10 aa, Influenza virus
TYQNNFVPVV

SEQ ID NO: 515533 - protein, 10 aa, Influenza virus
TYQNSFVPVV

SEQ ID NO: 515534 - protein, 10 aa, Influenza virus
TYQRTRALVR

SEQ ID NO: 515535 - protein, 10 aa, Influenza virus
TYQSNFVPVV

SEQ ID NO: 515536 - protein, 10 aa, Influenza virus
TYQWIIKNWE

SEQ ID NO: 515537 - protein, 10 aa, Influenza virus
TYQWIIRNWE

SEQ ID NO: 515538 - protein, 10 aa, Influenza virus
TYQWVIRNWE

SEQ ID NO: 515539 - protein, 10 aa, Influenza virus
TYRCHKGDTQ

SEQ ID NO: 515540 - protein, 10 aa, Influenza virus
TYRCHRGDAQ

SEQ ID NO: 515541 - protein, 10 aa, Influenza virus
TYRCHRGDMQ

SEQ ID NO: 515542 - protein, 10 aa, Influenza virus
TYRCHRGDTH

SEQ ID NO: 515543 - protein, 10 aa, Influenza virus
TYRCHRGDTQ

SEQ ID NO: 515544 - protein, 10 aa, Influenza virus
TYREEAMQNR

SEQ ID NO: 515545 - protein, 10 aa, Influenza virus
TYRILSIYST

SEQ ID NO: 515546 - protein, 10 aa, Influenza virus
TYRNNRKEPA

SEQ ID NO: 515547 - protein, 10 aa, Influenza virus
TYRNTRKEPA

SEQ ID NO: 515548 - protein, 10 aa, Influenza virus
TYSGIRTNGA

SEQ ID NO: 515549 - protein, 10 aa, Influenza virus
TYSGIRTNGT

SEQ ID NO: 515550 - protein, 10 aa, Influenza virus
TYSGIRTNGV

SEQ ID NO: 515551 - protein, 10 aa, Influenza virus
TYSSPMMWEI

SEQ ID NO: 515552 - protein, 10 aa, Influenza virus
TYSSSLMWEI

SEQ ID NO: 515553 - protein, 10 aa, Influenza virus
TYSSSMMWEI

SEQ ID NO: 515554 - protein, 10 aa, Influenza virus
TYSSSMMWEV

SEQ ID NO: 515555 - protein, 10 aa, Influenza virus
TYTGAINSSK

SEQ ID NO: 515556 - protein, 10 aa, Influenza virus
TYTGAINSSR

SEQ ID NO: 515557 - protein, 10 aa, Influenza virus
TYTGISKACN

SEQ ID NO: 515558 - protein, 10 aa, Influenza virus
TYTGTSKACN

SEQ ID NO: 515559 - protein, 10 aa, Influenza virus
TYTGTSRACN

SEQ ID NO: 515560 - protein, 10 aa, Influenza virus
TYVDGFEPNG

SEQ ID NO: 515561 - protein, 10 aa, Influenza virus
TYVDGFKPNG

SEQ ID NO: 515562 - protein, 10 aa, Influenza virus
TYVLSIIPSG

SEQ ID NO: 515563 - protein, 10 aa, Influenza virus
TYVLSIVPSG

SEQ ID NO: 515564 - protein, 10 aa, Influenza virus
TYVLSVIPSG

SEQ ID NO: 515565 - protein, 10 aa, Influenza virus
TYVSIGTSTL

SEQ ID NO: 515566 - protein, 10 aa, Influenza virus
TYVSVGTSTL

SEQ ID NO: 515567 - protein, 10 aa, Influenza virus
TYWWDGLQSS

SEQ ID NO: 515568 - protein, 10 aa, Influenza virus
TYYYPKYEEE

SEQ ID NO: 515569 - protein, 10 aa, Influenza virus
VAASLCLAIL

SEQ ID NO: 515570 - protein, 10 aa, Influenza virus
VAASLCLAVL

SEQ ID NO: 515571 - protein, 10 aa, Influenza virus
VACGPAECRT

SEQ ID NO: 515572 - protein, 10 aa, Influenza virus
VACGPSECRT

SEQ ID NO: 515573 - protein, 10 aa, Influenza virus
VACGPTECRT

SEQ ID NO: 515574 - protein, 10 aa, Influenza virus
VACSPSECRT

SEQ ID NO: 515575 - protein, 10 aa, Influenza virus
VADGGPNLYN

SEQ ID NO: 515576 - protein, 10 aa, Influenza virus
VADRDSTQKA

SEQ ID NO: 515577 - protein, 10 aa, Influenza virus
VADYKSTQAA

SEQ ID NO: 515578 - protein, 10 aa, Influenza virus
VAEINTWARN

SEQ ID NO: 515579 - protein, 10 aa, Influenza virus
VAFCGTSGTY

SEQ ID NO: 515580 - protein, 10 aa, Influenza virus
VAGGLILGMQ

SEQ ID NO: 515581 - protein, 10 aa, Influenza virus
VAGLSFWMCS

SEQ ID NO: 515582 - protein, 10 aa, Influenza virus
VAGLSFWRCS

SEQ ID NO: 515583 - protein, 10 aa, Influenza virus
VAGSLSLAIM

SEQ ID NO: 515584 - protein, 10 aa, Influenza virus
VAGSSEQAAE

SEQ ID NO: 515585 - protein, 10 aa, Influenza virus
VAGWILGNPE

SEQ ID NO: 515586 - protein, 10 aa, Influenza virus
VAGWILGNPK

SEQ ID NO: 515587 - protein, 10 aa, Influenza virus
VAGWLLGNPE

SEQ ID NO: 515588 - protein, 10 aa, Influenza virus
VAGWLLGNPL

SEQ ID NO: 515589 - protein, 10 aa, Influenza virus
VAGWLLGNPM

SEQ ID NO: 515590 - protein, 10 aa, Influenza virus
VAGWYGFQHQ

SEQ ID NO: 515591 - protein, 10 aa, Influenza virus
VAGWYGFQHS

SEQ ID NO: 515592 - protein, 10 aa, Influenza virus
VAGWYGFQHT

SEQ ID NO: 515593 - protein, 10 aa, Influenza virus
VAHKSCLPAC

SEQ ID NO: 515594 - protein, 10 aa, Influenza virus
VAIALSILNL

SEQ ID NO: 515595 - protein, 10 aa, Influenza virus
VAIALSVLNL

SEQ ID NO: 515596 - protein, 10 aa, Influenza virus
VAIENQHTID

SEQ ID NO: 515597 - protein, 10 aa, Influenza virus
VAIVFSQEDC

SEQ ID NO: 515598 - protein, 10 aa, Influenza virus
VAKAGFIENG

SEQ ID NO: 515599 - protein, 10 aa, Influenza virus
VAKDNAIRFG

SEQ ID NO: 515600 - protein, 10 aa, Influenza virus
VALALSHTAY

SEQ ID NO: 515601 - protein, 10 aa, Influenza virus
VALCGSKEQL

SEQ ID NO: 515602 - protein, 10 aa, Influenza virus
VALCGSKERL

SEQ ID NO: 515603 - protein, 10 aa, Influenza virus
VALCGSPISV

SEQ ID NO: 515604 - protein, 10 aa, Influenza virus
VALCGSPVPV

SEQ ID NO: 515605 - protein, 10 aa, Influenza virus
VALCGSPVSV

SEQ ID NO: 515606 - protein, 10 aa, Influenza virus
VALCGSRERL

SEQ ID NO: 515607 - protein, 10 aa, Influenza virus
VALENQHTID

SEQ ID NO: 515608 - protein, 10 aa, Influenza virus
VALENQHTIH

SEQ ID NO: 515609 - protein, 10 aa, Influenza virus
VALENQNTID

SEQ ID NO: 515610 - protein, 10 aa, Influenza virus
VALGYSTGAL

SEQ ID NO: 515611 - protein, 10 aa, Influenza virus
VALILGFVLW

SEQ ID NO: 515612 - protein, 10 aa, Influenza virus
VALSYSAGAL

SEQ ID NO: 515613 - protein, 10 aa, Influenza virus
VALSYSTGAL

SEQ ID NO: 515614 - protein, 10 aa, Influenza virus
VAMENQHTID

SEQ ID NO: 515615 - protein, 10 aa, Influenza virus
VAMVFSQEDC

SEQ ID NO: 515616 - protein, 10 aa, Influenza virus
VAMVFSQEDR

SEQ ID NO: 515617 - protein, 10 aa, Influenza virus
VAMVFSQEEC

SEQ ID NO: 515618 - protein, 10 aa, Influenza virus
VANFSMELPS

SEQ ID NO: 515619 - protein, 10 aa, Influenza virus
VANGTKVNTL

SEQ ID NO: 515620 - protein, 10 aa, Influenza virus
VAPEYGFKIS

SEQ ID NO: 515621 - protein, 10 aa, Influenza virus
VAPIMFSNKM

SEQ ID NO: 515622 - protein, 10 aa, Influenza virus
VAPSPSNSRF

SEQ ID NO: 515623 - protein, 10 aa, Influenza virus
VAPSPYNSRF

SEQ ID NO: 515624 - protein, 10 aa, Influenza virus
VAPVLGNYKE

SEQ ID NO: 515625 - protein, 10 aa, Influenza virus
VARCNTKCQT

SEQ ID NO: 515626 - protein, 10 aa, Influenza virus
VARLGKGYMF

SEQ ID NO: 515627 - protein, 10 aa, Influenza virus
VASMRRNYFT

SEQ ID NO: 515628 - protein, 10 aa, Influenza virus
VASSLVLLFM

SEQ ID NO: 515629 - protein, 10 aa, Influenza virus
VASSLVLLLM

SEQ ID NO: 515630 - protein, 10 aa, Influenza virus
VATGRVTVST

SEQ ID NO: 515631 - protein, 10 aa, Influenza virus
VATTHSWIPK

SEQ ID NO: 515632 - protein, 10 aa, Influenza virus
VATTHSWTPK

SEQ ID NO: 515633 - protein, 10 aa, Influenza virus
VATTHSWVPI

SEQ ID NO: 515634 - protein, 10 aa, Influenza virus
VATTHSWVPK

SEQ ID NO: 515635 - protein, 10 aa, Influenza virus
VAVAKDNAIR

SEQ ID NO: 515636 - protein, 10 aa, Influenza virus
VAVENQHTID

SEQ ID NO: 515637 - protein, 10 aa, Influenza virus
VAVIKYNGII

SEQ ID NO: 515638 - protein, 10 aa, Influenza virus
VAVLKYKGII

SEQ ID NO: 515639 - protein, 10 aa, Influenza virus
VAVLKYNDII

SEQ ID NO: 515640 - protein, 10 aa, Influenza virus
VAVLKYNGII

SEQ ID NO: 515641 - protein, 10 aa, Influenza virus
VAVLKYNGVI

SEQ ID NO: 515642 - protein, 10 aa, Influenza virus
VAVTDGPAAN

SEQ ID NO: 515643 - protein, 10 aa, Influenza virus
VAWSASACHD

SEQ ID NO: 515644 - protein, 10 aa, Influenza virus
VAWSATACHD

SEQ ID NO: 515645 - protein, 10 aa, Influenza virus
VAWSATACSD

SEQ ID NO: 515646 - protein, 10 aa, Influenza virus
VAWSSSSCFD

SEQ ID NO: 515647 - protein, 10 aa, Influenza virus
VAWSSSSCHD

SEQ ID NO: 515648 - protein, 10 aa, Influenza virus
VAWSSTSCFD

SEQ ID NO: 515649 - protein, 10 aa, Influenza virus
VAYDKICIGY

SEQ ID NO: 515650 - protein, 10 aa, Influenza virus
VAYERMCNIL

SEQ ID NO: 515651 - protein, 10 aa, Influenza virus
VAYMLERELV

SEQ ID NO: 515652 - protein, 10 aa, Influenza virus
VCAAWSSSSC

SEQ ID NO: 515653 - protein, 10 aa, Influenza virus
VCATCEQIAD

SEQ ID NO: 515654 - protein, 10 aa, Influenza virus
VCFMYSDFHF

SEQ ID NO: 515655 - protein, 10 aa, Influenza virus
VCHKGICPVV

SEQ ID NO: 515656 - protein, 10 aa, Influenza virus
VCHKGVCPVI

SEQ ID NO: 515657 - protein, 10 aa, Influenza virus
VCHKGVCPVV

SEQ ID NO: 515658 - protein, 10 aa, Influenza virus
VCHNGICPVV

SEQ ID NO: 515659 - protein, 10 aa, Influenza virus
VCHNGTCAVV

SEQ ID NO: 515660 - protein, 10 aa, Influenza virus
VCHNGTCVVI

SEQ ID NO: 515661 - protein, 10 aa, Influenza virus
VCHNGTCVVV

SEQ ID NO: 515662 - protein, 10 aa, Influenza virus
VCHNGVCPVV

SEQ ID NO: 515663 - protein, 10 aa, Influenza virus
VCHSGICPVV

SEQ ID NO: 515664 - protein, 10 aa, Influenza virus
VCHSGVCPVV

SEQ ID NO: 515665 - protein, 10 aa, Influenza virus
VCIAWSSASC

SEQ ID NO: 515666 - protein, 10 aa, Influenza virus
VCIAWSSSSC

SEQ ID NO: 515667 - protein, 10 aa, Influenza virus
VCINGICTVV

SEQ ID NO: 515668 - protein, 10 aa, Influenza virus
VCINGSCAVV

SEQ ID NO: 515669 - protein, 10 aa, Influenza virus
VCINGSCIVV

SEQ ID NO: 515670 - protein, 10 aa, Influenza virus
VCINGSCTVV

SEQ ID NO: 515671 - protein, 10 aa, Influenza virus
VCINGTCAVV

SEQ ID NO: 515672 - protein, 10 aa, Influenza virus
VCINGTCTVI

SEQ ID NO: 515673 - protein, 10 aa, Influenza virus
VCINGTCTVV

SEQ ID NO: 515674 - protein, 10 aa, Influenza virus
VCISGPNNNA

SEQ ID NO: 515675 - protein, 10 aa, Influenza virus
VCISGTCAVV

SEQ ID NO: 515676 - protein, 10 aa, Influenza virus
VCITGDDRNA

SEQ ID NO: 515677 - protein, 10 aa, Influenza virus
VCMAWSSSSC

SEQ ID NO: 515678 - protein, 10 aa, Influenza virus
VCMESVRNGT

SEQ ID NO: 515679 - protein, 10 aa, Influenza virus
VCMSGPNNNA

SEQ ID NO: 515680 - protein, 10 aa, Influenza virus
VCPVVFTDGS

SEQ ID NO: 515681 - protein, 10 aa, Influenza virus
VCPVVMTDGP

SEQ ID NO: 515682 - protein, 10 aa, Influenza virus
VCQDEFCYTL

SEQ ID NO: 515683 - protein, 10 aa, Influenza virus
VCQNGVCPVV

SEQ ID NO: 515684 - protein, 10 aa, Influenza virus
VCRALLAKSV

SEQ ID NO: 515685 - protein, 10 aa, Influenza virus
VCRDNWHASN

SEQ ID NO: 515686 - protein, 10 aa, Influenza virus
VCRDNWHGSN

SEQ ID NO: 515687 - protein, 10 aa, Influenza virus
VCRDNWKGAN

SEQ ID NO: 515688 - protein, 10 aa, Influenza virus
VCRDNWKGCN

SEQ ID NO: 515689 - protein, 10 aa, Influenza virus
VCRDNWKGSN

SEQ ID NO: 515690 - protein, 10 aa, Influenza virus
VCRDNWMGSN

SEQ ID NO: 515691 - protein, 10 aa, Influenza virus
VCRDNWNGMN

SEQ ID NO: 515692 - protein, 10 aa, Influenza virus
VCRDNWQGAN

SEQ ID NO: 515693 - protein, 10 aa, Influenza virus
VCRDNWRGSN

SEQ ID NO: 515694 - protein, 10 aa, Influenza virus
VCRDNWTGTN

SEQ ID NO: 515695 - protein, 10 aa, Influenza virus
VCRTLLAKSV

SEQ ID NO: 515696 - protein, 10 aa, Influenza virus
VCSGIFGDNP

SEQ ID NO: 515697 - protein, 10 aa, Influenza virus
VCSGIFGDSP

SEQ ID NO: 515698 - protein, 10 aa, Influenza virus
VCSGLVGDTP

SEQ ID NO: 515699 - protein, 10 aa, Influenza virus
VCSGVFGDNP

SEQ ID NO: 515700 - protein, 10 aa, Influenza virus
VCSKFHSDTP

SEQ ID NO: 515701 - protein, 10 aa, Influenza virus
VCSNGSCRCT

SEQ ID NO: 515702 - protein, 10 aa, Influenza virus
VCTGILTDTS

SEQ ID NO: 515703 - protein, 10 aa, Influenza virus
VCTGVLTDTS

SEQ ID NO: 515704 - protein, 10 aa, Influenza virus
VCTKGKKAVD

SEQ ID NO: 515705 - protein, 10 aa, Influenza virus
VCVAWSSSSC

SEQ ID NO: 515706 - protein, 10 aa, Influenza virus
VCVCRDNWHA

SEQ ID NO: 515707 - protein, 10 aa, Influenza virus
VCVSLLQSAI

SEQ ID NO: 515708 - protein, 10 aa, Influenza virus
VCVTGDDGNA

SEQ ID NO: 515709 - protein, 10 aa, Influenza virus
VCVTGDDKNA

SEQ ID NO: 515710 - protein, 10 aa, Influenza virus
VCVTGDDRNA

SEQ ID NO: 515711 - protein, 10 aa, Influenza virus
VCWSFALAQG

SEQ ID NO: 515712 - protein, 10 aa, Influenza virus
VCYNPCFYVE

SEQ ID NO: 515713 - protein, 10 aa, Influenza virus
VCYPGSIENQ

SEQ ID NO: 515714 - protein, 10 aa, Influenza virus
VCYPGSIKNQ

SEQ ID NO: 515715 - protein, 10 aa, Influenza virus
VDALLGDPHC

SEQ ID NO: 515716 - protein, 10 aa, Influenza virus
VDCFLWHVRK

SEQ ID NO: 515717 - protein, 10 aa, Influenza virus
VDDAVTDIWS

SEQ ID NO: 515718 - protein, 10 aa, Influenza virus
VDDAVTDVWS

SEQ ID NO: 515719 - protein, 10 aa, Influenza virus
VDEGNGCFEL

SEQ ID NO: 515720 - protein, 10 aa, Influenza virus
VDGFEPNGCI

SEQ ID NO: 515721 - protein, 10 aa, Influenza virus
VDGFEPNGSI

SEQ ID NO: 515722 - protein, 10 aa, Influenza virus
VDGFEPNGYI

SEQ ID NO: 515723 - protein, 10 aa, Influenza virus
VDGFKPNGCI

SEQ ID NO: 515724 - protein, 10 aa, Influenza virus
VDGQDCDLIN

SEQ ID NO: 515725 - protein, 10 aa, Influenza virus
VDGQSGRIDF

SEQ ID NO: 515726 - protein, 10 aa, Influenza virus
VDGSSSACLR

SEQ ID NO: 515727 - protein, 10 aa, Influenza virus
VDGTIAGFIE

SEQ ID NO: 515728 - protein, 10 aa, Influenza virus
VDGWYGFHHS

SEQ ID NO: 515729 - protein, 10 aa, Influenza virus
VDGWYGFRHH

SEQ ID NO: 515730 - protein, 10 aa, Influenza virus
VDGWYGFRHQ

SEQ ID NO: 515731 - protein, 10 aa, Influenza virus
VDGWYGYHHE

SEQ ID NO: 515732 - protein, 10 aa, Influenza virus
VDGWYGYHHI

SEQ ID NO: 515733 - protein, 10 aa, Influenza virus
VDGWYGYHHN

SEQ ID NO: 515734 - protein, 10 aa, Influenza virus
VDGWYGYHHQ

SEQ ID NO: 515735 - protein, 10 aa, Influenza virus
VDGWYGYHHS

SEQ ID NO: 515736 - protein, 10 aa, Influenza virus
VDGWYGYHHT

SEQ ID NO: 515737 - protein, 10 aa, Influenza virus
VDHMAIIKKY

SEQ ID NO: 515738 - protein, 10 aa, Influenza virus
VDKLTQGRQT

SEQ ID NO: 515739 - protein, 10 aa, Influenza virus
VDKMNREFEV

SEQ ID NO: 515740 - protein, 10 aa, Influenza virus
VDKMNREFGV

SEQ ID NO: 515741 - protein, 10 aa, Influenza virus
VDLGQCGLLG

SEQ ID NO: 515742 - protein, 10 aa, Influenza virus
VDLGSCGILG

SEQ ID NO: 515743 - protein, 10 aa, Influenza virus
VDLVETNHTG

SEQ ID NO: 515744 - protein, 10 aa, Influenza virus
VDLWSYNAEL

SEQ ID NO: 515745 - protein, 10 aa, Influenza virus
VDNHSMSDIE

SEQ ID NO: 515746 - protein, 10 aa, Influenza virus
VDNKNWSGYS

SEQ ID NO: 515747 - protein, 10 aa, Influenza virus
VDNNGELRHL

SEQ ID NO: 515748 - protein, 10 aa, Influenza virus
VDNNNWFGYF

SEQ ID NO: 515749 - protein, 10 aa, Influenza virus
VDNNNWSGYS

SEQ ID NO: 515750 - protein, 10 aa, Influenza virus
VDNNSWSGYS

SEQ ID NO: 515751 - protein, 10 aa, Influenza virus
VDNQNWSGYS

SEQ ID NO: 515752 - protein, 10 aa, Influenza virus
VDNSNWSGYS

SEQ ID NO: 515753 - protein, 10 aa, Influenza virus
VDQITGKLNR

SEQ ID NO: 515754 - protein, 10 aa, Influenza virus
VDQSLIIAAR

SEQ ID NO: 515755 - protein, 10 aa, Influenza virus
VDQSLVIAAR

SEQ ID NO: 515756 - protein, 10 aa, Influenza virus
VDQVRESRNP

SEQ ID NO: 515757 - protein, 10 aa, Influenza virus
VDRFYRICKL

SEQ ID NO: 515758 - protein, 10 aa, Influenza virus
VDRFYRTCKL

SEQ ID NO: 515759 - protein, 10 aa, Influenza virus
VDRLTQGRQT

SEQ ID NO: 515760 - protein, 10 aa, Influenza virus
VDSIGSWSQN

SEQ ID NO: 515761 - protein, 10 aa, Influenza virus
VDSIVSWSQN

SEQ ID NO: 515762 - protein, 10 aa, Influenza virus
VDTCYPFDVP

SEQ ID NO: 515763 - protein, 10 aa, Influenza virus
VDTGDGCFEI

SEQ ID NO: 515764 - protein, 10 aa, Influenza virus
VDTGNGCFDI

SEQ ID NO: 515765 - protein, 10 aa, Influenza virus
VDTIIENNVT

SEQ ID NO: 515766 - protein, 10 aa, Influenza virus
VDTIIESNVT

SEQ ID NO: 515767 - protein, 10 aa, Influenza virus
VDTILEKNIT

SEQ ID NO: 515768 - protein, 10 aa, Influenza virus
VDTILEKNVT

SEQ ID NO: 515769 - protein, 10 aa, Influenza virus
VDTILERNVT

SEQ ID NO: 515770 - protein, 10 aa, Influenza virus
VDTIMEKNIT

SEQ ID NO: 515771 - protein, 10 aa, Influenza virus
VDTIMEKNVT

SEQ ID NO: 515772 - protein, 10 aa, Influenza virus
VDTIMERNVT

SEQ ID NO: 515773 - protein, 10 aa, Influenza virus
VDTLLEKNVT

SEQ ID NO: 515774 - protein, 10 aa, Influenza virus
VDTLLENDVP

SEQ ID NO: 515775 - protein, 10 aa, Influenza virus
VDTLLENGVP

SEQ ID NO: 515776 - protein, 10 aa, Influenza virus
VDTLLENNVP

SEQ ID NO: 515777 - protein, 10 aa, Influenza virus
VDTLLESDVP

SEQ ID NO: 515778 - protein, 10 aa, Influenza virus
VDTLTEKGIE

SEQ ID NO: 515779 - protein, 10 aa, Influenza virus
VDTLTENGVP

SEQ ID NO: 515780 - protein, 10 aa, Influenza virus
VDTLTETGVP

SEQ ID NO: 515781 - protein, 10 aa, Influenza virus
VDTLTGRGIE

SEQ ID NO: 515782 - protein, 10 aa, Influenza virus
VDTVLEKNVT

SEQ ID NO: 515783 - protein, 10 aa, Influenza virus
VDTVLERNVT

SEQ ID NO: 515784 - protein, 10 aa, Influenza virus
VDTVREKNVT

SEQ ID NO: 515785 - protein, 10 aa, Influenza virus
VDVYCICRDN

SEQ ID NO: 515786 - protein, 10 aa, Influenza virus
VEAESSVKEK

SEQ ID NO: 515787 - protein, 10 aa, Influenza virus
VEAMISRARI

SEQ ID NO: 515788 - protein, 10 aa, Influenza virus
VEAMMSRARI

SEQ ID NO: 515789 - protein, 10 aa, Influenza virus
VEAMVSRARI

SEQ ID NO: 515790 - protein, 10 aa, Influenza virus
VEAVIYGNPK

SEQ ID NO: 515791 - protein, 10 aa, Influenza virus
VECICRDNWT

SEQ ID NO: 515792 - protein, 10 aa, Influenza virus
VECIGWSSTS

SEQ ID NO: 515793 - protein, 10 aa, Influenza virus
VECVCRDNWN

SEQ ID NO: 515794 - protein, 10 aa, Influenza virus
VECVCRDNWR

SEQ ID NO: 515795 - protein, 10 aa, Influenza virus
VECVCRDNWT

SEQ ID NO: 515796 - protein, 10 aa, Influenza virus
VECVGWSSTS

SEQ ID NO: 515797 - protein, 10 aa, Influenza virus
VEDGFLDVWT

SEQ ID NO: 515798 - protein, 10 aa, Influenza virus
VEDGSIGKVC

SEQ ID NO: 515799 - protein, 10 aa, Influenza virus
VEDTKIDLWS

SEQ ID NO: 515800 - protein, 10 aa, Influenza virus
VEDTKVDLWS

SEQ ID NO: 515801 - protein, 10 aa, Influenza virus
VEECLINDPW

SEQ ID NO: 515802 - protein, 10 aa, Influenza virus
VEECSCYGHN

SEQ ID NO: 515803 - protein, 10 aa, Influenza virus
VEECSCYPRF

SEQ ID NO: 515804 - protein, 10 aa, Influenza virus
VEECSCYPRS

SEQ ID NO: 515805 - protein, 10 aa, Influenza virus
VEECSCYPRY

SEQ ID NO: 515806 - protein, 10 aa, Influenza virus
VEEGSIGKVC

SEQ ID NO: 515807 - protein, 10 aa, Influenza virus
VEELVHGGID

SEQ ID NO: 515808 - protein, 10 aa, Influenza virus
VEELVHGGIN

SEQ ID NO: 515809 - protein, 10 aa, Influenza virus
VEELVHGGVD

SEQ ID NO: 515810 - protein, 10 aa, Influenza virus
VEELVHGQVN

SEQ ID NO: 515811 - protein, 10 aa, Influenza virus
VEELVHRGID

SEQ ID NO: 515812 - protein, 10 aa, Influenza virus
VEESSIGKVC

SEQ ID NO: 515813 - protein, 10 aa, Influenza virus
VEFEPFQSLV

SEQ ID NO: 515814 - protein, 10 aa, Influenza virus
VEGRIQDLEK

SEQ ID NO: 515815 - protein, 10 aa, Influenza virus
VEGRIQDLER

SEQ ID NO: 515816 - protein, 10 aa, Influenza virus
VEGWVVIAKD

SEQ ID NO: 515817 - protein, 10 aa, Influenza virus
VEGWVVIAQD

SEQ ID NO: 515818 - protein, 10 aa, Influenza virus
VEGWVVIEKD

SEQ ID NO: 515819 - protein, 10 aa, Influenza virus
VEGWVVVAKD

SEQ ID NO: 515820 - protein, 10 aa, Influenza virus
VEIRINMINS

SEQ ID NO: 515821 - protein, 10 aa, Influenza virus
VEITGIDKVC

SEQ ID NO: 515822 - protein, 10 aa, Influenza virus
VEITGINKVC

SEQ ID NO: 515823 - protein, 10 aa, Influenza virus
VEKMNTQFTA

SEQ ID NO: 515824 - protein, 10 aa, Influenza virus
VEKQIGNVIN

SEQ ID NO: 515825 - protein, 10 aa, Influenza virus
VEKQLGNVIN

SEQ ID NO: 515826 - protein, 10 aa, Influenza virus
VEKRINMIAD

SEQ ID NO: 515827 - protein, 10 aa, Influenza virus
VEKRINMLAD

SEQ ID NO: 515828 - protein, 10 aa, Influenza virus
VEKTNEKFHQ

SEQ ID NO: 515829 - protein, 10 aa, Influenza virus
VELAEKAMKE

SEQ ID NO: 515830 - protein, 10 aa, Influenza virus
VELAEKTMKE

SEQ ID NO: 515831 - protein, 10 aa, Influenza virus
VELAERAMKE

SEQ ID NO: 515832 - protein, 10 aa, Influenza virus
VELIRGMPKE

SEQ ID NO: 515833 - protein, 10 aa, Influenza virus
VELIRGMPQE

SEQ ID NO: 515834 - protein, 10 aa, Influenza virus
VELIRGQPKE

SEQ ID NO: 515835 - protein, 10 aa, Influenza virus
VELIRGRKQE

SEQ ID NO: 515836 - protein, 10 aa, Influenza virus
VELIRGRPEE

SEQ ID NO: 515837 - protein, 10 aa, Influenza virus
VELIRGRPKE

SEQ ID NO: 515838 - protein, 10 aa, Influenza virus
VELIRGRPQE

SEQ ID NO: 515839 - protein, 10 aa, Influenza virus
VELIRGRPRE

SEQ ID NO: 515840 - protein, 10 aa, Influenza virus
VELIRGRQQE

SEQ ID NO: 515841 - protein, 10 aa, Influenza virus
VELIRGRSQE

SEQ ID NO: 515842 - protein, 10 aa, Influenza virus
VELLVLMENE

SEQ ID NO: 515843 - protein, 10 aa, Influenza virus
VELSSGYKDV

SEQ ID NO: 515844 - protein, 10 aa, Influenza virus
VELSSMGVYQ

SEQ ID NO: 515845 - protein, 10 aa, Influenza virus
VELTRGRPQE

SEQ ID NO: 515846 - protein, 10 aa, Influenza virus
VELVRGRPKE

SEQ ID NO: 515847 - protein, 10 aa, Influenza virus
VEMIRGEPEE

SEQ ID NO: 515848 - protein, 10 aa, Influenza virus
VEMIRGKPEE

SEQ ID NO: 515849 - protein, 10 aa, Influenza virus
VEMIRGQPKE

SEQ ID NO: 515850 - protein, 10 aa, Influenza virus
VEMIRGRPEE

SEQ ID NO: 515851 - protein, 10 aa, Influenza virus
VENGTSVKTL

SEQ ID NO: 515852 - protein, 10 aa, Influenza virus
VENLEELRFV

SEQ ID NO: 515853 - protein, 10 aa, Influenza virus
VENLFDEVRR

SEQ ID NO: 515854 - protein, 10 aa, Influenza virus
VENLNKKMED

SEQ ID NO: 515855 - protein, 10 aa, Influenza virus
VENQEELRSL

SEQ ID NO: 515856 - protein, 10 aa, Influenza virus
VENQHTIDLT

SEQ ID NO: 515857 - protein, 10 aa, Influenza virus
VENQHTIDST

SEQ ID NO: 515858 - protein, 10 aa, Influenza virus
VENRINMLAD

SEQ ID NO: 515859 - protein, 10 aa, Influenza virus
VENTYVNNTT

SEQ ID NO: 515860 - protein, 10 aa, Influenza virus
VEPKGLFGAI

SEQ ID NO: 515861 - protein, 10 aa, Influenza virus
VEPRGLFGAI

SEQ ID NO: 515862 - protein, 10 aa, Influenza virus
VEQQIGNVIN

SEQ ID NO: 515863 - protein, 10 aa, Influenza virus
VEQRINMLAD

SEQ ID NO: 515864 - protein, 10 aa, Influenza virus
VERGLFGAIA

SEQ ID NO: 515865 - protein, 10 aa, Influenza virus
VERILEEESD

SEQ ID NO: 515866 - protein, 10 aa, Influenza virus
VERMVLSAFD

SEQ ID NO: 515867 - protein, 10 aa, Influenza virus
VERPKEIEGI

SEQ ID NO: 515868 - protein, 10 aa, Influenza virus
VERPKEMEGI

SEQ ID NO: 515869 - protein, 10 aa, Influenza virus
VERPKEMEGV

SEQ ID NO: 515870 - protein, 10 aa, Influenza virus
VERPSAPEGM

SEQ ID NO: 515871 - protein, 10 aa, Influenza virus
VERQIGNVIN

SEQ ID NO: 515872 - protein, 10 aa, Influenza virus
VERRINMLAD

SEQ ID NO: 515873 - protein, 10 aa, Influenza virus
VERTKEMEGI

SEQ ID NO: 515874 - protein, 10 aa, Influenza virus
VESAVLRGFL

SEQ ID NO: 515875 - protein, 10 aa, Influenza virus
VESMIEAESS

SEQ ID NO: 515876 - protein, 10 aa, Influenza virus
VESNGNLIAP

SEQ ID NO: 515877 - protein, 10 aa, Influenza virus
VESNGNLVAP

SEQ ID NO: 515878 - protein, 10 aa, Influenza virus
VESRINMINS

SEQ ID NO: 515879 - protein, 10 aa, Influenza virus
VESRINTINS

SEQ ID NO: 515880 - protein, 10 aa, Influenza virus
VESSTYQNNF

SEQ ID NO: 515881 - protein, 10 aa, Influenza virus
VETGYVCSKF

SEQ ID NO: 515882 - protein, 10 aa, Influenza virus
VETIRGKPEE

SEQ ID NO: 515883 - protein, 10 aa, Influenza virus
VETNHTDELC

SEQ ID NO: 515884 - protein, 10 aa, Influenza virus
VETNHTGTYC

SEQ ID NO: 515885 - protein, 10 aa, Influenza virus
VETRINMINS

SEQ ID NO: 515886 - protein, 10 aa, Influenza virus
VETSHTGTYC

SEQ ID NO: 515887 - protein, 10 aa, Influenza virus
VETYVLSIIP

SEQ ID NO: 515888 - protein, 10 aa, Influenza virus
VETYVLSIVP

SEQ ID NO: 515889 - protein, 10 aa, Influenza virus
VETYVLSVIP

SEQ ID NO: 515890 - protein, 10 aa, Influenza virus
VEVITAQELV

SEQ ID NO: 515891 - protein, 10 aa, Influenza virus
VEVLHLTQGT

SEQ ID NO: 515892 - protein, 10 aa, Influenza virus
VEVTNATELV

SEQ ID NO: 515893 - protein, 10 aa, Influenza virus
VEVVAAQELV

SEQ ID NO: 515894 - protein, 10 aa, Influenza virus
VEVVDATETV

SEQ ID NO: 515895 - protein, 10 aa, Influenza virus
VEVVNATETV

SEQ ID NO: 515896 - protein, 10 aa, Influenza virus
VEVVSAKELV

SEQ ID NO: 515897 - protein, 10 aa, Influenza virus
VEVVTAQELV

SEQ ID NO: 515898 - protein, 10 aa, Influenza virus
VEWSATACHD

SEQ ID NO: 515899 - protein, 10 aa, Influenza virus
VEWTSNSLIA

SEQ ID NO: 515900 - protein, 10 aa, Influenza virus
VEYASKTRIS

SEQ ID NO: 515901 - protein, 10 aa, Influenza virus
VEYDAVATTH

SEQ ID NO: 515902 - protein, 10 aa, Influenza virus
VEYNGKSLGI

SEQ ID NO: 515903 - protein, 10 aa, Influenza virus
VFAGKNADLE

SEQ ID NO: 515904 - protein, 10 aa, Influenza virus
VFAGKNSDLE

SEQ ID NO: 515905 - protein, 10 aa, Influenza virus
VFAGKNTDLE

SEQ ID NO: 515906 - protein, 10 aa, Influenza virus
VFCGASGTYG

SEQ ID NO: 515907 - protein, 10 aa, Influenza virus
VFCGTSGIYG

SEQ ID NO: 515908 - protein, 10 aa, Influenza virus
VFCGTSGNYG

SEQ ID NO: 515909 - protein, 10 aa, Influenza virus
VFCGTSGTYG

SEQ ID NO: 515910 - protein, 10 aa, Influenza virus
VFCGVSGEVP

SEQ ID NO: 515911 - protein, 10 aa, Influenza virus
VFCGVSSEVP

SEQ ID NO: 515912 - protein, 10 aa, Influenza virus
VFCSTSGTYG

SEQ ID NO: 515913 - protein, 10 aa, Influenza virus
VFEFSDERAA

SEQ ID NO: 515914 - protein, 10 aa, Influenza virus
VFELSDEKAA

SEQ ID NO: 515915 - protein, 10 aa, Influenza virus
VFELSDEKAT

SEQ ID NO: 515916 - protein, 10 aa, Influenza virus
VFELSDERAA

SEQ ID NO: 515917 - protein, 10 aa, Influenza virus
VFELSDERAT

SEQ ID NO: 515918 - protein, 10 aa, Influenza virus
VFFCLKNGNM

SEQ ID NO: 515919 - protein, 10 aa, Influenza virus
VFFCLRNGNM

SEQ ID NO: 515920 - protein, 10 aa, Influenza virus
VFICIKNGNM

SEQ ID NO: 515921 - protein, 10 aa, Influenza virus
VFICIKNGNV

SEQ ID NO: 515922 - protein, 10 aa, Influenza virus
VFICVKNGNM

SEQ ID NO: 515923 - protein, 10 aa, Influenza virus
VFIERPTAVD

SEQ ID NO: 515924 - protein, 10 aa, Influenza virus
VFIIREPFVS

SEQ ID NO: 515925 - protein, 10 aa, Influenza virus
VFLAMITYIT

SEQ ID NO: 515926 - protein, 10 aa, Influenza virus
VFLTMITYIT

SEQ ID NO: 515927 - protein, 10 aa, Influenza virus
VFMCVKNGNM

SEQ ID NO: 515928 - protein, 10 aa, Influenza virus
VFNTIGNLIA

SEQ ID NO: 515929 - protein, 10 aa, Influenza virus
VFNTIGNLVA

SEQ ID NO: 515930 - protein, 10 aa, Influenza virus
VFPNEVGAKI

SEQ ID NO: 515931 - protein, 10 aa, Influenza virus
VFPNEVGARI

SEQ ID NO: 515932 - protein, 10 aa, Influenza virus
VFPQLNQTYR

SEQ ID NO: 515933 - protein, 10 aa, Influenza virus
VFREQKQEFK

SEQ ID NO: 515934 - protein, 10 aa, Influenza virus
VFSGKNTDLE

SEQ ID NO: 515935 - protein, 10 aa, Influenza virus
VFSIAASYKR

SEQ ID NO: 515936 - protein, 10 aa, Influenza virus
VFSNAASYKR

SEQ ID NO: 515937 - protein, 10 aa, Influenza virus
VFSQEDCMIK

SEQ ID NO: 515938 - protein, 10 aa, Influenza virus
VFSQEDCMMK

SEQ ID NO: 515939 - protein, 10 aa, Influenza virus
VFSQEDCMVK

SEQ ID NO: 515940 - protein, 10 aa, Influenza virus
VFSQEDRMIK

SEQ ID NO: 515941 - protein, 10 aa, Influenza virus
VFSQEECMIK

SEQ ID NO: 515942 - protein, 10 aa, Influenza virus
VFSSAASYKR

SEQ ID NO: 515943 - protein, 10 aa, Influenza virus
VFTDGSATGP

SEQ ID NO: 515944 - protein, 10 aa, Influenza virus
VFTLTVPSER

SEQ ID NO: 515945 - protein, 10 aa, Influenza virus
VFVALILGFV

SEQ ID NO: 515946 - protein, 10 aa, Influenza virus
VFVIREPFIS

SEQ ID NO: 515947 - protein, 10 aa, Influenza virus
VFVIREPFVA

SEQ ID NO: 515948 - protein, 10 aa, Influenza virus
VFVIREPFVS

SEQ ID NO: 515949 - protein, 10 aa, Influenza virus
VFWTSNSIVA

SEQ ID NO: 515950 - protein, 10 aa, Influenza virus
VGAKILTSES

SEQ ID NO: 515951 - protein, 10 aa, Influenza virus
VGARIITSES

SEQ ID NO: 515952 - protein, 10 aa, Influenza virus
VGARILASES

SEQ ID NO: 515953 - protein, 10 aa, Influenza virus
VGARILTSES

SEQ ID NO: 515954 - protein, 10 aa, Influenza virus
VGARPLVNGQ

SEQ ID NO: 515955 - protein, 10 aa, Influenza virus
VGARPQVNGQ

SEQ ID NO: 515956 - protein, 10 aa, Influenza virus
VGCVILLNPF

SEQ ID NO: 515957 - protein, 10 aa, Influenza virus
VGDTPRNDDG

SEQ ID NO: 515958 - protein, 10 aa, Influenza virus
VGDTPRNDDI

SEQ ID NO: 515959 - protein, 10 aa, Influenza virus
VGDTPRNDDR

SEQ ID NO: 515960 - protein, 10 aa, Influenza virus
VGDTPRNDDS

SEQ ID NO: 515961 - protein, 10 aa, Influenza virus
VGDTPRNEDG

SEQ ID NO: 515962 - protein, 10 aa, Influenza virus
VGDTPRNEDS

SEQ ID NO: 515963 - protein, 10 aa, Influenza virus
VGDTPRNGDS

SEQ ID NO: 515964 - protein, 10 aa, Influenza virus
VGDTPRNNDG

SEQ ID NO: 515965 - protein, 10 aa, Influenza virus
VGDTPRNNDS

SEQ ID NO: 515966 - protein, 10 aa, Influenza virus
VGEAPSPYNS

SEQ ID NO: 515967 - protein, 10 aa, Influenza virus
VGECPRYVKQ

SEQ ID NO: 515968 - protein, 10 aa, Influenza virus
VGEVPSPYNS

SEQ ID NO: 515969 - protein, 10 aa, Influenza virus
VGGIDTNKTF

SEQ ID NO: 515970 - protein, 10 aa, Influenza virus
VGGINTNKTF

SEQ ID NO: 515971 - protein, 10 aa, Influenza virus
VGGINTNRTF

SEQ ID NO: 515972 - protein, 10 aa, Influenza virus
VGGNEKKAKL

SEQ ID NO: 515973 - protein, 10 aa, Influenza virus
VGGSGTDNYG

SEQ ID NO: 515974 - protein, 10 aa, Influenza virus
VGGSGTNNYG

SEQ ID NO: 515975 - protein, 10 aa, Influenza virus
VGIAADKEST

SEQ ID NO: 515976 - protein, 10 aa, Influenza virus
VGIDPFKLLQ

SEQ ID NO: 515977 - protein, 10 aa, Influenza virus
VGIDPFRLLQ

SEQ ID NO: 515978 - protein, 10 aa, Influenza virus
VGINMSKKKS

SEQ ID NO: 515979 - protein, 10 aa, Influenza virus
VGINMSKRKS

SEQ ID NO: 515980 - protein, 10 aa, Influenza virus
VGISSMGEAM

SEQ ID NO: 515981 - protein, 10 aa, Influenza virus
VGISSMMEAM

SEQ ID NO: 515982 - protein, 10 aa, Influenza virus
VGISSMVEAM

SEQ ID NO: 515983 - protein, 10 aa, Influenza virus
VGKCNDPYPG

SEQ ID NO: 515984 - protein, 10 aa, Influenza virus
VGKCNEPYPG

SEQ ID NO: 515985 - protein, 10 aa, Influenza virus
VGKCPKYVKQ

SEQ ID NO: 515986 - protein, 10 aa, Influenza virus
VGKCPRYIKQ

SEQ ID NO: 515987 - protein, 10 aa, Influenza virus
VGKCPRYVKQ

SEQ ID NO: 515988 - protein, 10 aa, Influenza virus
VGKCPRYVRQ

SEQ ID NO: 515989 - protein, 10 aa, Influenza virus
VGLILAFILW

SEQ ID NO: 515990 - protein, 10 aa, Influenza virus
VGLILAFIMW

SEQ ID NO: 515991 - protein, 10 aa, Influenza virus
VGLILSFIMW

SEQ ID NO: 515992 - protein, 10 aa, Influenza virus
VGLILTFIMW

SEQ ID NO: 515993 - protein, 10 aa, Influenza virus
VGLKVSLHLK

SEQ ID NO: 515994 - protein, 10 aa, Influenza virus
VGLLLQIISL

SEQ ID NO: 515995 - protein, 10 aa, Influenza virus
VGLLLQITSL

SEQ ID NO: 515996 - protein, 10 aa, Influenza virus
VGLLLQVTSL

SEQ ID NO: 515997 - protein, 10 aa, Influenza virus
VGLNISLHLK

SEQ ID NO: 515998 - protein, 10 aa, Influenza virus
VGLNVSLHLK

SEQ ID NO: 515999 - protein, 10 aa, Influenza virus
VGLRNTPSID

SEQ ID NO: 516000 - protein, 10 aa, Influenza virus
VGLRNTPSIE

SEQ ID NO: 516001 - protein, 10 aa, Influenza virus
VGLRNTPSVE

SEQ ID NO: 516002 - protein, 10 aa, Influenza virus
VGLVFFCLKN

SEQ ID NO: 516003 - protein, 10 aa, Influenza virus
VGMAADKEST

SEQ ID NO: 516004 - protein, 10 aa, Influenza virus
VGNDNWSGYS

SEQ ID NO: 516005 - protein, 10 aa, Influenza virus
VGNGCFEFYH

SEQ ID NO: 516006 - protein, 10 aa, Influenza virus
VGNLIFNTVI

SEQ ID NO: 516007 - protein, 10 aa, Influenza virus
VGNLVFNTVI

SEQ ID NO: 516008 - protein, 10 aa, Influenza virus
VGNPSCASNI

SEQ ID NO: 516009 - protein, 10 aa, Influenza virus
VGNPSCATNI

SEQ ID NO: 516010 - protein, 10 aa, Influenza virus
VGPGSFPDGA

SEQ ID NO: 516011 - protein, 10 aa, Influenza virus
VGPILSFIMW

SEQ ID NO: 516012 - protein, 10 aa, Influenza virus
VGQCPKYVNK

SEQ ID NO: 516013 - protein, 10 aa, Influenza virus
VGQCPKYVNQ

SEQ ID NO: 516014 - protein, 10 aa, Influenza virus
VGQCPKYVSK

SEQ ID NO: 516015 - protein, 10 aa, Influenza virus
VGQCPKYVSQ

SEQ ID NO: 516016 - protein, 10 aa, Influenza virus
VGQSPNVYQA

SEQ ID NO: 516017 - protein, 10 aa, Influenza virus
VGRCPRYVKQ

SEQ ID NO: 516018 - protein, 10 aa, Influenza virus
VGRMTICIQG

SEQ ID NO: 516019 - protein, 10 aa, Influenza virus
VGRMTICVQG

SEQ ID NO: 516020 - protein, 10 aa, Influenza virus
VGSGSFPDGA

SEQ ID NO: 516021 - protein, 10 aa, Influenza virus
VGSGSFPNGA

SEQ ID NO: 516022 - protein, 10 aa, Influenza virus
VGSRGHVFVI

SEQ ID NO: 516023 - protein, 10 aa, Influenza virus
VGSRINMINS

SEQ ID NO: 516024 - protein, 10 aa, Influenza virus
VGSSKYQQSF

SEQ ID NO: 516025 - protein, 10 aa, Influenza virus
VGSSKYRQSF

SEQ ID NO: 516026 - protein, 10 aa, Influenza virus
VGSSTYHNSF

SEQ ID NO: 516027 - protein, 10 aa, Influenza virus
VGSSTYQNNF

SEQ ID NO: 516028 - protein, 10 aa, Influenza virus
VGSSTYQNSF

SEQ ID NO: 516029 - protein, 10 aa, Influenza virus
VGSSTYQSNF

SEQ ID NO: 516030 - protein, 10 aa, Influenza virus
VGSWSQNILR

SEQ ID NO: 516031 - protein, 10 aa, Influenza virus
VGTAPVLGNY

SEQ ID NO: 516032 - protein, 10 aa, Influenza virus
VGTRWMKIIR

SEQ ID NO: 516033 - protein, 10 aa, Influenza virus
VGTSTLNLRL

SEQ ID NO: 516034 - protein, 10 aa, Influenza virus
VGTSTLNQRL

SEQ ID NO: 516035 - protein, 10 aa, Influenza virus
VGTSTLNQRS

SEQ ID NO: 516036 - protein, 10 aa, Influenza virus
VGVAPSPSNS

SEQ ID NO: 516037 - protein, 10 aa, Influenza virus
VGVDEYSSTE

SEQ ID NO: 516038 - protein, 10 aa, Influenza virus
VGVDPFKLLQ

SEQ ID NO: 516039 - protein, 10 aa, Influenza virus
VGVDPFRLLQ

SEQ ID NO: 516040 - protein, 10 aa, Influenza virus
VGWSATACHD

SEQ ID NO: 516041 - protein, 10 aa, Influenza virus
VGWSSTSCHD

SEQ ID NO: 516042 - protein, 10 aa, Influenza virus
VGWSSTTCHD

SEQ ID NO: 516043 - protein, 10 aa, Influenza virus
VGWTSNSIVV

SEQ ID NO: 516044 - protein, 10 aa, Influenza virus
VGYHANNSTD

SEQ ID NO: 516045 - protein, 10 aa, Influenza virus
VGYHANNSTE

SEQ ID NO: 516046 - protein, 10 aa, Influenza virus
VGYHANNSTK

SEQ ID NO: 516047 - protein, 10 aa, Influenza virus
VGYHSNNSTE

SEQ ID NO: 516048 - protein, 10 aa, Influenza virus
VGYICSGVFG

SEQ ID NO: 516049 - protein, 10 aa, Influenza virus
VGYLCAGIPS

SEQ ID NO: 516050 - protein, 10 aa, Influenza virus
VGYLCAGIPT

SEQ ID NO: 516051 - protein, 10 aa, Influenza virus
VGYLCAGLPS

SEQ ID NO: 516052 - protein, 10 aa, Influenza virus
VGYLSTNSSD

SEQ ID NO: 516053 - protein, 10 aa, Influenza virus
VGYLSTNSSE

SEQ ID NO: 516054 - protein, 10 aa, Influenza virus
VGYLSTNSTE

SEQ ID NO: 516055 - protein, 10 aa, Influenza virus
VHDRIPHRTL

SEQ ID NO: 516056 - protein, 10 aa, Influenza virus
VHFQNQVKIR

SEQ ID NO: 516057 - protein, 10 aa, Influenza virus
VHFRNQIKIR

SEQ ID NO: 516058 - protein, 10 aa, Influenza virus
VHFRNQVKIR

SEQ ID NO: 516059 - protein, 10 aa, Influenza virus
VHFRSQVKIR

SEQ ID NO: 516060 - protein, 10 aa, Influenza virus
VHHPSSDNEQ

SEQ ID NO: 516061 - protein, 10 aa, Influenza virus
VHHPSTDAEQ

SEQ ID NO: 516062 - protein, 10 aa, Influenza virus
VHHPSTDKEQ

SEQ ID NO: 516063 - protein, 10 aa, Influenza virus
VHHPSTDTEQ

SEQ ID NO: 516064 - protein, 10 aa, Influenza virus
VHHSSSLDEQ

SEQ ID NO: 516065 - protein, 10 aa, Influenza virus
VHIGPLSGSA

SEQ ID NO: 516066 - protein, 10 aa, Influenza virus
VHISPLAGSA

SEQ ID NO: 516067 - protein, 10 aa, Influenza virus
VHISPLSGSA

SEQ ID NO: 516068 - protein, 10 aa, Influenza virus
VHKSQLIWMA

SEQ ID NO: 516069 - protein, 10 aa, Influenza virus
VHKSQLVWMA

SEQ ID NO: 516070 - protein, 10 aa, Influenza virus
VHLGDCNFEG

SEQ ID NO: 516071 - protein, 10 aa, Influenza virus
VHLGDCRFEG

SEQ ID NO: 516072 - protein, 10 aa, Influenza virus
VHLGDCSFEG

SEQ ID NO: 516073 - protein, 10 aa, Influenza virus
VHPLTIGECP

SEQ ID NO: 516074 - protein, 10 aa, Influenza virus
VHQILAIYST

SEQ ID NO: 516075 - protein, 10 aa, Influenza virus
VHRNAIGDCP

SEQ ID NO: 516076 - protein, 10 aa, Influenza virus
VHRNTFGDCP

SEQ ID NO: 516077 - protein, 10 aa, Influenza virus
VHRNTIGDCP

SEQ ID NO: 516078 - protein, 10 aa, Influenza virus
VHRSTIGDCP

SEQ ID NO: 516079 - protein, 10 aa, Influenza virus
VHVSPLSGSA

SEQ ID NO: 516080 - protein, 10 aa, Influenza virus
VIAARNIVRR

SEQ ID NO: 516081 - protein, 10 aa, Influenza virus
VIAKDNAIRF

SEQ ID NO: 516082 - protein, 10 aa, Influenza virus
VIAKDNAVRF

SEQ ID NO: 516083 - protein, 10 aa, Influenza virus
VIAQDNAIRF

SEQ ID NO: 516084 - protein, 10 aa, Influenza virus
VIASTTAKAM

SEQ ID NO: 516085 - protein, 10 aa, Influenza virus
VIDGWTTANS

SEQ ID NO: 516086 - protein, 10 aa, Influenza virus
VIEKDNAVRF

SEQ ID NO: 516087 - protein, 10 aa, Influenza virus
VIEKMNIQFT

SEQ ID NO: 516088 - protein, 10 aa, Influenza virus
VIEKMNTQFT

SEQ ID NO: 516089 - protein, 10 aa, Influenza virus
VIGARPQVNG

SEQ ID NO: 516090 - protein, 10 aa, Influenza virus
VIGGWATANS

SEQ ID NO: 516091 - protein, 10 aa, Influenza virus
VIGGWTIANS

SEQ ID NO: 516092 - protein, 10 aa, Influenza virus
VIGGWTTANS

SEQ ID NO: 516093 - protein, 10 aa, Influenza virus
VIHYGGIPTD

SEQ ID NO: 516094 - protein, 10 aa, Influenza virus
VIHYGGMPTD

SEQ ID NO: 516095 - protein, 10 aa, Influenza virus
VIHYGGVPTD

SEQ ID NO: 516096 - protein, 10 aa, Influenza virus
VIITREPYVS

SEQ ID NO: 516097 - protein, 10 aa, Influenza virus
VIKLLPFAAA

SEQ ID NO: 516098 - protein, 10 aa, Influenza virus
VIKNNMINND

SEQ ID NO: 516099 - protein, 10 aa, Influenza virus
VIKNNMVNND

SEQ ID NO: 516100 - protein, 10 aa, Influenza virus
VIKYNGIITD

SEQ ID NO: 516101 - protein, 10 aa, Influenza virus
VILEENTTYK

SEQ ID NO: 516102 - protein, 10 aa, Influenza virus
VILLNPFVSH

SEQ ID NO: 516103 - protein, 10 aa, Influenza virus
VILVLGLSMV

SEQ ID NO: 516104 - protein, 10 aa, Influenza virus
VILWFSFGAS

SEQ ID NO: 516105 - protein, 10 aa, Influenza virus
VILWFSLGAS

SEQ ID NO: 516106 - protein, 10 aa, Influenza virus
VIMEVVFPNE

SEQ ID NO: 516107 - protein, 10 aa, Influenza virus
VIMTDGPANS

SEQ ID NO: 516108 - protein, 10 aa, Influenza virus
VIMTDGPASS

SEQ ID NO: 516109 - protein, 10 aa, Influenza virus
VIMTDGSANS

SEQ ID NO: 516110 - protein, 10 aa, Influenza virus
VIMTDGSASG

SEQ ID NO: 516111 - protein, 10 aa, Influenza virus
VIMTDGSASS

SEQ ID NO: 516112 - protein, 10 aa, Influenza virus
VINDKIDDQI

SEQ ID NO: 516113 - protein, 10 aa, Influenza virus
VINFESTGNL

SEQ ID NO: 516114 - protein, 10 aa, Influenza virus
VINNITTTII

SEQ ID NO: 516115 - protein, 10 aa, Influenza virus
VINNMTTTII

SEQ ID NO: 516116 - protein, 10 aa, Influenza virus
VINNYYNETN

SEQ ID NO: 516117 - protein, 10 aa, Influenza virus
VINTSKPFQN

SEQ ID NO: 516118 - protein, 10 aa, Influenza virus
VINWTKDSIT

SEQ ID NO: 516119 - protein, 10 aa, Influenza virus
VINWTQDAMT

SEQ ID NO: 516120 - protein, 10 aa, Influenza virus
VINWTRDAMT

SEQ ID NO: 516121 - protein, 10 aa, Influenza virus
VINWTRDSII

SEQ ID NO: 516122 - protein, 10 aa, Influenza virus
VINWTRDSIT

SEQ ID NO: 516123 - protein, 10 aa, Influenza virus
VINWTRDSLT

SEQ ID NO: 516124 - protein, 10 aa, Influenza virus
VINWTRDSMT

SEQ ID NO: 516125 - protein, 10 aa, Influenza virus
VINWTRDSVT

SEQ ID NO: 516126 - protein, 10 aa, Influenza virus
VIPLTTTPTK

SEQ ID NO: 516127 - protein, 10 aa, Influenza virus
VIPSGPLKAE

SEQ ID NO: 516128 - protein, 10 aa, Influenza virus
VIREPCISCS

SEQ ID NO: 516129 - protein, 10 aa, Influenza virus
VIREPFISCS

SEQ ID NO: 516130 - protein, 10 aa, Influenza virus
VIREPFVACG

SEQ ID NO: 516131 - protein, 10 aa, Influenza virus
VIREPFVACS

SEQ ID NO: 516132 - protein, 10 aa, Influenza virus
VIREPFVSCG

SEQ ID NO: 516133 - protein, 10 aa, Influenza virus
VIREPFVSCS

SEQ ID NO: 516134 - protein, 10 aa, Influenza virus
VIRNNMINND

SEQ ID NO: 516135 - protein, 10 aa, Influenza virus
VIRSWRKQIL

SEQ ID NO: 516136 - protein, 10 aa, Influenza virus
VISFESTGNL

SEQ ID NO: 516137 - protein, 10 aa, Influenza virus
VISGWTTANS

SEQ ID NO: 516138 - protein, 10 aa, Influenza virus
VITAQELVES

SEQ ID NO: 516139 - protein, 10 aa, Influenza virus
VITDTLKSWK

SEQ ID NO: 516140 - protein, 10 aa, Influenza virus
VIVSKDNGIR

SEQ ID NO: 516141 - protein, 10 aa, Influenza virus
VIVTREPYIS

SEQ ID NO: 516142 - protein, 10 aa, Influenza virus
VIVTREPYVS

SEQ ID NO: 516143 - protein, 10 aa, Influenza virus
VIYGNPKCDI

SEQ ID NO: 516144 - protein, 10 aa, Influenza virus
VIYGNPKCDT

SEQ ID NO: 516145 - protein, 10 aa, Influenza virus
VIYGNPKCDV

SEQ ID NO: 516146 - protein, 10 aa, Influenza virus
VKAVRGDLNF

SEQ ID NO: 516147 - protein, 10 aa, Influenza virus
VKCICRDNWK

SEQ ID NO: 516148 - protein, 10 aa, Influenza virus
VKCVCRDNWK

SEQ ID NO: 516149 - protein, 10 aa, Influenza virus
VKCYQFALGQ

SEQ ID NO: 516150 - protein, 10 aa, Influenza virus
VKDRSPFRTL

SEQ ID NO: 516151 - protein, 10 aa, Influenza virus
VKDRSPYRAL

SEQ ID NO: 516152 - protein, 10 aa, Influenza virus
VKDRSPYRTL

SEQ ID NO: 516153 - protein, 10 aa, Influenza virus
VKEAQDVIME

SEQ ID NO: 516154 - protein, 10 aa, Influenza virus
VKEIGNGCFE

SEQ ID NO: 516155 - protein, 10 aa, Influenza virus
VKELGNGCFE

SEQ ID NO: 516156 - protein, 10 aa, Influenza virus
VKGDKICLGH

SEQ ID NO: 516157 - protein, 10 aa, Influenza virus
VKGDQICIGY

SEQ ID NO: 516158 - protein, 10 aa, Influenza virus
VKGDRICIGY

SEQ ID NO: 516159 - protein, 10 aa, Influenza virus
VKGDYNNTTG

SEQ ID NO: 516160 - protein, 10 aa, Influenza virus
VKGEYNNTTG

SEQ ID NO: 516161 - protein, 10 aa, Influenza virus
VKGFGFRQGD

SEQ ID NO: 516162 - protein, 10 aa, Influenza virus
VKGFGFRQGN

SEQ ID NO: 516163 - protein, 10 aa, Influenza virus
VKGFGFRQGT

SEQ ID NO: 516164 - protein, 10 aa, Influenza virus
VKGFSFRYGD

SEQ ID NO: 516165 - protein, 10 aa, Influenza virus
VKGQSGRISF

SEQ ID NO: 516166 - protein, 10 aa, Influenza virus
VKGRSHLRND

SEQ ID NO: 516167 - protein, 10 aa, Influenza virus
VKGWAFDNGD

SEQ ID NO: 516168 - protein, 10 aa, Influenza virus
VKGWAFDNGN

SEQ ID NO: 516169 - protein, 10 aa, Influenza virus
VKGWAFDSGD

SEQ ID NO: 516170 - protein, 10 aa, Influenza virus
VKGWAFDYGN

SEQ ID NO: 516171 - protein, 10 aa, Influenza virus
VKGWAFDYGS

SEQ ID NO: 516172 - protein, 10 aa, Influenza virus
VKGWAPLSKD

SEQ ID NO: 516173 - protein, 10 aa, Influenza virus
VKHFEKVKIL

SEQ ID NO: 516174 - protein, 10 aa, Influenza virus
VKHFEKVRIL

SEQ ID NO: 516175 - protein, 10 aa, Influenza virus
VKIKTNGNLI

SEQ ID NO: 516176 - protein, 10 aa, Influenza virus
VKIQTNGNLI

SEQ ID NO: 516177 - protein, 10 aa, Influenza virus
VKIQTSGNLI

SEQ ID NO: 516178 - protein, 10 aa, Influenza virus
VKIRRRVDIN

SEQ ID NO: 516179 - protein, 10 aa, Influenza virus
VKIRRRVDMN

SEQ ID NO: 516180 - protein, 10 aa, Influenza virus
VKIRRRVDTN

SEQ ID NO: 516181 - protein, 10 aa, Influenza virus
VKIRRRVDVN

SEQ ID NO: 516182 - protein, 10 aa, Influenza virus
VKKQLRENAE

SEQ ID NO: 516183 - protein, 10 aa, Influenza virus
VKLEENSTYK

SEQ ID NO: 516184 - protein, 10 aa, Influenza virus
VKLEENTSYK

SEQ ID NO: 516185 - protein, 10 aa, Influenza virus
VKLEENTTYK

SEQ ID NO: 516186 - protein, 10 aa, Influenza virus
VKLEENTTYR

SEQ ID NO: 516187 - protein, 10 aa, Influenza virus
VKLSGGYKDI

SEQ ID NO: 516188 - protein, 10 aa, Influenza virus
VKLSGGYKDV

SEQ ID NO: 516189 - protein, 10 aa, Influenza virus
VKLSNMGIYQ

SEQ ID NO: 516190 - protein, 10 aa, Influenza virus
VKLSNMGVYQ

SEQ ID NO: 516191 - protein, 10 aa, Influenza virus
VKLSSGYKDI

SEQ ID NO: 516192 - protein, 10 aa, Influenza virus
VKLSSGYKDV

SEQ ID NO: 516193 - protein, 10 aa, Influenza virus
VKLSSGYKEV

SEQ ID NO: 516194 - protein, 10 aa, Influenza virus
VKLSSGYKNV

SEQ ID NO: 516195 - protein, 10 aa, Influenza virus
VKLSSMGIYQ

SEQ ID NO: 516196 - protein, 10 aa, Influenza virus
VKLSSMGVYQ

SEQ ID NO: 516197 - protein, 10 aa, Influenza virus
VKLYKKLKRE

SEQ ID NO: 516198 - protein, 10 aa, Influenza virus
VKLYRKLKRE

SEQ ID NO: 516199 - protein, 10 aa, Influenza virus
VKMEKIVLLL

SEQ ID NO: 516200 - protein, 10 aa, Influenza virus
VKMFDFIKWN

SEQ ID NO: 516201 - protein, 10 aa, Influenza virus
VKMFDFSKWN

SEQ ID NO: 516202 - protein, 10 aa, Influenza virus
VKMFDFTKWN

SEQ ID NO: 516203 - protein, 10 aa, Influenza virus
VKMKWGMEMR

SEQ ID NO: 516204 - protein, 10 aa, Influenza virus
VKMNPNQKII

SEQ ID NO: 516205 - protein, 10 aa, Influenza virus
VKMQLRDNAK

SEQ ID NO: 516206 - protein, 10 aa, Influenza virus
VKNDDIDQSL

SEQ ID NO: 516207 - protein, 10 aa, Influenza virus
VKNDDVDQSL

SEQ ID NO: 516208 - protein, 10 aa, Influenza virus
VKNDEVDQSL

SEQ ID NO: 516209 - protein, 10 aa, Influenza virus
VKNGNHAVHY

SEQ ID NO: 516210 - protein, 10 aa, Influenza virus
VKNGNLRCTI

SEQ ID NO: 516211 - protein, 10 aa, Influenza virus
VKNGNMQCTI

SEQ ID NO: 516212 - protein, 10 aa, Influenza virus
VKNGNMRCTI

SEQ ID NO: 516213 - protein, 10 aa, Influenza virus
VKNGNMRCTS

SEQ ID NO: 516214 - protein, 10 aa, Influenza virus
VKNGTYDYPK

SEQ ID NO: 516215 - protein, 10 aa, Influenza virus
VKNGTYNYPK

SEQ ID NO: 516216 - protein, 10 aa, Influenza virus
VKNLFDEVKR

SEQ ID NO: 516217 - protein, 10 aa, Influenza virus
VKNLFDEVRR

SEQ ID NO: 516218 - protein, 10 aa, Influenza virus
VKNLHDQIKR

SEQ ID NO: 516219 - protein, 10 aa, Influenza virus
VKNLHEQVKR

SEQ ID NO: 516220 - protein, 10 aa, Influenza virus
VKNLYDKVRL

SEQ ID NO: 516221 - protein, 10 aa, Influenza virus
VKNLYDKVRM

SEQ ID NO: 516222 - protein, 10 aa, Influenza virus
VKNLYDRVRL

SEQ ID NO: 516223 - protein, 10 aa, Influenza virus
VKNLYEKVRL

SEQ ID NO: 516224 - protein, 10 aa, Influenza virus
VKNLYEKVRM

SEQ ID NO: 516225 - protein, 10 aa, Influenza virus
VKNLYNKVRM

SEQ ID NO: 516226 - protein, 10 aa, Influenza virus
VKPLILKDCS

SEQ ID NO: 516227 - protein, 10 aa, Influenza virus
VKPLILRDCS

SEQ ID NO: 516228 - protein, 10 aa, Influenza virus
VKPLILRNCS

SEQ ID NO: 516229 - protein, 10 aa, Influenza virus
VKQDGKSSAC

SEQ ID NO: 516230 - protein, 10 aa, Influenza virus
VKQESLLLAT

SEQ ID NO: 516231 - protein, 10 aa, Influenza virus
VKQESLMLAT

SEQ ID NO: 516232 - protein, 10 aa, Influenza virus
VKQGSLKLAT

SEQ ID NO: 516233 - protein, 10 aa, Influenza virus
VKQGSLMLAT

SEQ ID NO: 516234 - protein, 10 aa, Influenza virus
VKQGSLRLAT

SEQ ID NO: 516235 - protein, 10 aa, Influenza virus
VKQKSILLAT

SEQ ID NO: 516236 - protein, 10 aa, Influenza virus
VKQKSLLLAT

SEQ ID NO: 516237 - protein, 10 aa, Influenza virus
VKQKTLKLAT

SEQ ID NO: 516238 - protein, 10 aa, Influenza virus
VKQNGKSGAC

SEQ ID NO: 516239 - protein, 10 aa, Influenza virus
VKQNGKSSAC

SEQ ID NO: 516240 - protein, 10 aa, Influenza virus
VKQNTLKLAT

SEQ ID NO: 516241 - protein, 10 aa, Influenza virus
VKQSSLPLAL

SEQ ID NO: 516242 - protein, 10 aa, Influenza virus
VKQSTLKLAT

SEQ ID NO: 516243 - protein, 10 aa, Influenza virus
VKQTSLLLAT

SEQ ID NO: 516244 - protein, 10 aa, Influenza virus
VKRGINDRNF

SEQ ID NO: 516245 - protein, 10 aa, Influenza virus
VKRLLRENAE

SEQ ID NO: 516246 - protein, 10 aa, Influenza virus
VKRQLRENAE

SEQ ID NO: 516247 - protein, 10 aa, Influenza virus
VKRRPVAKAG

SEQ ID NO: 516248 - protein, 10 aa, Influenza virus
VKSDKICLGH

SEQ ID NO: 516249 - protein, 10 aa, Influenza virus
VKSDRLVLAI

SEQ ID NO: 516250 - protein, 10 aa, Influenza virus
VKSDRLVLAT

SEQ ID NO: 516251 - protein, 10 aa, Influenza virus
VKSEKLVLAT

SEQ ID NO: 516252 - protein, 10 aa, Influenza virus
VKSERLVLAT

SEQ ID NO: 516253 - protein, 10 aa, Influenza virus
VKSITQTLVS

SEQ ID NO: 516254 - protein, 10 aa, Influenza virus
VKSLYDKVRM

SEQ ID NO: 516255 - protein, 10 aa, Influenza virus
VKSVTQTLVS

SEQ ID NO: 516256 - protein, 10 aa, Influenza virus
VKTLTDNHVE

SEQ ID NO: 516257 - protein, 10 aa, Influenza virus
VKTWAGNILR

SEQ ID NO: 516258 - protein, 10 aa, Influenza virus
VKVDGSSSAC

SEQ ID NO: 516259 - protein, 10 aa, Influenza virus
VKYSRADKIC

SEQ ID NO: 516260 - protein, 10 aa, Influenza virus
VKYVWWTSNS

SEQ ID NO: 516261 - protein, 10 aa, Influenza virus
VLAIYATVAG

SEQ ID NO: 516262 - protein, 10 aa, Influenza virus
VLAIYSCIAS

SEQ ID NO: 516263 - protein, 10 aa, Influenza virus
VLASTTAKAM

SEQ ID NO: 516264 - protein, 10 aa, Influenza virus
VLATGLRNAH

SEQ ID NO: 516265 - protein, 10 aa, Influenza virus
VLATGLRNIP

SEQ ID NO: 516266 - protein, 10 aa, Influenza virus
VLATGLRNVP

SEQ ID NO: 516267 - protein, 10 aa, Influenza virus
VLATGPRNVP

SEQ ID NO: 516268 - protein, 10 aa, Influenza virus
VLDDCSLEGI

SEQ ID NO: 516269 - protein, 10 aa, Influenza virus
VLDDCSLEGL

SEQ ID NO: 516270 - protein, 10 aa, Influenza virus
VLDDCSLKGL

SEQ ID NO: 516271 - protein, 10 aa, Influenza virus
VLDGVTASCL

SEQ ID NO: 516272 - protein, 10 aa, Influenza virus
VLDNKNWSGY

SEQ ID NO: 516273 - protein, 10 aa, Influenza virus
VLEAMAFLED

SEQ ID NO: 516274 - protein, 10 aa, Influenza virus
VLEAMAFLEE

SEQ ID NO: 516275 - protein, 10 aa, Influenza virus
VLEAMAFLEK

SEQ ID NO: 516276 - protein, 10 aa, Influenza virus
VLEAMAFLEN

SEQ ID NO: 516277 - protein, 10 aa, Influenza virus
VLEAMALLEE

SEQ ID NO: 516278 - protein, 10 aa, Influenza virus
VLEDEQMYQK

SEQ ID NO: 516279 - protein, 10 aa, Influenza virus
VLEKNVTVTH

SEQ ID NO: 516280 - protein, 10 aa, Influenza virus
VLELIRMIKR

SEQ ID NO: 516281 - protein, 10 aa, Influenza virus
VLERNVTVTH

SEQ ID NO: 516282 - protein, 10 aa, Influenza virus
VLFQGGHIEE

SEQ ID NO: 516283 - protein, 10 aa, Influenza virus
VLGDCSIAGW

SEQ ID NO: 516284 - protein, 10 aa, Influenza virus
VLGENMAPEK

SEQ ID NO: 516285 - protein, 10 aa, Influenza virus
VLGIINLLIG

SEQ ID NO: 516286 - protein, 10 aa, Influenza virus
VLGLSMVKSD

SEQ ID NO: 516287 - protein, 10 aa, Influenza virus
VLGLSMVRSD

SEQ ID NO: 516288 - protein, 10 aa, Influenza virus
VLGNPKCDLY

SEQ ID NO: 516289 - protein, 10 aa, Influenza virus
VLGVSILNLG

SEQ ID NO: 516290 - protein, 10 aa, Influenza virus
VLGVSVLNLG

SEQ ID NO: 516291 - protein, 10 aa, Influenza virus
VLHLTQGACW

SEQ ID NO: 516292 - protein, 10 aa, Influenza virus
VLHLTQGTCW

SEQ ID NO: 516293 - protein, 10 aa, Influenza virus
VLIAGGLILG

SEQ ID NO: 516294 - protein, 10 aa, Influenza virus
VLIENDRTLD

SEQ ID NO: 516295 - protein, 10 aa, Influenza virus
VLIENERTLD

SEQ ID NO: 516296 - protein, 10 aa, Influenza virus
VLIENQKTLD

SEQ ID NO: 516297 - protein, 10 aa, Influenza virus
VLIGQGDIVL

SEQ ID NO: 516298 - protein, 10 aa, Influenza virus
VLIGQGDVVL

SEQ ID NO: 516299 - protein, 10 aa, Influenza virus
VLINTYQWII

SEQ ID NO: 516300 - protein, 10 aa, Influenza virus
VLKPGQTVKI

SEQ ID NO: 516301 - protein, 10 aa, Influenza virus
VLKSDKRIGS

SEQ ID NO: 516302 - protein, 10 aa, Influenza virus
VLKYKGIITG

SEQ ID NO: 516303 - protein, 10 aa, Influenza virus
VLKYNDIITD

SEQ ID NO: 516304 - protein, 10 aa, Influenza virus
VLKYNGIITD

SEQ ID NO: 516305 - protein, 10 aa, Influenza virus
VLKYNGIITE

SEQ ID NO: 516306 - protein, 10 aa, Influenza virus
VLKYNGIITG

SEQ ID NO: 516307 - protein, 10 aa, Influenza virus
VLKYNGVITD

SEQ ID NO: 516308 - protein, 10 aa, Influenza virus
VLLEDERTLD

SEQ ID NO: 516309 - protein, 10 aa, Influenza virus
VLLENDKTLD

SEQ ID NO: 516310 - protein, 10 aa, Influenza virus
VLLENDKTLN

SEQ ID NO: 516311 - protein, 10 aa, Influenza virus
VLLENDRTLD

SEQ ID NO: 516312 - protein, 10 aa, Influenza virus
VLLENEKTLD

SEQ ID NO: 516313 - protein, 10 aa, Influenza virus
VLLENERTLD

SEQ ID NO: 516314 - protein, 10 aa, Influenza virus
VLLENGRTLD

SEQ ID NO: 516315 - protein, 10 aa, Influenza virus
VLLENGRTLG

SEQ ID NO: 516316 - protein, 10 aa, Influenza virus
VLLENQKILD

SEQ ID NO: 516317 - protein, 10 aa, Influenza virus
VLLENQKPLD

SEQ ID NO: 516318 - protein, 10 aa, Influenza virus
VLLENQKTLD

SEQ ID NO: 516319 - protein, 10 aa, Influenza virus
VLLFMIIGGF

SEQ ID NO: 516320 - protein, 10 aa, Influenza virus
VLLGNQKTLD

SEQ ID NO: 516321 - protein, 10 aa, Influenza virus
VLLGSSPNAY

SEQ ID NO: 516322 - protein, 10 aa, Influenza virus
VLLGTKHSNG

SEQ ID NO: 516323 - protein, 10 aa, Influenza virus
VLLKHRFEII

SEQ ID NO: 516324 - protein, 10 aa, Influenza virus
VLLLMIIGGF

SEQ ID NO: 516325 - protein, 10 aa, Influenza virus
VLLNASWFNS

SEQ ID NO: 516326 - protein, 10 aa, Influenza virus
VLLNDKHSNN

SEQ ID NO: 516327 - protein, 10 aa, Influenza virus
VLLSPEEVSE

SEQ ID NO: 516328 - protein, 10 aa, Influenza virus
VLMENEMTLD

SEQ ID NO: 516329 - protein, 10 aa, Influenza virus
VLMENERTLD

SEQ ID NO: 516330 - protein, 10 aa, Influenza virus
VLMENERTLE

SEQ ID NO: 516331 - protein, 10 aa, Influenza virus
VLMENERTLG

SEQ ID NO: 516332 - protein, 10 aa, Influenza virus
VLMENERTLY

SEQ ID NO: 516333 - protein, 10 aa, Influenza virus
VLNKSLCKVE

SEQ ID NO: 516334 - protein, 10 aa, Influenza virus
VLNLLIGISN

SEQ ID NO: 516335 - protein, 10 aa, Influenza virus
VLNLLIGVSN

SEQ ID NO: 516336 - protein, 10 aa, Influenza virus
VLNNKNWSGY

SEQ ID NO: 516337 - protein, 10 aa, Influenza virus
VLNNMNWSGY

SEQ ID NO: 516338 - protein, 10 aa, Influenza virus
VLNNRNWSGY

SEQ ID NO: 516339 - protein, 10 aa, Influenza virus
VLNTDWSGYS

SEQ ID NO: 516340 - protein, 10 aa, Influenza virus
VLRGFLIIGK

SEQ ID NO: 516341 - protein, 10 aa, Influenza virus
VLRGFLILGK

SEQ ID NO: 516342 - protein, 10 aa, Influenza virus
VLRGFLILGR

SEQ ID NO: 516343 - protein, 10 aa, Influenza virus
VLRTQESECA

SEQ ID NO: 516344 - protein, 10 aa, Influenza virus
VLRVPNALTD

SEQ ID NO: 516345 - protein, 10 aa, Influenza virus
VLSAFDERRN

SEQ ID NO: 516346 - protein, 10 aa, Influenza virus
VLSCIFCLAF

SEQ ID NO: 516347 - protein, 10 aa, Influenza virus
VLSIAPIMFS

SEQ ID NO: 516348 - protein, 10 aa, Influenza virus
VLSIIALLIG

SEQ ID NO: 516349 - protein, 10 aa, Influenza virus
VLSIIPSGPL

SEQ ID NO: 516350 - protein, 10 aa, Influenza virus
VLSIVPSGPL

SEQ ID NO: 516351 - protein, 10 aa, Influenza virus
VLSIYSCIAS

SEQ ID NO: 516352 - protein, 10 aa, Influenza virus
VLSVAPIMFS

SEQ ID NO: 516353 - protein, 10 aa, Influenza virus
VLSVIPSGPL

SEQ ID NO: 516354 - protein, 10 aa, Influenza virus
VLTDNPRPND

SEQ ID NO: 516355 - protein, 10 aa, Influenza virus
VLTDTSRPGD

SEQ ID NO: 516356 - protein, 10 aa, Influenza virus
VLTDTSRPKD

SEQ ID NO: 516357 - protein, 10 aa, Influenza virus
VLTDTSRPSD

SEQ ID NO: 516358 - protein, 10 aa, Influenza virus
VLTGNLQALK

SEQ ID NO: 516359 - protein, 10 aa, Influenza virus
VLTGNLQTLK

SEQ ID NO: 516360 - protein, 10 aa, Influenza virus
VLTGNLQTLR

SEQ ID NO: 516361 - protein, 10 aa, Influenza virus
VLVALENQHT

SEQ ID NO: 516362 - protein, 10 aa, Influenza virus
VLVGLILAFI

SEQ ID NO: 516363 - protein, 10 aa, Influenza virus
VLVGLILSFI

SEQ ID NO: 516364 - protein, 10 aa, Influenza virus
VLVGLILTFI

SEQ ID NO: 516365 - protein, 10 aa, Influenza virus
VLVGPILSFI

SEQ ID NO: 516366 - protein, 10 aa, Influenza virus
VLVIWGIHHP

SEQ ID NO: 516367 - protein, 10 aa, Influenza virus
VLVLMENERT

SEQ ID NO: 516368 - protein, 10 aa, Influenza virus
VLVLWGIHHP

SEQ ID NO: 516369 - protein, 10 aa, Influenza virus
VLVMKRKRDS

SEQ ID NO: 516370 - protein, 10 aa, Influenza virus
VLVMKRKRNS

SEQ ID NO: 516371 - protein, 10 aa, Influenza virus
VLVMWGIHHP

SEQ ID NO: 516372 - protein, 10 aa, Influenza virus
VLVMWGLHHP

SEQ ID NO: 516373 - protein, 10 aa, Influenza virus
VLVNTYQWII

SEQ ID NO: 516374 - protein, 10 aa, Influenza virus
VLVNTYQWVI

SEQ ID NO: 516375 - protein, 10 aa, Influenza virus
VLVTREPYIS

SEQ ID NO: 516376 - protein, 10 aa, Influenza virus
VLVTREPYLS

SEQ ID NO: 516377 - protein, 10 aa, Influenza virus
VLVTREPYVS

SEQ ID NO: 516378 - protein, 10 aa, Influenza virus
VLWACQNGNI

SEQ ID NO: 516379 - protein, 10 aa, Influenza virus
VLWGIHHPDS

SEQ ID NO: 516380 - protein, 10 aa, Influenza virus
VLWGIHHPDT

SEQ ID NO: 516381 - protein, 10 aa, Influenza virus
VLWISFAISC

SEQ ID NO: 516382 - protein, 10 aa, Influenza virus
VLWTSNSIVA

SEQ ID NO: 516383 - protein, 10 aa, Influenza virus
VLWTSNSIVV

SEQ ID NO: 516384 - protein, 10 aa, Influenza virus
VLWTSNSMVA

SEQ ID NO: 516385 - protein, 10 aa, Influenza virus
VLYFWGIHHP

SEQ ID NO: 516386 - protein, 10 aa, Influenza virus
VLYFWGVHHP

SEQ ID NO: 516387 - protein, 10 aa, Influenza virus
VMCVCRDNWH

SEQ ID NO: 516388 - protein, 10 aa, Influenza virus
VMEHTSQYLC

SEQ ID NO: 516389 - protein, 10 aa, Influenza virus
VMELIRMIKR

SEQ ID NO: 516390 - protein, 10 aa, Influenza virus
VMELIRMVKR

SEQ ID NO: 516391 - protein, 10 aa, Influenza virus
VMELVRMIKR

SEQ ID NO: 516392 - protein, 10 aa, Influenza virus
VMGARPQVNG

SEQ ID NO: 516393 - protein, 10 aa, Influenza virus
VMGLVFFCLK

SEQ ID NO: 516394 - protein, 10 aa, Influenza virus
VMGLVFICIK

SEQ ID NO: 516395 - protein, 10 aa, Influenza virus
VMGQASYKIF

SEQ ID NO: 516396 - protein, 10 aa, Influenza virus
VMGQQGRMDY

SEQ ID NO: 516397 - protein, 10 aa, Influenza virus
VMKRKRDSSI

SEQ ID NO: 516398 - protein, 10 aa, Influenza virus
VMKRKRNSSI

SEQ ID NO: 516399 - protein, 10 aa, Influenza virus
VMLLAIAMGL

SEQ ID NO: 516400 - protein, 10 aa, Influenza virus
VMNTSKPFQN

SEQ ID NO: 516401 - protein, 10 aa, Influenza virus
VMNTSKPLQN

SEQ ID NO: 516402 - protein, 10 aa, Influenza virus
VMREPFISCS

SEQ ID NO: 516403 - protein, 10 aa, Influenza virus
VMREPYVSCN

SEQ ID NO: 516404 - protein, 10 aa, Influenza virus
VMTDGNASGK

SEQ ID NO: 516405 - protein, 10 aa, Influenza virus
VMTDGPANKQ

SEQ ID NO: 516406 - protein, 10 aa, Influenza virus
VMTDGPANNQ

SEQ ID NO: 516407 - protein, 10 aa, Influenza virus
VMTDGPANRQ

SEQ ID NO: 516408 - protein, 10 aa, Influenza virus
VMTDGPANSQ

SEQ ID NO: 516409 - protein, 10 aa, Influenza virus
VMTDGPASNQ

SEQ ID NO: 516410 - protein, 10 aa, Influenza virus
VMTDGSASGK

SEQ ID NO: 516411 - protein, 10 aa, Influenza virus
VMTDGSASGQ

SEQ ID NO: 516412 - protein, 10 aa, Influenza virus
VMTDGSASGR

SEQ ID NO: 516413 - protein, 10 aa, Influenza virus
VMTDGSASRK

SEQ ID NO: 516414 - protein, 10 aa, Influenza virus
VMTDGSASSQ

SEQ ID NO: 516415 - protein, 10 aa, Influenza virus
VMTHTSQYIC

SEQ ID NO: 516416 - protein, 10 aa, Influenza virus
VMVGLILAFI

SEQ ID NO: 516417 - protein, 10 aa, Influenza virus
VNATETVEIT

SEQ ID NO: 516418 - protein, 10 aa, Influenza virus
VNATETVERT

SEQ ID NO: 516419 - protein, 10 aa, Influenza virus
VNATETVETA

SEQ ID NO: 516420 - protein, 10 aa, Influenza virus
VNATETVETT

SEQ ID NO: 516421 - protein, 10 aa, Influenza virus
VNATETVETV

SEQ ID NO: 516422 - protein, 10 aa, Influenza virus
VNDRNFWRGE

SEQ ID NO: 516423 - protein, 10 aa, Influenza virus
VNEEALRQKI

SEQ ID NO: 516424 - protein, 10 aa, Influenza virus
VNEGALRQKI

SEQ ID NO: 516425 - protein, 10 aa, Influenza virus
VNESADMSIG

SEQ ID NO: 516426 - protein, 10 aa, Influenza virus
VNFESNGNFI

SEQ ID NO: 516427 - protein, 10 aa, Influenza virus
VNFLSMEFSL

SEQ ID NO: 516428 - protein, 10 aa, Influenza virus
VNFVSMEFSL

SEQ ID NO: 516429 - protein, 10 aa, Influenza virus
VNGALGSPGC

SEQ ID NO: 516430 - protein, 10 aa, Influenza virus
VNGKLNRLIE

SEQ ID NO: 516431 - protein, 10 aa, Influenza virus
VNGPESVLVN

SEQ ID NO: 516432 - protein, 10 aa, Influenza virus
VNGQAGRIDF

SEQ ID NO: 516433 - protein, 10 aa, Influenza virus
VNGQAGRMTF

SEQ ID NO: 516434 - protein, 10 aa, Influenza virus
VNGQFGRIDF

SEQ ID NO: 516435 - protein, 10 aa, Influenza virus
VNGQFGRINF

SEQ ID NO: 516436 - protein, 10 aa, Influenza virus
VNGQRGRIDF

SEQ ID NO: 516437 - protein, 10 aa, Influenza virus
VNGQSGRIDF

SEQ ID NO: 516438 - protein, 10 aa, Influenza virus
VNGQSGRIEF

SEQ ID NO: 516439 - protein, 10 aa, Influenza virus
VNGQSGRINF

SEQ ID NO: 516440 - protein, 10 aa, Influenza virus
VNGQSGRIVF

SEQ ID NO: 516441 - protein, 10 aa, Influenza virus
VNGQTGRIDF

SEQ ID NO: 516442 - protein, 10 aa, Influenza virus
VNGVKLEENS

SEQ ID NO: 516443 - protein, 10 aa, Influenza virus
VNGWYGFRHQ

SEQ ID NO: 516444 - protein, 10 aa, Influenza virus
VNIDRFLRVR

SEQ ID NO: 516445 - protein, 10 aa, Influenza virus
VNKITYGACP

SEQ ID NO: 516446 - protein, 10 aa, Influenza virus
VNKNPYTLVS

SEQ ID NO: 516447 - protein, 10 aa, Influenza virus
VNLGLNIGLH

SEQ ID NO: 516448 - protein, 10 aa, Influenza virus
VNMTNVQNNY

SEQ ID NO: 516449 - protein, 10 aa, Influenza virus
VNNGKGRYGV

SEQ ID NO: 516450 - protein, 10 aa, Influenza virus
VNNIVDKMNR

SEQ ID NO: 516451 - protein, 10 aa, Influenza virus
VNNNNWSGYS

SEQ ID NO: 516452 - protein, 10 aa, Influenza virus
VNNQDWSGYS

SEQ ID NO: 516453 - protein, 10 aa, Influenza virus
VNNQNWSGYS

SEQ ID NO: 516454 - protein, 10 aa, Influenza virus
VNPGDSIIFN

SEQ ID NO: 516455 - protein, 10 aa, Influenza virus
VNPTLLFLEV

SEQ ID NO: 516456 - protein, 10 aa, Influenza virus
VNPTLLFLKI

SEQ ID NO: 516457 - protein, 10 aa, Influenza virus
VNPTLLFLKM

SEQ ID NO: 516458 - protein, 10 aa, Influenza virus
VNPTLLFLKV

SEQ ID NO: 516459 - protein, 10 aa, Influenza virus
VNPTLLFLRV

SEQ ID NO: 516460 - protein, 10 aa, Influenza virus
VNQITGKLNR

SEQ ID NO: 516461 - protein, 10 aa, Influenza virus
VNRANQRLNP

SEQ ID NO: 516462 - protein, 10 aa, Influenza virus
VNRANQRLNT

SEQ ID NO: 516463 - protein, 10 aa, Influenza virus
VNRCFYVELI

SEQ ID NO: 516464 - protein, 10 aa, Influenza virus
VNRFYRTCKL

SEQ ID NO: 516465 - protein, 10 aa, Influenza virus
VNRITYGACP

SEQ ID NO: 516466 - protein, 10 aa, Influenza virus
VNRITYGPCP

SEQ ID NO: 516467 - protein, 10 aa, Influenza virus
VNRITYGVCP

SEQ ID NO: 516468 - protein, 10 aa, Influenza virus
VNRTHQYSEK

SEQ ID NO: 516469 - protein, 10 aa, Influenza virus
VNRTHQYSER

SEQ ID NO: 516470 - protein, 10 aa, Influenza virus
VNSALGSPGC

SEQ ID NO: 516471 - protein, 10 aa, Influenza virus
VNSFSRTELI

SEQ ID NO: 516472 - protein, 10 aa, Influenza virus
VNSIIDKMNI

SEQ ID NO: 516473 - protein, 10 aa, Influenza virus
VNSIIDKMNT

SEQ ID NO: 516474 - protein, 10 aa, Influenza virus
VNSIIGKMNT

SEQ ID NO: 516475 - protein, 10 aa, Influenza virus
VNSIINKMNT

SEQ ID NO: 516476 - protein, 10 aa, Influenza virus
VNSSKPFQNA

SEQ ID NO: 516477 - protein, 10 aa, Influenza virus
VNSSMPFHNI

SEQ ID NO: 516478 - protein, 10 aa, Influenza virus
VNSWHIFSKD

SEQ ID NO: 516479 - protein, 10 aa, Influenza virus
VNSWHILSKD

SEQ ID NO: 516480 - protein, 10 aa, Influenza virus
VNTALLNASC

SEQ ID NO: 516481 - protein, 10 aa, Influenza virus
VNTIIENNVT

SEQ ID NO: 516482 - protein, 10 aa, Influenza virus
VNTIIESNVT

SEQ ID NO: 516483 - protein, 10 aa, Influenza virus
VNTILEKNVT

SEQ ID NO: 516484 - protein, 10 aa, Influenza virus
VNTILSTKAL

SEQ ID NO: 516485 - protein, 10 aa, Influenza virus
VNTLIEQNIP

SEQ ID NO: 516486 - protein, 10 aa, Influenza virus
VNTLIEQNVP

SEQ ID NO: 516487 - protein, 10 aa, Influenza virus
VNTLLENDVP

SEQ ID NO: 516488 - protein, 10 aa, Influenza virus
VNTLSEQNVP

SEQ ID NO: 516489 - protein, 10 aa, Influenza virus
VNTLTEKGIE

SEQ ID NO: 516490 - protein, 10 aa, Influenza virus
VNTLTEKGVE

SEQ ID NO: 516491 - protein, 10 aa, Influenza virus
VNTLTEQNVP

SEQ ID NO: 516492 - protein, 10 aa, Influenza virus
VNTLTEREVE

SEQ ID NO: 516493 - protein, 10 aa, Influenza virus
VNTLTERGIE

SEQ ID NO: 516494 - protein, 10 aa, Influenza virus
VNTLTERGVE

SEQ ID NO: 516495 - protein, 10 aa, Influenza virus
VNTNKTFQNI

SEQ ID NO: 516496 - protein, 10 aa, Influenza virus
VNTNTINRSF

SEQ ID NO: 516497 - protein, 10 aa, Influenza virus
VNTTLSTIAL

SEQ ID NO: 516498 - protein, 10 aa, Influenza virus
VNTVLSIIAL

SEQ ID NO: 516499 - protein, 10 aa, Influenza virus
VNTYQWIIKN

SEQ ID NO: 516500 - protein, 10 aa, Influenza virus
VNTYQWIIRN

SEQ ID NO: 516501 - protein, 10 aa, Influenza virus
VNTYQWVIRN

SEQ ID NO: 516502 - protein, 10 aa, Influenza virus
VNVRGSGLRI

SEQ ID NO: 516503 - protein, 10 aa, Influenza virus
VNVRGSGMRI

SEQ ID NO: 516504 - protein, 10 aa, Influenza virus
VNVRGTGMRI

SEQ ID NO: 516505 - protein, 10 aa, Influenza virus
VNVTHVQNNY

SEQ ID NO: 516506 - protein, 10 aa, Influenza virus
VNVTNVQNDY

SEQ ID NO: 516507 - protein, 10 aa, Influenza virus
VNVTNVQNNY

SEQ ID NO: 516508 - protein, 10 aa, Influenza virus
VNYVSMEFSL

SEQ ID NO: 516509 - protein, 10 aa, Influenza virus
VPASRYLIDM

SEQ ID NO: 516510 - protein, 10 aa, Influenza virus
VPASRYLTDM

SEQ ID NO: 516511 - protein, 10 aa, Influenza virus
VPCFWLEMIR

SEQ ID NO: 516512 - protein, 10 aa, Influenza virus
VPCFWVEMIR

SEQ ID NO: 516513 - protein, 10 aa, Influenza virus
VPDYQSIRSI

SEQ ID NO: 516514 - protein, 10 aa, Influenza virus
VPDYQSLRSI

SEQ ID NO: 516515 - protein, 10 aa, Influenza virus
VPEKIHTRGL

SEQ ID NO: 516516 - protein, 10 aa, Influenza virus
VPEKIRTRGL

SEQ ID NO: 516517 - protein, 10 aa, Influenza virus
VPEKIRVKRR

SEQ ID NO: 516518 - protein, 10 aa, Influenza virus
VPEWSYIIEK

SEQ ID NO: 516519 - protein, 10 aa, Influenza virus
VPEWSYIMEK

SEQ ID NO: 516520 - protein, 10 aa, Influenza virus
VPEWSYIVEK

SEQ ID NO: 516521 - protein, 10 aa, Influenza virus
VPEWSYIVER

SEQ ID NO: 516522 - protein, 10 aa, Influenza virus
VPEYGFKISK

SEQ ID NO: 516523 - protein, 10 aa, Influenza virus
VPEYQSLRSI

SEQ ID NO: 516524 - protein, 10 aa, Influenza virus
VPFHLATKQV

SEQ ID NO: 516525 - protein, 10 aa, Influenza virus
VPFHLGTKQV

SEQ ID NO: 516526 - protein, 10 aa, Influenza virus
VPFHLGTRQV

SEQ ID NO: 516527 - protein, 10 aa, Influenza virus
VPFYLGTKQV

SEQ ID NO: 516528 - protein, 10 aa, Influenza virus
VPGVKGFGFL

SEQ ID NO: 516529 - protein, 10 aa, Influenza virus
VPGWSWDDGA

SEQ ID NO: 516530 - protein, 10 aa, Influenza virus
VPGWSWGDGA

SEQ ID NO: 516531 - protein, 10 aa, Influenza virus
VPGYQSLRSI

SEQ ID NO: 516532 - protein, 10 aa, Influenza virus
VPILNTSQRG

SEQ ID NO: 516533 - protein, 10 aa, Influenza virus
VPKRNRSILN

SEQ ID NO: 516534 - protein, 10 aa, Influenza virus
VPLGSSPNAY

SEQ ID NO: 516535 - protein, 10 aa, Influenza virus
VPLGSSSNAY

SEQ ID NO: 516536 - protein, 10 aa, Influenza virus
VPLVPCEPII

SEQ ID NO: 516537 - protein, 10 aa, Influenza virus
VPNAGTDPNS

SEQ ID NO: 516538 - protein, 10 aa, Influenza virus
VPNALTDDKS

SEQ ID NO: 516539 - protein, 10 aa, Influenza virus
VPNALTDDRS

SEQ ID NO: 516540 - protein, 10 aa, Influenza virus
VPNALTDERS

SEQ ID NO: 516541 - protein, 10 aa, Influenza virus
VPNALTDNRS

SEQ ID NO: 516542 - protein, 10 aa, Influenza virus
VPNGTIVKTI

SEQ ID NO: 516543 - protein, 10 aa, Influenza virus
VPNGTIVRTI

SEQ ID NO: 516544 - protein, 10 aa, Influenza virus
VPNGTKVNTL

SEQ ID NO: 516545 - protein, 10 aa, Influenza virus
VPNGTLVKTI

SEQ ID NO: 516546 - protein, 10 aa, Influenza virus
VPNGTMVKTI

SEQ ID NO: 516547 - protein, 10 aa, Influenza virus
VPNGTVVKTI

SEQ ID NO: 516548 - protein, 10 aa, Influenza virus
VPNIGSRPRV

SEQ ID NO: 516549 - protein, 10 aa, Influenza virus
VPNYQSLRSI

SEQ ID NO: 516550 - protein, 10 aa, Influenza virus
VPPLELGDCS

SEQ ID NO: 516551 - protein, 10 aa, Influenza virus
VPQAQDRGLF

SEQ ID NO: 516552 - protein, 10 aa, Influenza virus
VPQAQNRGLF

SEQ ID NO: 516553 - protein, 10 aa, Influenza virus
VPQIEARGLF

SEQ ID NO: 516554 - protein, 10 aa, Influenza virus
VPQIESRGLF

SEQ ID NO: 516555 - protein, 10 aa, Influenza virus
VPQIQNRGLF

SEQ ID NO: 516556 - protein, 10 aa, Influenza virus
VPQMESRGLF

SEQ ID NO: 516557 - protein, 10 aa, Influenza virus
VPQVQDRGLF

SEQ ID NO: 516558 - protein, 10 aa, Influenza virus
VPQVQNRGLF

SEQ ID NO: 516559 - protein, 10 aa, Influenza virus
VPSERGLQRR

SEQ ID NO: 516560 - protein, 10 aa, Influenza virus
VPSGPLKAEI

SEQ ID NO: 516561 - protein, 10 aa, Influenza virus
VPSIQSRGLF

SEQ ID NO: 516562 - protein, 10 aa, Influenza virus
VPSPYNSRFE

SEQ ID NO: 516563 - protein, 10 aa, Influenza virus
VPSVQSRGLF

SEQ ID NO: 516564 - protein, 10 aa, Influenza virus
VPVGSGSFPD

SEQ ID NO: 516565 - protein, 10 aa, Influenza virus
VPVIGARPQV

SEQ ID NO: 516566 - protein, 10 aa, Influenza virus
VPVMGARPQV

SEQ ID NO: 516567 - protein, 10 aa, Influenza virus
VPVTQAMELV

SEQ ID NO: 516568 - protein, 10 aa, Influenza virus
VPVTQTMELV

SEQ ID NO: 516569 - protein, 10 aa, Influenza virus
VPVTQVEELV

SEQ ID NO: 516570 - protein, 10 aa, Influenza virus
VPVTSSIDLI

SEQ ID NO: 516571 - protein, 10 aa, Influenza virus
VPVTSSIDLV

SEQ ID NO: 516572 - protein, 10 aa, Influenza virus
VPVTSSVDLI

SEQ ID NO: 516573 - protein, 10 aa, Influenza virus
VPVTSSVDLV

SEQ ID NO: 516574 - protein, 10 aa, Influenza virus
VPVTSTIDLI

SEQ ID NO: 516575 - protein, 10 aa, Influenza virus
VPVVGARPLV

SEQ ID NO: 516576 - protein, 10 aa, Influenza virus
VPVVGARPQV

SEQ ID NO: 516577 - protein, 10 aa, Influenza virus
VPVVRARPQV

SEQ ID NO: 516578 - protein, 10 aa, Influenza virus
VQDIIDNDNW

SEQ ID NO: 516579 - protein, 10 aa, Influenza virus
VQDIIDNNNW

SEQ ID NO: 516580 - protein, 10 aa, Influenza virus
VQGFFPFHKD

SEQ ID NO: 516581 - protein, 10 aa, Influenza virus
VQGNNDNATA

SEQ ID NO: 516582 - protein, 10 aa, Influenza virus
VQGNNKNATA

SEQ ID NO: 516583 - protein, 10 aa, Influenza virus
VQGNNNNATA

SEQ ID NO: 516584 - protein, 10 aa, Influenza virus
VQHLEECSCY

SEQ ID NO: 516585 - protein, 10 aa, Influenza virus
VQHPELTGLD

SEQ ID NO: 516586 - protein, 10 aa, Influenza virus
VQHPELTGLN

SEQ ID NO: 516587 - protein, 10 aa, Influenza virus
VQHPELTGMD

SEQ ID NO: 516588 - protein, 10 aa, Influenza virus
VQHPELTGMN

SEQ ID NO: 516589 - protein, 10 aa, Influenza virus
VQHPELTGVD

SEQ ID NO: 516590 - protein, 10 aa, Influenza virus
VQHPEMTGLD

SEQ ID NO: 516591 - protein, 10 aa, Influenza virus
VQIIKLLPFA

SEQ ID NO: 516592 - protein, 10 aa, Influenza virus
VQITGKLNRL

SEQ ID NO: 516593 - protein, 10 aa, Influenza virus
VQMCTELKLN

SEQ ID NO: 516594 - protein, 10 aa, Influenza virus
VQMCTELKLS

SEQ ID NO: 516595 - protein, 10 aa, Influenza virus
VQMQRFRRPD

SEQ ID NO: 516596 - protein, 10 aa, Influenza virus
VQNAISTTFP

SEQ ID NO: 516597 - protein, 10 aa, Influenza virus
VQNALNGNGD

SEQ ID NO: 516598 - protein, 10 aa, Influenza virus
VQNALSGNGD

SEQ ID NO: 516599 - protein, 10 aa, Influenza virus
VQNEFNKACE

SEQ ID NO: 516600 - protein, 10 aa, Influenza virus
VQPAFSVQRN

SEQ ID NO: 516601 - protein, 10 aa, Influenza virus
VQPGDNIIFS

SEQ ID NO: 516602 - protein, 10 aa, Influenza virus
VQPGDNITFS

SEQ ID NO: 516603 - protein, 10 aa, Influenza virus
VQPTFSVQRN

SEQ ID NO: 516604 - protein, 10 aa, Influenza virus
VQPTFSVQRS

SEQ ID NO: 516605 - protein, 10 aa, Influenza virus
VQQTRMDKLT

SEQ ID NO: 516606 - protein, 10 aa, Influenza virus
VQQTRVDKLT

SEQ ID NO: 516607 - protein, 10 aa, Influenza virus
VQQTRVDRLT

SEQ ID NO: 516608 - protein, 10 aa, Influenza virus
VQSEFNKACE

SEQ ID NO: 516609 - protein, 10 aa, Influenza virus
VQSRGLFGAI

SEQ ID NO: 516610 - protein, 10 aa, Influenza virus
VQSYFQLFLV

SEQ ID NO: 516611 - protein, 10 aa, Influenza virus
VQTDEYKNTG

SEQ ID NO: 516612 - protein, 10 aa, Influenza virus
VQTDEYKNTR

SEQ ID NO: 516613 - protein, 10 aa, Influenza virus
VQVDTIMEKN

SEQ ID NO: 516614 - protein, 10 aa, Influenza virus
VQVIKLLPFA

SEQ ID NO: 516615 - protein, 10 aa, Influenza virus
VRARPQVNGQ

SEQ ID NO: 516616 - protein, 10 aa, Influenza virus
VRCICRDNWK

SEQ ID NO: 516617 - protein, 10 aa, Influenza virus
VRCICRDNWR

SEQ ID NO: 516618 - protein, 10 aa, Influenza virus
VRCTCRDNWK

SEQ ID NO: 516619 - protein, 10 aa, Influenza virus
VRCVCRDNWK

SEQ ID NO: 516620 - protein, 10 aa, Influenza virus
VRCVCRDNWM

SEQ ID NO: 516621 - protein, 10 aa, Influenza virus
VRCVCRDNWR

SEQ ID NO: 516622 - protein, 10 aa, Influenza virus
VREGRNPGNA

SEQ ID NO: 516623 - protein, 10 aa, Influenza virus
VREKNVTVTH

SEQ ID NO: 516624 - protein, 10 aa, Influenza virus
VREPFISCSH

SEQ ID NO: 516625 - protein, 10 aa, Influenza virus
VREQQGRMDY

SEQ ID NO: 516626 - protein, 10 aa, Influenza virus
VRESRNPGNA

SEQ ID NO: 516627 - protein, 10 aa, Influenza virus
VREWSYLIED

SEQ ID NO: 516628 - protein, 10 aa, Influenza virus
VRFGESEQII

SEQ ID NO: 516629 - protein, 10 aa, Influenza virus
VRGDLNFVNR

SEQ ID NO: 516630 - protein, 10 aa, Influenza virus
VRGDQICIGY

SEQ ID NO: 516631 - protein, 10 aa, Influenza virus
VRGDQICVGY

SEQ ID NO: 516632 - protein, 10 aa, Influenza virus
VRGDYNNTTG

SEQ ID NO: 516633 - protein, 10 aa, Influenza virus
VRGLSSRISF

SEQ ID NO: 516634 - protein, 10 aa, Influenza virus
VRGNSPAFNY

SEQ ID NO: 516635 - protein, 10 aa, Influenza virus
VRGNSPVFNY

SEQ ID NO: 516636 - protein, 10 aa, Influenza virus
VRGQQGRMDY

SEQ ID NO: 516637 - protein, 10 aa, Influenza virus
VRGQQGTMDY

SEQ ID NO: 516638 - protein, 10 aa, Influenza virus
VRGQQGWMDY

SEQ ID NO: 516639 - protein, 10 aa, Influenza virus
VRGQSGRISF

SEQ ID NO: 516640 - protein, 10 aa, Influenza virus
VRGQSGRVSF

SEQ ID NO: 516641 - protein, 10 aa, Influenza virus
VRHFEKVKIL

SEQ ID NO: 516642 - protein, 10 aa, Influenza virus
VRHQLRDNAK

SEQ ID NO: 516643 - protein, 10 aa, Influenza virus
VRHQLRENAE

SEQ ID NO: 516644 - protein, 10 aa, Influenza virus
VRHRLKITEN

SEQ ID NO: 516645 - protein, 10 aa, Influenza virus
VRIGSKGDVF

SEQ ID NO: 516646 - protein, 10 aa, Influenza virus
VRINNETILE

SEQ ID NO: 516647 - protein, 10 aa, Influenza virus
VRKMMTNSQD

SEQ ID NO: 516648 - protein, 10 aa, Influenza virus
VRKMMTNSRD

SEQ ID NO: 516649 - protein, 10 aa, Influenza virus
VRKMMTSSQD

SEQ ID NO: 516650 - protein, 10 aa, Influenza virus
VRKQLRENAE

SEQ ID NO: 516651 - protein, 10 aa, Influenza virus
VRKQLRQNAE

SEQ ID NO: 516652 - protein, 10 aa, Influenza virus
VRKRFADQEL

SEQ ID NO: 516653 - protein, 10 aa, Influenza virus
VRKTRFLPVA

SEQ ID NO: 516654 - protein, 10 aa, Influenza virus
VRKTRFLPVS

SEQ ID NO: 516655 - protein, 10 aa, Influenza virus
VRKTRFLPVT

SEQ ID NO: 516656 - protein, 10 aa, Influenza virus
VRKTRFLPVV

SEQ ID NO: 516657 - protein, 10 aa, Influenza virus
VRLEENTTYK

SEQ ID NO: 516658 - protein, 10 aa, Influenza virus
VRLFDYSRWN

SEQ ID NO: 516659 - protein, 10 aa, Influenza virus
VRLQLKDNAK

SEQ ID NO: 516660 - protein, 10 aa, Influenza virus
VRLQLKDNAR

SEQ ID NO: 516661 - protein, 10 aa, Influenza virus
VRLQLRDNAK

SEQ ID NO: 516662 - protein, 10 aa, Influenza virus
VRLQLRDNAR

SEQ ID NO: 516663 - protein, 10 aa, Influenza virus
VRLSAGGDIW

SEQ ID NO: 516664 - protein, 10 aa, Influenza virus
VRLSASGDIW

SEQ ID NO: 516665 - protein, 10 aa, Influenza virus
VRLYLWGVHH

SEQ ID NO: 516666 - protein, 10 aa, Influenza virus
VRMIKRGIND

SEQ ID NO: 516667 - protein, 10 aa, Influenza virus
VRMNNETILE

SEQ ID NO: 516668 - protein, 10 aa, Influenza virus
VRMQLKDNAK

SEQ ID NO: 516669 - protein, 10 aa, Influenza virus
VRMQLRDNAK

SEQ ID NO: 516670 - protein, 10 aa, Influenza virus
VRMQLRDNVK

SEQ ID NO: 516671 - protein, 10 aa, Influenza virus
VRNDDIDQSL

SEQ ID NO: 516672 - protein, 10 aa, Influenza virus
VRNDDVDQSL

SEQ ID NO: 516673 - protein, 10 aa, Influenza virus
VRNGTYDHKE

SEQ ID NO: 516674 - protein, 10 aa, Influenza virus
VRNGTYDYPK

SEQ ID NO: 516675 - protein, 10 aa, Influenza virus
VRNLHDQIKR

SEQ ID NO: 516676 - protein, 10 aa, Influenza virus
VRNLHDQVKR

SEQ ID NO: 516677 - protein, 10 aa, Influenza virus
VRNLHDRIRR

SEQ ID NO: 516678 - protein, 10 aa, Influenza virus
VRNLHDRTRR

SEQ ID NO: 516679 - protein, 10 aa, Influenza virus
VRNLHDRVKR

SEQ ID NO: 516680 - protein, 10 aa, Influenza virus
VRNLHDRVRR

SEQ ID NO: 516681 - protein, 10 aa, Influenza virus
VRNLHEQIKR

SEQ ID NO: 516682 - protein, 10 aa, Influenza virus
VRNLHERIRR

SEQ ID NO: 516683 - protein, 10 aa, Influenza virus
VRNLYDKVRL

SEQ ID NO: 516684 - protein, 10 aa, Influenza virus
VRNLYDKVRM

SEQ ID NO: 516685 - protein, 10 aa, Influenza virus
VRNQSGRISI

SEQ ID NO: 516686 - protein, 10 aa, Influenza virus
VRPGDNITFS

SEQ ID NO: 516687 - protein, 10 aa, Influenza virus
VRPGYNGQKS

SEQ ID NO: 516688 - protein, 10 aa, Influenza virus
VRPGYNGQRS

SEQ ID NO: 516689 - protein, 10 aa, Influenza virus
VRPLILKDCS

SEQ ID NO: 516690 - protein, 10 aa, Influenza virus
VRPLILRDCS

SEQ ID NO: 516691 - protein, 10 aa, Influenza virus
VRPRYNGQRS

SEQ ID NO: 516692 - protein, 10 aa, Influenza virus
VRQCFNPMIA

SEQ ID NO: 516693 - protein, 10 aa, Influenza virus
VRQCFNPMII

SEQ ID NO: 516694 - protein, 10 aa, Influenza virus
VRQCFNPMIV

SEQ ID NO: 516695 - protein, 10 aa, Influenza virus
VRQCFNPMTV

SEQ ID NO: 516696 - protein, 10 aa, Influenza virus
VRQCFNPMVV

SEQ ID NO: 516697 - protein, 10 aa, Influenza virus
VRQNTLKLAT

SEQ ID NO: 516698 - protein, 10 aa, Influenza virus
VRRAAVSADP

SEQ ID NO: 516699 - protein, 10 aa, Influenza virus
VRRAIVSADP

SEQ ID NO: 516700 - protein, 10 aa, Influenza virus
VRRATVSADP

SEQ ID NO: 516701 - protein, 10 aa, Influenza virus
VRRDQMAHCR

SEQ ID NO: 516702 - protein, 10 aa, Influenza virus
VRRQLRENAE

SEQ ID NO: 516703 - protein, 10 aa, Influenza virus
VRSDKICLGH

SEQ ID NO: 516704 - protein, 10 aa, Influenza virus
VRSEKLVLAT

SEQ ID NO: 516705 - protein, 10 aa, Influenza virus
VRSGMDPRMC

SEQ ID NO: 516706 - protein, 10 aa, Influenza virus
VRSQSGRISF

SEQ ID NO: 516707 - protein, 10 aa, Influenza virus
VRSWKKQILR

SEQ ID NO: 516708 - protein, 10 aa, Influenza virus
VRSWRKKILR

SEQ ID NO: 516709 - protein, 10 aa, Influenza virus
VRSWRKQILR

SEQ ID NO: 516710 - protein, 10 aa, Influenza virus
VRSWRRQILR

SEQ ID NO: 516711 - protein, 10 aa, Influenza virus
VRTGMDPRMC

SEQ ID NO: 516712 - protein, 10 aa, Influenza virus
VRTLFQQMRD

SEQ ID NO: 516713 - protein, 10 aa, Influenza virus
VRTNGTSKIK

SEQ ID NO: 516714 - protein, 10 aa, Influenza virus
VRTNGTSKVK

SEQ ID NO: 516715 - protein, 10 aa, Influenza virus
VSADPLASLL

SEQ ID NO: 516716 - protein, 10 aa, Influenza virus
VSADPLLSLL

SEQ ID NO: 516717 - protein, 10 aa, Influenza virus
VSADPLVSLL

SEQ ID NO: 516718 - protein, 10 aa, Influenza virus
VSAGGDIWVT

SEQ ID NO: 516719 - protein, 10 aa, Influenza virus
VSAKELVETN

SEQ ID NO: 516720 - protein, 10 aa, Influenza virus
VSCDPDECRF

SEQ ID NO: 516721 - protein, 10 aa, Influenza virus
VSCDPDGCRF

SEQ ID NO: 516722 - protein, 10 aa, Influenza virus
VSCDPLGCKM

SEQ ID NO: 516723 - protein, 10 aa, Influenza virus
VSCDPLGCKT

SEQ ID NO: 516724 - protein, 10 aa, Influenza virus
VSCDPLGCRM

SEQ ID NO: 516725 - protein, 10 aa, Influenza virus
VSCDPNECRF

SEQ ID NO: 516726 - protein, 10 aa, Influenza virus
VSCDPSGCKM

SEQ ID NO: 516727 - protein, 10 aa, Influenza virus
VSCDPTGCKM

SEQ ID NO: 516728 - protein, 10 aa, Influenza virus
VSCEPDECRF

SEQ ID NO: 516729 - protein, 10 aa, Influenza virus
VSCGPSECRT

SEQ ID NO: 516730 - protein, 10 aa, Influenza virus
VSCSHLECRT

SEQ ID NO: 516731 - protein, 10 aa, Influenza virus
VSCVCRDNWQ

SEQ ID NO: 516732 - protein, 10 aa, Influenza virus
VSDGGPNLYN

SEQ ID NO: 516733 - protein, 10 aa, Influenza virus
VSECRTFFLT

SEQ ID NO: 516734 - protein, 10 aa, Influenza virus
VSEWSYIVEK

SEQ ID NO: 516735 - protein, 10 aa, Influenza virus
VSFESNGGLL

SEQ ID NO: 516736 - protein, 10 aa, Influenza virus
VSFHLGTKQV

SEQ ID NO: 516737 - protein, 10 aa, Influenza virus
VSFQGGHIEE

SEQ ID NO: 516738 - protein, 10 aa, Influenza virus
VSFQGRGVFE

SEQ ID NO: 516739 - protein, 10 aa, Influenza virus
VSFRGGHIEE

SEQ ID NO: 516740 - protein, 10 aa, Influenza virus
VSFRGRGVFE

SEQ ID NO: 516741 - protein, 10 aa, Influenza virus
VSFSISCFLL

SEQ ID NO: 516742 - protein, 10 aa, Influenza virus
VSFWMCSNGS

SEQ ID NO: 516743 - protein, 10 aa, Influenza virus
VSFYWTIVEP

SEQ ID NO: 516744 - protein, 10 aa, Influenza virus
VSGADDDAYA

SEQ ID NO: 516745 - protein, 10 aa, Influenza virus
VSGADNDAYA

SEQ ID NO: 516746 - protein, 10 aa, Influenza virus
VSGEVPGWSW

SEQ ID NO: 516747 - protein, 10 aa, Influenza virus
VSGINESADM

SEQ ID NO: 516748 - protein, 10 aa, Influenza virus
VSGPDNGAVA

SEQ ID NO: 516749 - protein, 10 aa, Influenza virus
VSGPNNNASA

SEQ ID NO: 516750 - protein, 10 aa, Influenza virus
VSGTDDDAYA

SEQ ID NO: 516751 - protein, 10 aa, Influenza virus
VSGVNESADM

SEQ ID NO: 516752 - protein, 10 aa, Influenza virus
VSGWLLGNPM

SEQ ID NO: 516753 - protein, 10 aa, Influenza virus
VSHCRATEYI

SEQ ID NO: 516754 - protein, 10 aa, Influenza virus
VSHCRATEYM

SEQ ID NO: 516755 - protein, 10 aa, Influenza virus
VSIDRFLRVK

SEQ ID NO: 516756 - protein, 10 aa, Influenza virus
VSIDRFLRVR

SEQ ID NO: 516757 - protein, 10 aa, Influenza virus
VSIGTSTLNQ

SEQ ID NO: 516758 - protein, 10 aa, Influenza virus
VSKDNGIRIG

SEQ ID NO: 516759 - protein, 10 aa, Influenza virus
VSKDNGIRVG

SEQ ID NO: 516760 - protein, 10 aa, Influenza virus
VSLGAISFWM

SEQ ID NO: 516761 - protein, 10 aa, Influenza virus
VSLGAVSFWM

SEQ ID NO: 516762 - protein, 10 aa, Influenza virus
VSLLQSAILS

SEQ ID NO: 516763 - protein, 10 aa, Influenza virus
VSLSPGMMMG

SEQ ID NO: 516764 - protein, 10 aa, Influenza virus
VSLSYSTGAL

SEQ ID NO: 516765 - protein, 10 aa, Influenza virus
VSMCSSTEFL

SEQ ID NO: 516766 - protein, 10 aa, Influenza virus
VSMEFSLTDP

SEQ ID NO: 516767 - protein, 10 aa, Influenza virus
VSNDNWSGYS

SEQ ID NO: 516768 - protein, 10 aa, Influenza virus
VSNGTKINTL

SEQ ID NO: 516769 - protein, 10 aa, Influenza virus
VSNGTKVNTL

SEQ ID NO: 516770 - protein, 10 aa, Influenza virus
VSNNDWSGYS

SEQ ID NO: 516771 - protein, 10 aa, Influenza virus
VSNSDFICVG

SEQ ID NO: 516772 - protein, 10 aa, Influenza virus
VSNSDFLCVG

SEQ ID NO: 516773 - protein, 10 aa, Influenza virus
VSNSDFMCVG

SEQ ID NO: 516774 - protein, 10 aa, Influenza virus
VSNSDWSGYS

SEQ ID NO: 516775 - protein, 10 aa, Influenza virus
VSNSEFLCVG

SEQ ID NO: 516776 - protein, 10 aa, Influenza virus
VSNTDWSGYS

SEQ ID NO: 516777 - protein, 10 aa, Influenza virus
VSPIHLGDCS

SEQ ID NO: 516778 - protein, 10 aa, Influenza virus
VSPLAVTWWN

SEQ ID NO: 516779 - protein, 10 aa, Influenza virus
VSPLSGSAQH

SEQ ID NO: 516780 - protein, 10 aa, Influenza virus
VSPVHLGDCN

SEQ ID NO: 516781 - protein, 10 aa, Influenza virus
VSPVHLGDCR

SEQ ID NO: 516782 - protein, 10 aa, Influenza virus
VSPVHLGDCS

SEQ ID NO: 516783 - protein, 10 aa, Influenza virus
VSRARIDARI

SEQ ID NO: 516784 - protein, 10 aa, Influenza virus
VSRARIDARV

SEQ ID NO: 516785 - protein, 10 aa, Influenza virus
VSRIAIGNCP

SEQ ID NO: 516786 - protein, 10 aa, Influenza virus
VSRTHQYSEK

SEQ ID NO: 516787 - protein, 10 aa, Influenza virus
VSSEAPGWSW

SEQ ID NO: 516788 - protein, 10 aa, Influenza virus
VSSEVPGCTM

SEQ ID NO: 516789 - protein, 10 aa, Influenza virus
VSSEVPGWSW

SEQ ID NO: 516790 - protein, 10 aa, Influenza virus
VSSFEKFEIF

SEQ ID NO: 516791 - protein, 10 aa, Influenza virus
VSSFERFEIF

SEQ ID NO: 516792 - protein, 10 aa, Influenza virus
VSSFERFEMF

SEQ ID NO: 516793 - protein, 10 aa, Influenza virus
VSSFKRFEIF

SEQ ID NO: 516794 - protein, 10 aa, Influenza virus
VSSFYSEMKW

SEQ ID NO: 516795 - protein, 10 aa, Influenza virus
VSSGLVLVGL

SEQ ID NO: 516796 - protein, 10 aa, Influenza virus
VSSLPFQNIN

SEQ ID NO: 516797 - protein, 10 aa, Influenza virus
VSSLPFQNIS

SEQ ID NO: 516798 - protein, 10 aa, Influenza virus
VSSLPFQSIN

SEQ ID NO: 516799 - protein, 10 aa, Influenza virus
VSSSGTSKAC

SEQ ID NO: 516800 - protein, 10 aa, Influenza virus
VSSSLVLAGL

SEQ ID NO: 516801 - protein, 10 aa, Influenza virus
VSSSLVLVGL

SEQ ID NO: 516802 - protein, 10 aa, Influenza virus
VSSWHILSKD

SEQ ID NO: 516803 - protein, 10 aa, Influenza virus
VSTDKDSNGV

SEQ ID NO: 516804 - protein, 10 aa, Influenza virus
VSTDKNSNGV

SEQ ID NO: 516805 - protein, 10 aa, Influenza virus
VSTKEWSKRY

SEQ ID NO: 516806 - protein, 10 aa, Influenza virus
VSTKEWSRRY

SEQ ID NO: 516807 - protein, 10 aa, Influenza virus
VSTNAYDRIC

SEQ ID NO: 516808 - protein, 10 aa, Influenza virus
VSTQKAINEI

SEQ ID NO: 516809 - protein, 10 aa, Influenza virus
VSTQKALNEI

SEQ ID NO: 516810 - protein, 10 aa, Influenza virus
VSTRSDQISI

SEQ ID NO: 516811 - protein, 10 aa, Influenza virus
VSVGSGSFPD

SEQ ID NO: 516812 - protein, 10 aa, Influenza virus
VSVGTSTLNQ

SEQ ID NO: 516813 - protein, 10 aa, Influenza virus
VSVIREPFIS

SEQ ID NO: 516814 - protein, 10 aa, Influenza virus
VSVRGSGMRI

SEQ ID NO: 516815 - protein, 10 aa, Influenza virus
VSVTDGPAAN

SEQ ID NO: 516816 - protein, 10 aa, Influenza virus
VSWASNSIVT

SEQ ID NO: 516817 - protein, 10 aa, Influenza virus
VSWEMGQAPS

SEQ ID NO: 516818 - protein, 10 aa, Influenza virus
VSWPLSSPPT

SEQ ID NO: 516819 - protein, 10 aa, Influenza virus
VSWSQNILRT

SEQ ID NO: 516820 - protein, 10 aa, Influenza virus
VSWTGNSIVT

SEQ ID NO: 516821 - protein, 10 aa, Influenza virus
VSWTSNSIVT

SEQ ID NO: 516822 - protein, 10 aa, Influenza virus
VSWTSNSMVT

SEQ ID NO: 516823 - protein, 10 aa, Influenza virus
VSYCRATEYI

SEQ ID NO: 516824 - protein, 10 aa, Influenza virus
VTADKDSNGV

SEQ ID NO: 516825 - protein, 10 aa, Influenza virus
VTASCLDKGA

SEQ ID NO: 516826 - protein, 10 aa, Influenza virus
VTASCLDRGA

SEQ ID NO: 516827 - protein, 10 aa, Influenza virus
VTASCLDRGT

SEQ ID NO: 516828 - protein, 10 aa, Influenza virus
VTASCRDNGA

SEQ ID NO: 516829 - protein, 10 aa, Influenza virus
VTCGCRDNWQ

SEQ ID NO: 516830 - protein, 10 aa, Influenza virus
VTCTCRDNWQ

SEQ ID NO: 516831 - protein, 10 aa, Influenza virus
VTCVCRDNWK

SEQ ID NO: 516832 - protein, 10 aa, Influenza virus
VTCVCRDNWQ

SEQ ID NO: 516833 - protein, 10 aa, Influenza virus
VTCVCRDNWR

SEQ ID NO: 516834 - protein, 10 aa, Influenza virus
VTDGPAANNA

SEQ ID NO: 516835 - protein, 10 aa, Influenza virus
VTDGPAANSA

SEQ ID NO: 516836 - protein, 10 aa, Influenza virus
VTDGPSDAQA

SEQ ID NO: 516837 - protein, 10 aa, Influenza virus
VTDIWAYNAE

SEQ ID NO: 516838 - protein, 10 aa, Influenza virus
VTDIWSYNAK

SEQ ID NO: 516839 - protein, 10 aa, Influenza virus
VTDIWSYNAR

SEQ ID NO: 516840 - protein, 10 aa, Influenza virus
VTDSEMDKLF

SEQ ID NO: 516841 - protein, 10 aa, Influenza virus
VTDSEMNKLF

SEQ ID NO: 516842 - protein, 10 aa, Influenza virus
VTDSEMNRLF

SEQ ID NO: 516843 - protein, 10 aa, Influenza virus
VTDSEMSKLF

SEQ ID NO: 516844 - protein, 10 aa, Influenza virus
VTDSIKSWRK

SEQ ID NO: 516845 - protein, 10 aa, Influenza virus
VTDVWSYNAK

SEQ ID NO: 516846 - protein, 10 aa, Influenza virus
VTEINTWARN

SEQ ID NO: 516847 - protein, 10 aa, Influenza virus
VTELWSYNAE

SEQ ID NO: 516848 - protein, 10 aa, Influenza virus
VTETLYLNHT

SEQ ID NO: 516849 - protein, 10 aa, Influenza virus
VTFCGLDNEP

SEQ ID NO: 516850 - protein, 10 aa, Influenza virus
VTFCGLNNEP

SEQ ID NO: 516851 - protein, 10 aa, Influenza virus
VTFIFNGAFI

SEQ ID NO: 516852 - protein, 10 aa, Influenza virus
VTFSFNGAFI

SEQ ID NO: 516853 - protein, 10 aa, Influenza virus
VTFTFNGAFI

SEQ ID NO: 516854 - protein, 10 aa, Influenza virus
VTGDDKNATA

SEQ ID NO: 516855 - protein, 10 aa, Influenza virus
VTGDDRNATA

SEQ ID NO: 516856 - protein, 10 aa, Influenza virus
VTGFAPFSKD

SEQ ID NO: 516857 - protein, 10 aa, Influenza virus
VTGKLNRLIE

SEQ ID NO: 516858 - protein, 10 aa, Influenza virus
VTGKSHGRIL

SEQ ID NO: 516859 - protein, 10 aa, Influenza virus
VTGLRNIPSI

SEQ ID NO: 516860 - protein, 10 aa, Influenza virus
VTGLRNVPSI

SEQ ID NO: 516861 - protein, 10 aa, Influenza virus
VTGYEKNATA

SEQ ID NO: 516862 - protein, 10 aa, Influenza virus
VTHAKDILEK

SEQ ID NO: 516863 - protein, 10 aa, Influenza virus
VTHAKDILER

SEQ ID NO: 516864 - protein, 10 aa, Influenza virus
VTHAKNILEK

SEQ ID NO: 516865 - protein, 10 aa, Influenza virus
VTHAQDILEK

SEQ ID NO: 516866 - protein, 10 aa, Influenza virus
VTHAQDILER

SEQ ID NO: 516867 - protein, 10 aa, Influenza virus
VTHAQDLLEK

SEQ ID NO: 516868 - protein, 10 aa, Influenza virus
VTHAQNILEK

SEQ ID NO: 516869 - protein, 10 aa, Influenza virus
VTHFEKIKIL

SEQ ID NO: 516870 - protein, 10 aa, Influenza virus
VTHFEKVKIL

SEQ ID NO: 516871 - protein, 10 aa, Influenza virus
VTHFQRKRRV

SEQ ID NO: 516872 - protein, 10 aa, Influenza virus
VTHSIELLEN

SEQ ID NO: 516873 - protein, 10 aa, Influenza virus
VTHSIELLES

SEQ ID NO: 516874 - protein, 10 aa, Influenza virus
VTHSVELLED

SEQ ID NO: 516875 - protein, 10 aa, Influenza virus
VTHSVELLEN

SEQ ID NO: 516876 - protein, 10 aa, Influenza virus
VTHSVELLES

SEQ ID NO: 516877 - protein, 10 aa, Influenza virus
VTHTGTSKAC

SEQ ID NO: 516878 - protein, 10 aa, Influenza virus
VTHVQNNYTT

SEQ ID NO: 516879 - protein, 10 aa, Influenza virus
VTIGECPKYV

SEQ ID NO: 516880 - protein, 10 aa, Influenza virus
VTIGKCPKYV

SEQ ID NO: 516881 - protein, 10 aa, Influenza virus
VTKENTGSYV

SEQ ID NO: 516882 - protein, 10 aa, Influenza virus
VTLHFKQHDC

SEQ ID NO: 516883 - protein, 10 aa, Influenza virus
VTLHFKQHEC

SEQ ID NO: 516884 - protein, 10 aa, Influenza virus
VTLHFKQHKC

SEQ ID NO: 516885 - protein, 10 aa, Influenza virus
VTLHFKQNEC

SEQ ID NO: 516886 - protein, 10 aa, Influenza virus
VTLSSGYKDI

SEQ ID NO: 516887 - protein, 10 aa, Influenza virus
VTLTMGYKDI

SEQ ID NO: 516888 - protein, 10 aa, Influenza virus
VTNATELVQG

SEQ ID NO: 516889 - protein, 10 aa, Influenza virus
VTNATELVQI

SEQ ID NO: 516890 - protein, 10 aa, Influenza virus
VTNATELVQN

SEQ ID NO: 516891 - protein, 10 aa, Influenza virus
VTNATELVQS

SEQ ID NO: 516892 - protein, 10 aa, Influenza virus
VTNATETVEN

SEQ ID NO: 516893 - protein, 10 aa, Influenza virus
VTNATETVES

SEQ ID NO: 516894 - protein, 10 aa, Influenza virus
VTNKVNSIID

SEQ ID NO: 516895 - protein, 10 aa, Influenza virus
VTNKVNSIIG

SEQ ID NO: 516896 - protein, 10 aa, Influenza virus
VTNKVNSIIN

SEQ ID NO: 516897 - protein, 10 aa, Influenza virus
VTNVQNDYTT

SEQ ID NO: 516898 - protein, 10 aa, Influenza virus
VTNVQNNYTT

SEQ ID NO: 516899 - protein, 10 aa, Influenza virus
VTQAMELVEA

SEQ ID NO: 516900 - protein, 10 aa, Influenza virus
VTQTLVSNND

SEQ ID NO: 516901 - protein, 10 aa, Influenza virus
VTQTMELVEA

SEQ ID NO: 516902 - protein, 10 aa, Influenza virus
VTQTMELVET

SEQ ID NO: 516903 - protein, 10 aa, Influenza virus
VTQVEELVHG

SEQ ID NO: 516904 - protein, 10 aa, Influenza virus
VTQVEELVHR

SEQ ID NO: 516905 - protein, 10 aa, Influenza virus
VTRELYVSCD

SEQ ID NO: 516906 - protein, 10 aa, Influenza virus
VTREPYISCD

SEQ ID NO: 516907 - protein, 10 aa, Influenza virus
VTREPYLSCD

SEQ ID NO: 516908 - protein, 10 aa, Influenza virus
VTREPYLSCG

SEQ ID NO: 516909 - protein, 10 aa, Influenza virus
VTREPYVSCD

SEQ ID NO: 516910 - protein, 10 aa, Influenza virus
VTREPYVSCE

SEQ ID NO: 516911 - protein, 10 aa, Influenza virus
VTREPYVSCG

SEQ ID NO: 516912 - protein, 10 aa, Influenza virus
VTREPYVSCS

SEQ ID NO: 516913 - protein, 10 aa, Influenza virus
VTRREIHIYY

SEQ ID NO: 516914 - protein, 10 aa, Influenza virus
VTRREVHIYY

SEQ ID NO: 516915 - protein, 10 aa, Influenza virus
VTRREVHMYY

SEQ ID NO: 516916 - protein, 10 aa, Influenza virus
VTRREVHTYY

SEQ ID NO: 516917 - protein, 10 aa, Influenza virus
VTRREVHVYY

SEQ ID NO: 516918 - protein, 10 aa, Influenza virus
VTRSGTSKAC

SEQ ID NO: 516919 - protein, 10 aa, Influenza virus
VTSSGTSKAC

SEQ ID NO: 516920 - protein, 10 aa, Influenza virus
VTSSIDLIET

SEQ ID NO: 516921 - protein, 10 aa, Influenza virus
VTSSIDLVET

SEQ ID NO: 516922 - protein, 10 aa, Influenza virus
VTSSIELVEN

SEQ ID NO: 516923 - protein, 10 aa, Influenza virus
VTSSVDLIET

SEQ ID NO: 516924 - protein, 10 aa, Influenza virus
VTSSVDLVET

SEQ ID NO: 516925 - protein, 10 aa, Influenza virus
VTSSVELVEN

SEQ ID NO: 516926 - protein, 10 aa, Influenza virus
VTSSVELVET

SEQ ID NO: 516927 - protein, 10 aa, Influenza virus
VTSTIDLIET

SEQ ID NO: 516928 - protein, 10 aa, Influenza virus
VTTHFHRKRR

SEQ ID NO: 516929 - protein, 10 aa, Influenza virus
VTTHFQRKRR

SEQ ID NO: 516930 - protein, 10 aa, Influenza virus
VTTNTINRIF

SEQ ID NO: 516931 - protein, 10 aa, Influenza virus
VTTNTINRNF

SEQ ID NO: 516932 - protein, 10 aa, Influenza virus
VTTNTINRSF

SEQ ID NO: 516933 - protein, 10 aa, Influenza virus
VTTRQASPSC

SEQ ID NO: 516934 - protein, 10 aa, Influenza virus
VTTVGWSWPD

SEQ ID NO: 516935 - protein, 10 aa, Influenza virus
VTTVTLHFKQ

SEQ ID NO: 516936 - protein, 10 aa, Influenza virus
VTVIKNNMIN

SEQ ID NO: 516937 - protein, 10 aa, Influenza virus
VTVIKNNMVN

SEQ ID NO: 516938 - protein, 10 aa, Influenza virus
VTVIRNNMIN

SEQ ID NO: 516939 - protein, 10 aa, Influenza virus
VTVSTRSDQI

SEQ ID NO: 516940 - protein, 10 aa, Influenza virus
VTVTDGPAAN

SEQ ID NO: 516941 - protein, 10 aa, Influenza virus
VTVTHAKDIL

SEQ ID NO: 516942 - protein, 10 aa, Influenza virus
VTVTHAKNIL

SEQ ID NO: 516943 - protein, 10 aa, Influenza virus
VTVTHAQDIL

SEQ ID NO: 516944 - protein, 10 aa, Influenza virus
VTVTHAQDLL

SEQ ID NO: 516945 - protein, 10 aa, Influenza virus
VTVTHAQNIL

SEQ ID NO: 516946 - protein, 10 aa, Influenza virus
VTVTHAVNLL

SEQ ID NO: 516947 - protein, 10 aa, Influenza virus
VTVTHSIELL

SEQ ID NO: 516948 - protein, 10 aa, Influenza virus
VTVTHSINLL

SEQ ID NO: 516949 - protein, 10 aa, Influenza virus
VTVTHSVDLL

SEQ ID NO: 516950 - protein, 10 aa, Influenza virus
VTVTHSVELL

SEQ ID NO: 516951 - protein, 10 aa, Influenza virus
VTVTHSVNIL

SEQ ID NO: 516952 - protein, 10 aa, Influenza virus
VTVTHSVNLF

SEQ ID NO: 516953 - protein, 10 aa, Influenza virus
VTVTHSVNLL

SEQ ID NO: 516954 - protein, 10 aa, Influenza virus
VTVTSSIELV

SEQ ID NO: 516955 - protein, 10 aa, Influenza virus
VTVTSSVELV

SEQ ID NO: 516956 - protein, 10 aa, Influenza virus
VTYNNTVINN

SEQ ID NO: 516957 - protein, 10 aa, Influenza virus
VTYQILSIYS

SEQ ID NO: 516958 - protein, 10 aa, Influenza virus
VTYTGISKAC

SEQ ID NO: 516959 - protein, 10 aa, Influenza virus
VTYTGTSKAC

SEQ ID NO: 516960 - protein, 10 aa, Influenza virus
VTYTGTSRAC

SEQ ID NO: 516961 - protein, 10 aa, Influenza virus
VVAAQELVES

SEQ ID NO: 516962 - protein, 10 aa, Influenza virus
VVAKDNAIRF

SEQ ID NO: 516963 - protein, 10 aa, Influenza virus
VVAMVFSQED

SEQ ID NO: 516964 - protein, 10 aa, Influenza virus
VVAVTDGPAA

SEQ ID NO: 516965 - protein, 10 aa, Influenza virus
VVAVTDGPAD

SEQ ID NO: 516966 - protein, 10 aa, Influenza virus
VVCVCRDNWH

SEQ ID NO: 516967 - protein, 10 aa, Influenza virus
VVDATETVER

SEQ ID NO: 516968 - protein, 10 aa, Influenza virus
VVEKMNTQFT

SEQ ID NO: 516969 - protein, 10 aa, Influenza virus
VVENKYVNNT

SEQ ID NO: 516970 - protein, 10 aa, Influenza virus
VVENTYVNNT

SEQ ID NO: 516971 - protein, 10 aa, Influenza virus
VVFCGASGTY

SEQ ID NO: 516972 - protein, 10 aa, Influenza virus
VVFCGTPGTY

SEQ ID NO: 516973 - protein, 10 aa, Influenza virus
VVFCGTSATY

SEQ ID NO: 516974 - protein, 10 aa, Influenza virus
VVFCGTSGIY

SEQ ID NO: 516975 - protein, 10 aa, Influenza virus
VVFCGTSGTC

SEQ ID NO: 516976 - protein, 10 aa, Influenza virus
VVFCGTSGTY

SEQ ID NO: 516977 - protein, 10 aa, Influenza virus
VVFPNEVGAK

SEQ ID NO: 516978 - protein, 10 aa, Influenza virus
VVFPNEVGAR

SEQ ID NO: 516979 - protein, 10 aa, Influenza virus
VVFTDGSATG

SEQ ID NO: 516980 - protein, 10 aa, Influenza virus
VVGARPQVNG

SEQ ID NO: 516981 - protein, 10 aa, Influenza virus
VVGDRPLVNG

SEQ ID NO: 516982 - protein, 10 aa, Influenza virus
VVHISPLSGS

SEQ ID NO: 516983 - protein, 10 aa, Influenza virus
VVIAKDNAIR

SEQ ID NO: 516984 - protein, 10 aa, Influenza virus
VVIAKDNAVR

SEQ ID NO: 516985 - protein, 10 aa, Influenza virus
VVIAQDNAIR

SEQ ID NO: 516986 - protein, 10 aa, Influenza virus
VVIEKDNAVR

SEQ ID NO: 516987 - protein, 10 aa, Influenza virus
VVIMTDGPAN

SEQ ID NO: 516988 - protein, 10 aa, Influenza virus
VVIMTDGPAS

SEQ ID NO: 516989 - protein, 10 aa, Influenza virus
VVIMTDGSAS

SEQ ID NO: 516990 - protein, 10 aa, Influenza virus
VVITDGSASG

SEQ ID NO: 516991 - protein, 10 aa, Influenza virus
VVLNTDWSGY

SEQ ID NO: 516992 - protein, 10 aa, Influenza virus
VVLVGLILAF

SEQ ID NO: 516993 - protein, 10 aa, Influenza virus
VVLVMKRKRD

SEQ ID NO: 516994 - protein, 10 aa, Influenza virus
VVLVMKRKRN

SEQ ID NO: 516995 - protein, 10 aa, Influenza virus
VVMTDGNASG

SEQ ID NO: 516996 - protein, 10 aa, Influenza virus
VVMTDGPANN

SEQ ID NO: 516997 - protein, 10 aa, Influenza virus
VVMTDGPASS

SEQ ID NO: 516998 - protein, 10 aa, Influenza virus
VVMTDGSALG

SEQ ID NO: 516999 - protein, 10 aa, Influenza virus
VVMTDGSASD

SEQ ID NO: 517000 - protein, 10 aa, Influenza virus
VVMTDGSASE

SEQ ID NO: 517001 - protein, 10 aa, Influenza virus
VVMTDGSASG

SEQ ID NO: 517002 - protein, 10 aa, Influenza virus
VVMTDGSASR

SEQ ID NO: 517003 - protein, 10 aa, Influenza virus
VVMTDGSASS

SEQ ID NO: 517004 - protein, 10 aa, Influenza virus
VVMTDGSVSG

SEQ ID NO: 517005 - protein, 10 aa, Influenza virus
VVNATETVEI

SEQ ID NO: 517006 - protein, 10 aa, Influenza virus
VVNATETVEN

SEQ ID NO: 517007 - protein, 10 aa, Influenza virus
VVNATETVEQ

SEQ ID NO: 517008 - protein, 10 aa, Influenza virus
VVNATETVER

SEQ ID NO: 517009 - protein, 10 aa, Influenza virus
VVNATETVET

SEQ ID NO: 517010 - protein, 10 aa, Influenza virus
VVNFLSMEFS

SEQ ID NO: 517011 - protein, 10 aa, Influenza virus
VVNFVSMEFS

SEQ ID NO: 517012 - protein, 10 aa, Influenza virus
VVNIDRFLRV

SEQ ID NO: 517013 - protein, 10 aa, Influenza virus
VVNNITTTII

SEQ ID NO: 517014 - protein, 10 aa, Influenza virus
VVNNITTTIV

SEQ ID NO: 517015 - protein, 10 aa, Influenza virus
VVNTALSTIA

SEQ ID NO: 517016 - protein, 10 aa, Influenza virus
VVNTTLSTIA

SEQ ID NO: 517017 - protein, 10 aa, Influenza virus
VVNYVSMEFS

SEQ ID NO: 517018 - protein, 10 aa, Influenza virus
VVPEYGFKIS

SEQ ID NO: 517019 - protein, 10 aa, Influenza virus
VVRARPQVNG

SEQ ID NO: 517020 - protein, 10 aa, Influenza virus
VVREPFISCS

SEQ ID NO: 517021 - protein, 10 aa, Influenza virus
VVRKMMTNSQ

SEQ ID NO: 517022 - protein, 10 aa, Influenza virus
VVRKMMTNSR

SEQ ID NO: 517023 - protein, 10 aa, Influenza virus
VVRKMMTSSQ

SEQ ID NO: 517024 - protein, 10 aa, Influenza virus
VVRSWKKQIL

SEQ ID NO: 517025 - protein, 10 aa, Influenza virus
VVRSWRKKIL

SEQ ID NO: 517026 - protein, 10 aa, Influenza virus
VVRSWRKQIL

SEQ ID NO: 517027 - protein, 10 aa, Influenza virus
VVRSWRRQIL

SEQ ID NO: 517028 - protein, 10 aa, Influenza virus
VVSAKELVET

SEQ ID NO: 517029 - protein, 10 aa, Influenza virus
VVSIDRFLRV

SEQ ID NO: 517030 - protein, 10 aa, Influenza virus
VVSLGAISFW

SEQ ID NO: 517031 - protein, 10 aa, Influenza virus
VVTAQELVEA

SEQ ID NO: 517032 - protein, 10 aa, Influenza virus
VVTAQELVES

SEQ ID NO: 517033 - protein, 10 aa, Influenza virus
VVTREPYVSC

SEQ ID NO: 517034 - protein, 10 aa, Influenza virus
VVTVTDGPAA

SEQ ID NO: 517035 - protein, 10 aa, Influenza virus
VVVAKDNAIR

SEQ ID NO: 517036 - protein, 10 aa, Influenza virus
VVVAKDNAVR

SEQ ID NO: 517037 - protein, 10 aa, Influenza virus
VVVFCGTSGT

SEQ ID NO: 517038 - protein, 10 aa, Influenza virus
VVVMTDGPAN

SEQ ID NO: 517039 - protein, 10 aa, Influenza virus
VVVMTDGSAS

SEQ ID NO: 517040 - protein, 10 aa, Influenza virus
VVYAELLVAM

SEQ ID NO: 517041 - protein, 10 aa, Influenza virus
VWACQRGNIR

SEQ ID NO: 517042 - protein, 10 aa, Influenza virus
VWAYNAELLV

SEQ ID NO: 517043 - protein, 10 aa, Influenza virus
VWDANGWVST

SEQ ID NO: 517044 - protein, 10 aa, Influenza virus
VWDDNGWVST

SEQ ID NO: 517045 - protein, 10 aa, Influenza virus
VWGVHHSSSL

SEQ ID NO: 517046 - protein, 10 aa, Influenza virus
VWIGRTKSLE

SEQ ID NO: 517047 - protein, 10 aa, Influenza virus
VWLENEKTLD

SEQ ID NO: 517048 - protein, 10 aa, Influenza virus
VWLGRTVSIN

SEQ ID NO: 517049 - protein, 10 aa, Influenza virus
VWLGRTVSIS

SEQ ID NO: 517050 - protein, 10 aa, Influenza virus
VWLGRTVSNS

SEQ ID NO: 517051 - protein, 10 aa, Influenza virus
VWLGRTVSTS

SEQ ID NO: 517052 - protein, 10 aa, Influenza virus
VWLWLVLREK

SEQ ID NO: 517053 - protein, 10 aa, Influenza virus
VWMACHSAAF

SEQ ID NO: 517054 - protein, 10 aa, Influenza virus
VWMACNSAAF

SEQ ID NO: 517055 - protein, 10 aa, Influenza virus
VWMGRTISKD

SEQ ID NO: 517056 - protein, 10 aa, Influenza virus
VWMGRTISMD

SEQ ID NO: 517057 - protein, 10 aa, Influenza virus
VWMGRTISRD

SEQ ID NO: 517058 - protein, 10 aa, Influenza virus
VWSYNAELLI

SEQ ID NO: 517059 - protein, 10 aa, Influenza virus
VWSYNAELLV

SEQ ID NO: 517060 - protein, 10 aa, Influenza virus
VWSYNAKLLV

SEQ ID NO: 517061 - protein, 10 aa, Influenza virus
VWTSGSIISF

SEQ ID NO: 517062 - protein, 10 aa, Influenza virus
VWTSGSSISF

SEQ ID NO: 517063 - protein, 10 aa, Influenza virus
VWTYNAEILV

SEQ ID NO: 517064 - protein, 10 aa, Influenza virus
VWTYNAELFV

SEQ ID NO: 517065 - protein, 10 aa, Influenza virus
VWTYNAELLI

SEQ ID NO: 517066 - protein, 10 aa, Influenza virus
VWTYNAELLV

SEQ ID NO: 517067 - protein, 10 aa, Influenza virus
VWTYNAEVLV

SEQ ID NO: 517068 - protein, 10 aa, Influenza virus
VWTYNTELLV

SEQ ID NO: 517069 - protein, 10 aa, Influenza virus
VWTYNVELLV

SEQ ID NO: 517070 - protein, 10 aa, Influenza virus
VWVTREPYVS

SEQ ID NO: 517071 - protein, 10 aa, Influenza virus
VWWASNSLIA

SEQ ID NO: 517072 - protein, 10 aa, Influenza virus
VWWTSNSIAV

SEQ ID NO: 517073 - protein, 10 aa, Influenza virus
VWWTSNSIIS

SEQ ID NO: 517074 - protein, 10 aa, Influenza virus
VWWTSNSIIV

SEQ ID NO: 517075 - protein, 10 aa, Influenza virus
VWWTSNSIVA

SEQ ID NO: 517076 - protein, 10 aa, Influenza virus
VWWTSNSIVS

SEQ ID NO: 517077 - protein, 10 aa, Influenza virus
VWWTSNSIVV

SEQ ID NO: 517078 - protein, 10 aa, Influenza virus
VWWTSNSLIA

SEQ ID NO: 517079 - protein, 10 aa, Influenza virus
VWWTSNSLVA

SEQ ID NO: 517080 - protein, 10 aa, Influenza virus
VWWTSNSVVV

SEQ ID NO: 517081 - protein, 10 aa, Influenza virus
VWWTSTSIVV

SEQ ID NO: 517082 - protein, 10 aa, Influenza virus
VWWTTNSIVV

SEQ ID NO: 517083 - protein, 10 aa, Influenza virus
VYAELLVAME

SEQ ID NO: 517084 - protein, 10 aa, Influenza virus
VYCICRDNWK

SEQ ID NO: 517085 - protein, 10 aa, Influenza virus
VYCVCRDNWK

SEQ ID NO: 517086 - protein, 10 aa, Influenza virus
VYIEVLHLTQ

SEQ ID NO: 517087 - protein, 10 aa, Influenza virus
VYINTALLNA

SEQ ID NO: 517088 - protein, 10 aa, Influenza virus
VYINTALLNS

SEQ ID NO: 517089 - protein, 10 aa, Influenza virus
VYINTAMLNA

SEQ ID NO: 517090 - protein, 10 aa, Influenza virus
VYKALSIYSC

SEQ ID NO: 517091 - protein, 10 aa, Influenza virus
VYKILSIYSC

SEQ ID NO: 517092 - protein, 10 aa, Influenza virus
VYKVLAIYSC

SEQ ID NO: 517093 - protein, 10 aa, Influenza virus
VYKVLSIYSC

SEQ ID NO: 517094 - protein, 10 aa, Influenza virus
VYMNTALLNA

SEQ ID NO: 517095 - protein, 10 aa, Influenza virus
VYNNTTGRDV

SEQ ID NO: 517096 - protein, 10 aa, Influenza virus
VYQAKFEAVA

SEQ ID NO: 517097 - protein, 10 aa, Influenza virus
VYQAKFESVA

SEQ ID NO: 517098 - protein, 10 aa, Influenza virus
VYQARFEAVA

SEQ ID NO: 517099 - protein, 10 aa, Influenza virus
VYQARFESVA

SEQ ID NO: 517100 - protein, 10 aa, Influenza virus
VYQILAIYAT

SEQ ID NO: 517101 - protein, 10 aa, Influenza virus
VYQILAIYST

SEQ ID NO: 517102 - protein, 10 aa, Influenza virus
VYQILSIYST

SEQ ID NO: 517103 - protein, 10 aa, Influenza virus
VYQILVIYAT

SEQ ID NO: 517104 - protein, 10 aa, Influenza virus
VYQSRFEAVA

SEQ ID NO: 517105 - protein, 10 aa, Influenza virus
VYRALSIYSC

SEQ ID NO: 517106 - protein, 10 aa, Influenza virus
VYRDNWKGSN

SEQ ID NO: 517107 - protein, 10 aa, Influenza virus
VYVDGFEPNG

SEQ ID NO: 517108 - protein, 10 aa, Influenza virus
VYVEVLHLTQ

SEQ ID NO: 517109 - protein, 10 aa, Influenza virus
VYVNTALLNA

SEQ ID NO: 517110 - protein, 10 aa, Influenza virus
VYWTIVKPGD

SEQ ID NO: 517111 - protein, 10 aa, Influenza virus
VYWTVVKPGD

SEQ ID NO: 517112 - protein, 10 aa, Influenza virus
VYWWDGLQSS

SEQ ID NO: 517113 - protein, 10 aa, Influenza virus
VYYDRRLTTT

SEQ ID NO: 517114 - protein, 10 aa, Influenza virus
VYYNGRLTTT

SEQ ID NO: 517115 - protein, 10 aa, Influenza virus
VYYNKRLTTT

SEQ ID NO: 517116 - protein, 10 aa, Influenza virus
VYYNRRLTTT

SEQ ID NO: 517117 - protein, 10 aa, Influenza virus
VYYNRRPTTT

SEQ ID NO: 517118 - protein, 10 aa, Influenza virus
WACGNGSCRC

SEQ ID NO: 517119 - protein, 10 aa, Influenza virus
WACNNGSCRC

SEQ ID NO: 517120 - protein, 10 aa, Influenza virus
WACNSGNCRF

SEQ ID NO: 517121 - protein, 10 aa, Influenza virus
WACQKGNIKC

SEQ ID NO: 517122 - protein, 10 aa, Influenza virus
WACQKGNIRC

SEQ ID NO: 517123 - protein, 10 aa, Influenza virus
WACQNGNIRC

SEQ ID NO: 517124 - protein, 10 aa, Influenza virus
WACQNGNIRW

SEQ ID NO: 517125 - protein, 10 aa, Influenza virus
WACQNGNLRC

SEQ ID NO: 517126 - protein, 10 aa, Influenza virus
WACQNGNVRC

SEQ ID NO: 517127 - protein, 10 aa, Influenza virus
WACQRGNIRC

SEQ ID NO: 517128 - protein, 10 aa, Influenza virus
WACSNGNCRF

SEQ ID NO: 517129 - protein, 10 aa, Influenza virus
WACSNGSCRC

SEQ ID NO: 517130 - protein, 10 aa, Influenza virus
WACSNGSCRF

SEQ ID NO: 517131 - protein, 10 aa, Influenza virus
WACSSGNCRF

SEQ ID NO: 517132 - protein, 10 aa, Influenza virus
WAEGDCYRAC

SEQ ID NO: 517133 - protein, 10 aa, Influenza virus
WAEGECYRAC

SEQ ID NO: 517134 - protein, 10 aa, Influenza virus
WAGKILRTQE

SEQ ID NO: 517135 - protein, 10 aa, Influenza virus
WAGNILRTQE

SEQ ID NO: 517136 - protein, 10 aa, Influenza virus
WAIHHPPTSA

SEQ ID NO: 517137 - protein, 10 aa, Influenza virus
WAIHHPPTSD

SEQ ID NO: 517138 - protein, 10 aa, Influenza virus
WAIHHPPTSN

SEQ ID NO: 517139 - protein, 10 aa, Influenza virus
WAIHHPPTTD

SEQ ID NO: 517140 - protein, 10 aa, Influenza virus
WAILKPGQTV

SEQ ID NO: 517141 - protein, 10 aa, Influenza virus
WAIRTRSGGN

SEQ ID NO: 517142 - protein, 10 aa, Influenza virus
WAKEECYRAC

SEQ ID NO: 517143 - protein, 10 aa, Influenza virus
WAKGDCYRAC

SEQ ID NO: 517144 - protein, 10 aa, Influenza virus
WAKGECYRAC

SEQ ID NO: 517145 - protein, 10 aa, Influenza virus
WAKNILRTQE

SEQ ID NO: 517146 - protein, 10 aa, Influenza virus
WALGENMAPE

SEQ ID NO: 517147 - protein, 10 aa, Influenza virus
WAPLSKDNGI

SEQ ID NO: 517148 - protein, 10 aa, Influenza virus
WARNILRTQD

SEQ ID NO: 517149 - protein, 10 aa, Influenza virus
WARNILRTQE

SEQ ID NO: 517150 - protein, 10 aa, Influenza virus
WASGSSISFC

SEQ ID NO: 517151 - protein, 10 aa, Influenza virus
WASNSIVTFC

SEQ ID NO: 517152 - protein, 10 aa, Influenza virus
WASNSLIALC

SEQ ID NO: 517153 - protein, 10 aa, Influenza virus
WAVGRCPRYV

SEQ ID NO: 517154 - protein, 10 aa, Influenza virus
WAVLKPGQTV

SEQ ID NO: 517155 - protein, 10 aa, Influenza virus
WAYNAELIVL

SEQ ID NO: 517156 - protein, 10 aa, Influenza virus
WAYNAELLVL

SEQ ID NO: 517157 - protein, 10 aa, Influenza virus
WCGMIDGWYG

SEQ ID NO: 517158 - protein, 10 aa, Influenza virus
WCKIVTTVGW

SEQ ID NO: 517159 - protein, 10 aa, Influenza virus
WDANGWVSTD

SEQ ID NO: 517160 - protein, 10 aa, Influenza virus
WDANGWVTAD

SEQ ID NO: 517161 - protein, 10 aa, Influenza virus
WDDGAILPFD

SEQ ID NO: 517162 - protein, 10 aa, Influenza virus
WDDGAILPLT

SEQ ID NO: 517163 - protein, 10 aa, Influenza virus
WDGLQSSDDF

SEQ ID NO: 517164 - protein, 10 aa, Influenza virus
WDSFRQSERG

SEQ ID NO: 517165 - protein, 10 aa, Influenza virus
WDTINFESTG

SEQ ID NO: 517166 - protein, 10 aa, Influenza virus
WDTISFESTG

SEQ ID NO: 517167 - protein, 10 aa, Influenza virus
WDTLIERDNA

SEQ ID NO: 517168 - protein, 10 aa, Influenza virus
WDTLIERDNS

SEQ ID NO: 517169 - protein, 10 aa, Influenza virus
WDTLIERENA

SEQ ID NO: 517170 - protein, 10 aa, Influenza virus
WDTLIERENS

SEQ ID NO: 517171 - protein, 10 aa, Influenza virus
WDTLIERGSS

SEQ ID NO: 517172 - protein, 10 aa, Influenza virus
WDVFIERPTA

SEQ ID NO: 517173 - protein, 10 aa, Influenza virus
WDVINFESTG

SEQ ID NO: 517174 - protein, 10 aa, Influenza virus
WDVISFESTG

SEQ ID NO: 517175 - protein, 10 aa, Influenza virus
WDWPDGAKIE

SEQ ID NO: 517176 - protein, 10 aa, Influenza virus
WEGLIDGWYG

SEQ ID NO: 517177 - protein, 10 aa, Influenza virus
WEGLINGWYG

SEQ ID NO: 517178 - protein, 10 aa, Influenza virus
WEGLVDGWYG

SEQ ID NO: 517179 - protein, 10 aa, Influenza virus
WEGMIDGWYG

SEQ ID NO: 517180 - protein, 10 aa, Influenza virus
WEGMMDGWYG

SEQ ID NO: 517181 - protein, 10 aa, Influenza virus
WEGMVDGWYG

SEQ ID NO: 517182 - protein, 10 aa, Influenza virus
WEGMVNGWYG

SEQ ID NO: 517183 - protein, 10 aa, Influenza virus
WEGNILRTQE

SEQ ID NO: 517184 - protein, 10 aa, Influenza virus
WEINGPDSVL

SEQ ID NO: 517185 - protein, 10 aa, Influenza virus
WEINGPESVL

SEQ ID NO: 517186 - protein, 10 aa, Influenza virus
WEKNCTLIDA

SEQ ID NO: 517187 - protein, 10 aa, Influenza virus
WEMGLAPSPY

SEQ ID NO: 517188 - protein, 10 aa, Influenza virus
WEMGQAPSPY

SEQ ID NO: 517189 - protein, 10 aa, Influenza virus
WEQLYTPGGE

SEQ ID NO: 517190 - protein, 10 aa, Influenza virus
WEQMYTPGGE

SEQ ID NO: 517191 - protein, 10 aa, Influenza virus
WEQMYTPGGG

SEQ ID NO: 517192 - protein, 10 aa, Influenza virus
WEQMYTPGGK

SEQ ID NO: 517193 - protein, 10 aa, Influenza virus
WETTGRNCTV

SEQ ID NO: 517194 - protein, 10 aa, Influenza virus
WEVNGPESVL

SEQ ID NO: 517195 - protein, 10 aa, Influenza virus
WFGYFGIFFV

SEQ ID NO: 517196 - protein, 10 aa, Influenza virus
WFRNILSIAP

SEQ ID NO: 517197 - protein, 10 aa, Influenza virus
WFRNILSMAP

SEQ ID NO: 517198 - protein, 10 aa, Influenza virus
WFRNVLSIAP

SEQ ID NO: 517199 - protein, 10 aa, Influenza virus
WFRNVLSVAP

SEQ ID NO: 517200 - protein, 10 aa, Influenza virus
WFSFGASCFI

SEQ ID NO: 517201 - protein, 10 aa, Influenza virus
WFSFGASCFL

SEQ ID NO: 517202 - protein, 10 aa, Influenza virus
WFSFGASCFT

SEQ ID NO: 517203 - protein, 10 aa, Influenza virus
WFSFGASCFV

SEQ ID NO: 517204 - protein, 10 aa, Influenza virus
WFSFGASCLI

SEQ ID NO: 517205 - protein, 10 aa, Influenza virus
WFSFGASCVM

SEQ ID NO: 517206 - protein, 10 aa, Influenza virus
WFSFGASSFV

SEQ ID NO: 517207 - protein, 10 aa, Influenza virus
WFSHYNQMKQ

SEQ ID NO: 517208 - protein, 10 aa, Influenza virus
WFSHYNQMTQ

SEQ ID NO: 517209 - protein, 10 aa, Influenza virus
WFSHYNQVAQ

SEQ ID NO: 517210 - protein, 10 aa, Influenza virus
WFSHYNQVTQ

SEQ ID NO: 517211 - protein, 10 aa, Influenza virus
WFSLGASCFL

SEQ ID NO: 517212 - protein, 10 aa, Influenza virus
WGDGAILPFD

SEQ ID NO: 517213 - protein, 10 aa, Influenza virus
WGDILDGVTA

SEQ ID NO: 517214 - protein, 10 aa, Influenza virus
WGDILEGTTA

SEQ ID NO: 517215 - protein, 10 aa, Influenza virus
WGDVLDGVTA

SEQ ID NO: 517216 - protein, 10 aa, Influenza virus
WGIHHPDSET

SEQ ID NO: 517217 - protein, 10 aa, Influenza virus
WGIHHPDTEA

SEQ ID NO: 517218 - protein, 10 aa, Influenza virus
WGIHHPDTEE

SEQ ID NO: 517219 - protein, 10 aa, Influenza virus
WGIHHPDTET

SEQ ID NO: 517220 - protein, 10 aa, Influenza virus
WGIHHPPDAK

SEQ ID NO: 517221 - protein, 10 aa, Influenza virus
WGIHHPPDET

SEQ ID NO: 517222 - protein, 10 aa, Influenza virus
WGIHHPPDTK

SEQ ID NO: 517223 - protein, 10 aa, Influenza virus
WGIHHPPNTK

SEQ ID NO: 517224 - protein, 10 aa, Influenza virus
WGIHHPSSAQ

SEQ ID NO: 517225 - protein, 10 aa, Influenza virus
WGIHHPSSTK

SEQ ID NO: 517226 - protein, 10 aa, Influenza virus
WGIHHPSSTQ

SEQ ID NO: 517227 - protein, 10 aa, Influenza virus
WGILKRGETL

SEQ ID NO: 517228 - protein, 10 aa, Influenza virus
WGMELRRCLL

SEQ ID NO: 517229 - protein, 10 aa, Influenza virus
WGMEMRRCLL

SEQ ID NO: 517230 - protein, 10 aa, Influenza virus
WGMGQAPSPY

SEQ ID NO: 517231 - protein, 10 aa, Influenza virus
WGNGCFEFYH

SEQ ID NO: 517232 - protein, 10 aa, Influenza virus
WGNVLDGVTA

SEQ ID NO: 517233 - protein, 10 aa, Influenza virus
WGVHHPSSDN

SEQ ID NO: 517234 - protein, 10 aa, Influenza virus
WGVHHPSTDA

SEQ ID NO: 517235 - protein, 10 aa, Influenza virus
WGVHHPSTDK

SEQ ID NO: 517236 - protein, 10 aa, Influenza virus
WGVHHPSTDT

SEQ ID NO: 517237 - protein, 10 aa, Influenza virus
WGVHHSSSLD

SEQ ID NO: 517238 - protein, 10 aa, Influenza virus
WHASNRPWIS

SEQ ID NO: 517239 - protein, 10 aa, Influenza virus
WHASNRPWVS

SEQ ID NO: 517240 - protein, 10 aa, Influenza virus
WHDGAEIIYF

SEQ ID NO: 517241 - protein, 10 aa, Influenza virus
WHDGAEITYF

SEQ ID NO: 517242 - protein, 10 aa, Influenza virus
WHGANRPWVS

SEQ ID NO: 517243 - protein, 10 aa, Influenza virus
WHGSNRPWIS

SEQ ID NO: 517244 - protein, 10 aa, Influenza virus
WHGSNRPWLS

SEQ ID NO: 517245 - protein, 10 aa, Influenza virus
WHGSNRPWVS

SEQ ID NO: 517246 - protein, 10 aa, Influenza virus
WHIFGKDNAI

SEQ ID NO: 517247 - protein, 10 aa, Influenza virus
WHIFGKDNAV

SEQ ID NO: 517248 - protein, 10 aa, Influenza virus
WHIFSKDNAI

SEQ ID NO: 517249 - protein, 10 aa, Influenza virus
WHILSKDNAI

SEQ ID NO: 517250 - protein, 10 aa, Influenza virus
WHILSKDNAV

SEQ ID NO: 517251 - protein, 10 aa, Influenza virus
WHIYGKDNAI

SEQ ID NO: 517252 - protein, 10 aa, Influenza virus
WHIYGKDNAV

SEQ ID NO: 517253 - protein, 10 aa, Influenza virus
WHLMHPGERI

SEQ ID NO: 517254 - protein, 10 aa, Influenza virus
WHLMRPGERI

SEQ ID NO: 517255 - protein, 10 aa, Influenza virus
WHLMRPGERT

SEQ ID NO: 517256 - protein, 10 aa, Influenza virus
WHLMSPGERI

SEQ ID NO: 517257 - protein, 10 aa, Influenza virus
WHSNLNDATY

SEQ ID NO: 517258 - protein, 10 aa, Influenza virus
WHSNLNDTTY

SEQ ID NO: 517259 - protein, 10 aa, Influenza virus
WHVRKRFADQ

SEQ ID NO: 517260 - protein, 10 aa, Influenza virus
WICMGHHAVA

SEQ ID NO: 517261 - protein, 10 aa, Influenza virus
WIDSPNHAKS

SEQ ID NO: 517262 - protein, 10 aa, Influenza virus
WIEFDEIGED

SEQ ID NO: 517263 - protein, 10 aa, Influenza virus
WIELDEIGED

SEQ ID NO: 517264 - protein, 10 aa, Influenza virus
WIELIRGRPK

SEQ ID NO: 517265 - protein, 10 aa, Influenza virus
WIGRTKSLES

SEQ ID NO: 517266 - protein, 10 aa, Influenza virus
WIKTRPILSP

SEQ ID NO: 517267 - protein, 10 aa, Influenza virus
WILGNPMCDD

SEQ ID NO: 517268 - protein, 10 aa, Influenza virus
WILGNPMCDE

SEQ ID NO: 517269 - protein, 10 aa, Influenza virus
WILGNPMCDN

SEQ ID NO: 517270 - protein, 10 aa, Influenza virus
WILGNPMCDY

SEQ ID NO: 517271 - protein, 10 aa, Influenza virus
WILGNPRCDD

SEQ ID NO: 517272 - protein, 10 aa, Influenza virus
WILWISFAIS

SEQ ID NO: 517273 - protein, 10 aa, Influenza virus
WILWISFAMS

SEQ ID NO: 517274 - protein, 10 aa, Influenza virus
WILWISFATS

SEQ ID NO: 517275 - protein, 10 aa, Influenza virus
WINSPNHAKS

SEQ ID NO: 517276 - protein, 10 aa, Influenza virus
WINSPNHVKS

SEQ ID NO: 517277 - protein, 10 aa, Influenza virus
WINSPSQAKS

SEQ ID NO: 517278 - protein, 10 aa, Influenza virus
WIPKRNRSIL

SEQ ID NO: 517279 - protein, 10 aa, Influenza virus
WIQNEFNKAC

SEQ ID NO: 517280 - protein, 10 aa, Influenza virus
WIQSEFNKAC

SEQ ID NO: 517281 - protein, 10 aa, Influenza virus
WIRFNSDLDY

SEQ ID NO: 517282 - protein, 10 aa, Influenza virus
WIRFNSDLNY

SEQ ID NO: 517283 - protein, 10 aa, Influenza virus
WIRFNSNLDY

SEQ ID NO: 517284 - protein, 10 aa, Influenza virus
WIRINNETIL

SEQ ID NO: 517285 - protein, 10 aa, Influenza virus
WISFAISCFL

SEQ ID NO: 517286 - protein, 10 aa, Influenza virus
WISFAMSCFL

SEQ ID NO: 517287 - protein, 10 aa, Influenza virus
WISFATSCFL

SEQ ID NO: 517288 - protein, 10 aa, Influenza virus
WISFSISCFL

SEQ ID NO: 517289 - protein, 10 aa, Influenza virus
WISFSMSCFV

SEQ ID NO: 517290 - protein, 10 aa, Influenza virus
WITIGISGPD

SEQ ID NO: 517291 - protein, 10 aa, Influenza virus
WITREPYVSC

SEQ ID NO: 517292 - protein, 10 aa, Influenza virus
WIVGNPSCAS

SEQ ID NO: 517293 - protein, 10 aa, Influenza virus
WIVGNPSCAT

SEQ ID NO: 517294 - protein, 10 aa, Influenza virus
WKGANRPIIT

SEQ ID NO: 517295 - protein, 10 aa, Influenza virus
WKGANRPVII

SEQ ID NO: 517296 - protein, 10 aa, Influenza virus
WKGANRPVIT

SEQ ID NO: 517297 - protein, 10 aa, Influenza virus
WKGGSIKTKL

SEQ ID NO: 517298 - protein, 10 aa, Influenza virus
WKGGSINTKL

SEQ ID NO: 517299 - protein, 10 aa, Influenza virus
WKGNIMRTQE

SEQ ID NO: 517300 - protein, 10 aa, Influenza virus
WKGSNRPIID

SEQ ID NO: 517301 - protein, 10 aa, Influenza virus
WKGSNRPIVD

SEQ ID NO: 517302 - protein, 10 aa, Influenza virus
WKGSNRPVID

SEQ ID NO: 517303 - protein, 10 aa, Influenza virus
WKGSNRPVVD

SEQ ID NO: 517304 - protein, 10 aa, Influenza virus
WKGSNRPWIR

SEQ ID NO: 517305 - protein, 10 aa, Influenza virus
WKGSNRPWMR

SEQ ID NO: 517306 - protein, 10 aa, Influenza virus
WKGSNRPWVR

SEQ ID NO: 517307 - protein, 10 aa, Influenza virus
WKHVTNTILL

SEQ ID NO: 517308 - protein, 10 aa, Influenza virus
WKKQILRTQE

SEQ ID NO: 517309 - protein, 10 aa, Influenza virus
WLELDEIGED

SEQ ID NO: 517310 - protein, 10 aa, Influenza virus
WLEMIRGKPE

SEQ ID NO: 517311 - protein, 10 aa, Influenza virus
WLEMIRGKPK

SEQ ID NO: 517312 - protein, 10 aa, Influenza virus
WLEMIRGRPE

SEQ ID NO: 517313 - protein, 10 aa, Influenza virus
WLENEKTLDL

SEQ ID NO: 517314 - protein, 10 aa, Influenza virus
WLGRTFSPRS

SEQ ID NO: 517315 - protein, 10 aa, Influenza virus
WLGRTINTAS

SEQ ID NO: 517316 - protein, 10 aa, Influenza virus
WLGRTISIAS

SEQ ID NO: 517317 - protein, 10 aa, Influenza virus
WLGRTISKDL

SEQ ID NO: 517318 - protein, 10 aa, Influenza virus
WLGRTISKDS

SEQ ID NO: 517319 - protein, 10 aa, Influenza virus
WLGRTISKDT

SEQ ID NO: 517320 - protein, 10 aa, Influenza virus
WLGRTISPHS

SEQ ID NO: 517321 - protein, 10 aa, Influenza virus
WLGRTISPKL

SEQ ID NO: 517322 - protein, 10 aa, Influenza virus
WLGRTISPRL

SEQ ID NO: 517323 - protein, 10 aa, Influenza virus
WLGRTISPRS

SEQ ID NO: 517324 - protein, 10 aa, Influenza virus
WLGRTISTAS

SEQ ID NO: 517325 - protein, 10 aa, Influenza virus
WLGRTTSKDS

SEQ ID NO: 517326 - protein, 10 aa, Influenza virus
WLGRTTSTAS

SEQ ID NO: 517327 - protein, 10 aa, Influenza virus
WLGRTVSING

SEQ ID NO: 517328 - protein, 10 aa, Influenza virus
WLGRTVSISG

SEQ ID NO: 517329 - protein, 10 aa, Influenza virus
WLGRTVSNSG

SEQ ID NO: 517330 - protein, 10 aa, Influenza virus
WLGRTVSTSG

SEQ ID NO: 517331 - protein, 10 aa, Influenza virus
WLHICVTGDD

SEQ ID NO: 517332 - protein, 10 aa, Influenza virus
WLHVCITGDD

SEQ ID NO: 517333 - protein, 10 aa, Influenza virus
WLHVCVTGDD

SEQ ID NO: 517334 - protein, 10 aa, Influenza virus
WLIDQSGTYP

SEQ ID NO: 517335 - protein, 10 aa, Influenza virus
WLIHQSETYP

SEQ ID NO: 517336 - protein, 10 aa, Influenza virus
WLIHQSGTYP

SEQ ID NO: 517337 - protein, 10 aa, Influenza virus
WLIYQSGTYP

SEQ ID NO: 517338 - protein, 10 aa, Influenza virus
WLKPQCQITG

SEQ ID NO: 517339 - protein, 10 aa, Influenza virus
WLKTRPILSP

SEQ ID NO: 517340 - protein, 10 aa, Influenza virus
WLLGNPECDI

SEQ ID NO: 517341 - protein, 10 aa, Influenza virus
WLLGNPECDL

SEQ ID NO: 517342 - protein, 10 aa, Influenza virus
WLLGNPECDR

SEQ ID NO: 517343 - protein, 10 aa, Influenza virus
WLLGNPKCDR

SEQ ID NO: 517344 - protein, 10 aa, Influenza virus
WLLGNPLCDE

SEQ ID NO: 517345 - protein, 10 aa, Influenza virus
WLLGNPMCDA

SEQ ID NO: 517346 - protein, 10 aa, Influenza virus
WLLGNPMCDE

SEQ ID NO: 517347 - protein, 10 aa, Influenza virus
WLLGNPMCDK

SEQ ID NO: 517348 - protein, 10 aa, Influenza virus
WLLSSKANQV

SEQ ID NO: 517349 - protein, 10 aa, Influenza virus
WLLSSKDNQV

SEQ ID NO: 517350 - protein, 10 aa, Influenza virus
WLSSSGNNQV

SEQ ID NO: 517351 - protein, 10 aa, Influenza virus
WLSSSMNNQV

SEQ ID NO: 517352 - protein, 10 aa, Influenza virus
WLTIGISGPD

SEQ ID NO: 517353 - protein, 10 aa, Influenza virus
WLTIGITGPD

SEQ ID NO: 517354 - protein, 10 aa, Influenza virus
WLTIGVSGPD

SEQ ID NO: 517355 - protein, 10 aa, Influenza virus
WLTKATNGNY

SEQ ID NO: 517356 - protein, 10 aa, Influenza virus
WLTKETNGNY

SEQ ID NO: 517357 - protein, 10 aa, Influenza virus
WLTKKEPDTY

SEQ ID NO: 517358 - protein, 10 aa, Influenza virus
WLTKKKNPEA

SEQ ID NO: 517359 - protein, 10 aa, Influenza virus
WLTKKKPDIY

SEQ ID NO: 517360 - protein, 10 aa, Influenza virus
WLTKKKPDTY

SEQ ID NO: 517361 - protein, 10 aa, Influenza virus
WLTLGITGPD

SEQ ID NO: 517362 - protein, 10 aa, Influenza virus
WLTLKLGQFP

SEQ ID NO: 517363 - protein, 10 aa, Influenza virus
WLTLKSEQFP

SEQ ID NO: 517364 - protein, 10 aa, Influenza virus
WLTLKSGQFP

SEQ ID NO: 517365 - protein, 10 aa, Influenza virus
WLVHQSGTYP

SEQ ID NO: 517366 - protein, 10 aa, Influenza virus
WLWLVLREKM

SEQ ID NO: 517367 - protein, 10 aa, Influenza virus
WMACHSAAFE

SEQ ID NO: 517368 - protein, 10 aa, Influenza virus
WMACNSAAFE

SEQ ID NO: 517369 - protein, 10 aa, Influenza virus
WMCFNGSLQC

SEQ ID NO: 517370 - protein, 10 aa, Influenza virus
WMCLNGSMQC

SEQ ID NO: 517371 - protein, 10 aa, Influenza virus
WMCPNGSLQC

SEQ ID NO: 517372 - protein, 10 aa, Influenza virus
WMCSGHSCRI

SEQ ID NO: 517373 - protein, 10 aa, Influenza virus
WMCSNGSLHG

SEQ ID NO: 517374 - protein, 10 aa, Influenza virus
WMCSNGSLQC

SEQ ID NO: 517375 - protein, 10 aa, Influenza virus
WMCSNGSLRC

SEQ ID NO: 517376 - protein, 10 aa, Influenza virus
WMCSNGSMQC

SEQ ID NO: 517377 - protein, 10 aa, Influenza virus
WMCSNGSYNA

SEQ ID NO: 517378 - protein, 10 aa, Influenza virus
WMCSNSSMQC

SEQ ID NO: 517379 - protein, 10 aa, Influenza virus
WMDYYWGILK

SEQ ID NO: 517380 - protein, 10 aa, Influenza virus
WMELDEIGED

SEQ ID NO: 517381 - protein, 10 aa, Influenza virus
WMGRTISKDS

SEQ ID NO: 517382 - protein, 10 aa, Influenza virus
WMGRTISMDS

SEQ ID NO: 517383 - protein, 10 aa, Influenza virus
WMGRTISRDS

SEQ ID NO: 517384 - protein, 10 aa, Influenza virus
WMKIIRVGCV

SEQ ID NO: 517385 - protein, 10 aa, Influenza virus
WMKIYWHLMH

SEQ ID NO: 517386 - protein, 10 aa, Influenza virus
WMKLYWHLMH

SEQ ID NO: 517387 - protein, 10 aa, Influenza virus
WMKLYWHLMR

SEQ ID NO: 517388 - protein, 10 aa, Influenza virus
WMKLYWHLMS

SEQ ID NO: 517389 - protein, 10 aa, Influenza virus
WMLLDPGDTV

SEQ ID NO: 517390 - protein, 10 aa, Influenza virus
WMMAMKYPIT

SEQ ID NO: 517391 - protein, 10 aa, Influenza virus
WMMAMRYPIT

SEQ ID NO: 517392 - protein, 10 aa, Influenza virus
WMRINNETIL

SEQ ID NO: 517393 - protein, 10 aa, Influenza virus
WMRISNETIL

SEQ ID NO: 517394 - protein, 10 aa, Influenza virus
WNENQNPRIF

SEQ ID NO: 517395 - protein, 10 aa, Influenza virus
WNENQNPRMF

SEQ ID NO: 517396 - protein, 10 aa, Influenza virus
WNENQNPRVF

SEQ ID NO: 517397 - protein, 10 aa, Influenza virus
WNGVKVDGSS

SEQ ID NO: 517398 - protein, 10 aa, Influenza virus
WNLALDIVDS

SEQ ID NO: 517399 - protein, 10 aa, Influenza virus
WNVSSSGTSK

SEQ ID NO: 517400 - protein, 10 aa, Influenza virus
WNVTHTGTSK

SEQ ID NO: 517401 - protein, 10 aa, Influenza virus
WNVTRSGTSK

SEQ ID NO: 517402 - protein, 10 aa, Influenza virus
WNVTSSGTSK

SEQ ID NO: 517403 - protein, 10 aa, Influenza virus
WNVTYTGISK

SEQ ID NO: 517404 - protein, 10 aa, Influenza virus
WNVTYTGTSK

SEQ ID NO: 517405 - protein, 10 aa, Influenza virus
WNVTYTGTSR

SEQ ID NO: 517406 - protein, 10 aa, Influenza virus
WNWPDGAEIE

SEQ ID NO: 517407 - protein, 10 aa, Influenza virus
WNWPDGAKIE

SEQ ID NO: 517408 - protein, 10 aa, Influenza virus
WPDGADINFM

SEQ ID NO: 517409 - protein, 10 aa, Influenza virus
WPDGADLPFT

SEQ ID NO: 517410 - protein, 10 aa, Influenza virus
WPDGAEIEYF

SEQ ID NO: 517411 - protein, 10 aa, Influenza virus
WPDGAELPFA

SEQ ID NO: 517412 - protein, 10 aa, Influenza virus
WPDGAELPFI

SEQ ID NO: 517413 - protein, 10 aa, Influenza virus
WPDGAELPFT

SEQ ID NO: 517414 - protein, 10 aa, Influenza virus
WPDGAKIETL

SEQ ID NO: 517415 - protein, 10 aa, Influenza virus
WPDGAKIEYF

SEQ ID NO: 517416 - protein, 10 aa, Influenza virus
WPDGAKIEYS

SEQ ID NO: 517417 - protein, 10 aa, Influenza virus
WPDGAKLPFT

SEQ ID NO: 517418 - protein, 10 aa, Influenza virus
WPDGALLPFD

SEQ ID NO: 517419 - protein, 10 aa, Influenza virus
WPDGALLPLT

SEQ ID NO: 517420 - protein, 10 aa, Influenza virus
WPDGANIDFM

SEQ ID NO: 517421 - protein, 10 aa, Influenza virus
WPDGANIDFV

SEQ ID NO: 517422 - protein, 10 aa, Influenza virus
WPDGANIGFM

SEQ ID NO: 517423 - protein, 10 aa, Influenza virus
WPDGANIGLC

SEQ ID NO: 517424 - protein, 10 aa, Influenza virus
WPDGANINFM

SEQ ID NO: 517425 - protein, 10 aa, Influenza virus
WPDGANINLM

SEQ ID NO: 517426 - protein, 10 aa, Influenza virus
WPDGANISFM

SEQ ID NO: 517427 - protein, 10 aa, Influenza virus
WPDGANTNFM

SEQ ID NO: 517428 - protein, 10 aa, Influenza virus
WPDGSDIGFM

SEQ ID NO: 517429 - protein, 10 aa, Influenza virus
WPDGSNIGFM

SEQ ID NO: 517430 - protein, 10 aa, Influenza virus
WPDGYNIGFM

SEQ ID NO: 517431 - protein, 10 aa, Influenza virus
WPGLINGWYG

SEQ ID NO: 517432 - protein, 10 aa, Influenza virus
WPGLVAGWYG

SEQ ID NO: 517433 - protein, 10 aa, Influenza virus
WPLSSPPTVY

SEQ ID NO: 517434 - protein, 10 aa, Influenza virus
WPQSSPPTVY

SEQ ID NO: 517435 - protein, 10 aa, Influenza virus
WQGANRPIIE

SEQ ID NO: 517436 - protein, 10 aa, Influenza virus
WQGANRPVIE

SEQ ID NO: 517437 - protein, 10 aa, Influenza virus
WQGANRPVIK

SEQ ID NO: 517438 - protein, 10 aa, Influenza virus
WQGLIDGWYG

SEQ ID NO: 517439 - protein, 10 aa, Influenza virus
WQGLVDGWYG

SEQ ID NO: 517440 - protein, 10 aa, Influenza virus
WQGMIDGWYG

SEQ ID NO: 517441 - protein, 10 aa, Influenza virus
WQGMVDGWYG

SEQ ID NO: 517442 - protein, 10 aa, Influenza virus
WQGSNRPVIQ

SEQ ID NO: 517443 - protein, 10 aa, Influenza virus
WQGSNRPVIR

SEQ ID NO: 517444 - protein, 10 aa, Influenza virus
WQGSNRPWIR

SEQ ID NO: 517445 - protein, 10 aa, Influenza virus
WREQLSQKFE

SEQ ID NO: 517446 - protein, 10 aa, Influenza virus
WRGANRPVIT

SEQ ID NO: 517447 - protein, 10 aa, Influenza virus
WRGDNGRRTR

SEQ ID NO: 517448 - protein, 10 aa, Influenza virus
WRGENGRKTR

SEQ ID NO: 517449 - protein, 10 aa, Influenza virus
WRGENGRRTR

SEQ ID NO: 517450 - protein, 10 aa, Influenza virus
WRGGSINTKL

SEQ ID NO: 517451 - protein, 10 aa, Influenza virus
WRGGSINTRL

SEQ ID NO: 517452 - protein, 10 aa, Influenza virus
WRGSNRPIVD

SEQ ID NO: 517453 - protein, 10 aa, Influenza virus
WRGSNRPWIR

SEQ ID NO: 517454 - protein, 10 aa, Influenza virus
WRKDILRTQE

SEQ ID NO: 517455 - protein, 10 aa, Influenza virus
WRKKILRTQE

SEQ ID NO: 517456 - protein, 10 aa, Influenza virus
WRKQILRTQE

SEQ ID NO: 517457 - protein, 10 aa, Influenza virus
WRQANNGDDA

SEQ ID NO: 517458 - protein, 10 aa, Influenza virus
WRQANNGEDA

SEQ ID NO: 517459 - protein, 10 aa, Influenza virus
WRQANNGEDS

SEQ ID NO: 517460 - protein, 10 aa, Influenza virus
WRQANNGEEA

SEQ ID NO: 517461 - protein, 10 aa, Influenza virus
WRQANSGEDA

SEQ ID NO: 517462 - protein, 10 aa, Influenza virus
WRRDILRTQE

SEQ ID NO: 517463 - protein, 10 aa, Influenza virus
WRRQILRTQE

SEQ ID NO: 517464 - protein, 10 aa, Influenza virus
WSASACHDGI

SEQ ID NO: 517465 - protein, 10 aa, Influenza virus
WSASACHDGL

SEQ ID NO: 517466 - protein, 10 aa, Influenza virus
WSASACHDGM

SEQ ID NO: 517467 - protein, 10 aa, Influenza virus
WSASACHDGS

SEQ ID NO: 517468 - protein, 10 aa, Influenza virus
WSASACHDGT

SEQ ID NO: 517469 - protein, 10 aa, Influenza virus
WSASACHDGV

SEQ ID NO: 517470 - protein, 10 aa, Influenza virus
WSATACHDGK

SEQ ID NO: 517471 - protein, 10 aa, Influenza virus
WSATACHDGR

SEQ ID NO: 517472 - protein, 10 aa, Influenza virus
WSATACSDGP

SEQ ID NO: 517473 - protein, 10 aa, Influenza virus
WSATACSDGS

SEQ ID NO: 517474 - protein, 10 aa, Influenza virus
WSFALAQGAL

SEQ ID NO: 517475 - protein, 10 aa, Influenza virus
WSFALAQGTL

SEQ ID NO: 517476 - protein, 10 aa, Influenza virus
WSFALAQGVL

SEQ ID NO: 517477 - protein, 10 aa, Influenza virus
WSFALSQGAL

SEQ ID NO: 517478 - protein, 10 aa, Influenza virus
WSGLIAGWYG

SEQ ID NO: 517479 - protein, 10 aa, Influenza virus
WSGLVAGWYG

SEQ ID NO: 517480 - protein, 10 aa, Influenza virus
WSGMIDGWYG

SEQ ID NO: 517481 - protein, 10 aa, Influenza virus
WSGYSGAFID

SEQ ID NO: 517482 - protein, 10 aa, Influenza virus
WSGYSGAFMD

SEQ ID NO: 517483 - protein, 10 aa, Influenza virus
WSGYSGAFTI

SEQ ID NO: 517484 - protein, 10 aa, Influenza virus
WSGYSGAFTV

SEQ ID NO: 517485 - protein, 10 aa, Influenza virus
WSGYSGAFVD

SEQ ID NO: 517486 - protein, 10 aa, Influenza virus
WSGYSGIFSI

SEQ ID NO: 517487 - protein, 10 aa, Influenza virus
WSGYSGIFSV

SEQ ID NO: 517488 - protein, 10 aa, Influenza virus
WSGYSGSFID

SEQ ID NO: 517489 - protein, 10 aa, Influenza virus
WSGYSGSFII

SEQ ID NO: 517490 - protein, 10 aa, Influenza virus
WSGYSGSFIQ

SEQ ID NO: 517491 - protein, 10 aa, Influenza virus
WSGYSGSFIV

SEQ ID NO: 517492 - protein, 10 aa, Influenza virus
WSGYSGSFMD

SEQ ID NO: 517493 - protein, 10 aa, Influenza virus
WSGYSGSFSI

SEQ ID NO: 517494 - protein, 10 aa, Influenza virus
WSGYSGSFSV

SEQ ID NO: 517495 - protein, 10 aa, Influenza virus
WSGYSGSFTI

SEQ ID NO: 517496 - protein, 10 aa, Influenza virus
WSGYSGSFTL

SEQ ID NO: 517497 - protein, 10 aa, Influenza virus
WSGYSGSFTV

SEQ ID NO: 517498 - protein, 10 aa, Influenza virus
WSGYSGSFVD

SEQ ID NO: 517499 - protein, 10 aa, Influenza virus
WSGYSGSFVI

SEQ ID NO: 517500 - protein, 10 aa, Influenza virus
WSGYSGSFVQ

SEQ ID NO: 517501 - protein, 10 aa, Influenza virus
WSGYSGVFSV

SEQ ID NO: 517502 - protein, 10 aa, Influenza virus
WSHNILRTQE

SEQ ID NO: 517503 - protein, 10 aa, Influenza virus
WSILKPGETL

SEQ ID NO: 517504 - protein, 10 aa, Influenza virus
WSKNILRTQE

SEQ ID NO: 517505 - protein, 10 aa, Influenza virus
WSKPQCHITG

SEQ ID NO: 517506 - protein, 10 aa, Influenza virus
WSKPQCKITG

SEQ ID NO: 517507 - protein, 10 aa, Influenza virus
WSKPQCLITG

SEQ ID NO: 517508 - protein, 10 aa, Influenza virus
WSKPQCQIAG

SEQ ID NO: 517509 - protein, 10 aa, Influenza virus
WSKPQCQIIG

SEQ ID NO: 517510 - protein, 10 aa, Influenza virus
WSKPQCQISG

SEQ ID NO: 517511 - protein, 10 aa, Influenza virus
WSKPQCQITG

SEQ ID NO: 517512 - protein, 10 aa, Influenza virus
WSKRYELEIG

SEQ ID NO: 517513 - protein, 10 aa, Influenza virus
WSMLKPGETL

SEQ ID NO: 517514 - protein, 10 aa, Influenza virus
WSQNILRTHE

SEQ ID NO: 517515 - protein, 10 aa, Influenza virus
WSQNILRTQE

SEQ ID NO: 517516 - protein, 10 aa, Influenza virus
WSRRYELEIG

SEQ ID NO: 517517 - protein, 10 aa, Influenza virus
WSSASCHDGR

SEQ ID NO: 517518 - protein, 10 aa, Influenza virus
WSSSSCFDGK

SEQ ID NO: 517519 - protein, 10 aa, Influenza virus
WSSSSCFDGR

SEQ ID NO: 517520 - protein, 10 aa, Influenza virus
WSSSSCHDGK

SEQ ID NO: 517521 - protein, 10 aa, Influenza virus
WSSSSCHDGN

SEQ ID NO: 517522 - protein, 10 aa, Influenza virus
WSSSSCHDGR

SEQ ID NO: 517523 - protein, 10 aa, Influenza virus
WSSSSCYDGK

SEQ ID NO: 517524 - protein, 10 aa, Influenza virus
WSSTSCFDGK

SEQ ID NO: 517525 - protein, 10 aa, Influenza virus
WSSTSCHDGI

SEQ ID NO: 517526 - protein, 10 aa, Influenza virus
WSSTSCHDGK

SEQ ID NO: 517527 - protein, 10 aa, Influenza virus
WSSTSCHDGM

SEQ ID NO: 517528 - protein, 10 aa, Influenza virus
WSSTSCHDGR

SEQ ID NO: 517529 - protein, 10 aa, Influenza virus
WSSTSCHDGV

SEQ ID NO: 517530 - protein, 10 aa, Influenza virus
WSSTTCHDGI

SEQ ID NO: 517531 - protein, 10 aa, Influenza virus
WSSTTCHDGV

SEQ ID NO: 517532 - protein, 10 aa, Influenza virus
WSVLKPGETL

SEQ ID NO: 517533 - protein, 10 aa, Influenza virus
WSVLQPGETL

SEQ ID NO: 517534 - protein, 10 aa, Influenza virus
WSVLRPGETL

SEQ ID NO: 517535 - protein, 10 aa, Influenza virus
WSWDDGAILP

SEQ ID NO: 517536 - protein, 10 aa, Influenza virus
WSWHDGAEII

SEQ ID NO: 517537 - protein, 10 aa, Influenza virus
WSWHDGAEIT

SEQ ID NO: 517538 - protein, 10 aa, Influenza virus
WSWHDGAILP

SEQ ID NO: 517539 - protein, 10 aa, Influenza virus
WSWHDGAVLP

SEQ ID NO: 517540 - protein, 10 aa, Influenza virus
WSWPDDAELP

SEQ ID NO: 517541 - protein, 10 aa, Influenza virus
WSWPDGADLP

SEQ ID NO: 517542 - protein, 10 aa, Influenza virus
WSWPDGAELP

SEQ ID NO: 517543 - protein, 10 aa, Influenza virus
WSWPDGAEVP

SEQ ID NO: 517544 - protein, 10 aa, Influenza virus
WSWPDGAKLP

SEQ ID NO: 517545 - protein, 10 aa, Influenza virus
WSWPDGALFP

SEQ ID NO: 517546 - protein, 10 aa, Influenza virus
WSWPDGALLP

SEQ ID NO: 517547 - protein, 10 aa, Influenza virus
WSYIIEKENP

SEQ ID NO: 517548 - protein, 10 aa, Influenza virus
WSYIMEKENP

SEQ ID NO: 517549 - protein, 10 aa, Influenza virus
WSYIVEKANP

SEQ ID NO: 517550 - protein, 10 aa, Influenza virus
WSYIVEKDKP

SEQ ID NO: 517551 - protein, 10 aa, Influenza virus
WSYIVEKDNP

SEQ ID NO: 517552 - protein, 10 aa, Influenza virus
WSYIVEKDSP

SEQ ID NO: 517553 - protein, 10 aa, Influenza virus
WSYIVEKENP

SEQ ID NO: 517554 - protein, 10 aa, Influenza virus
WSYIVEKLNP

SEQ ID NO: 517555 - protein, 10 aa, Influenza virus
WSYIVEKNNP

SEQ ID NO: 517556 - protein, 10 aa, Influenza virus
WSYIVEKPNP

SEQ ID NO: 517557 - protein, 10 aa, Influenza virus
WSYIVEKSNP

SEQ ID NO: 517558 - protein, 10 aa, Influenza virus
WSYIVEKTNP

SEQ ID NO: 517559 - protein, 10 aa, Influenza virus
WSYIVERENP

SEQ ID NO: 517560 - protein, 10 aa, Influenza virus
WSYIVERETP

SEQ ID NO: 517561 - protein, 10 aa, Influenza virus
WSYIVERPKE

SEQ ID NO: 517562 - protein, 10 aa, Influenza virus
WSYIVERPSA

SEQ ID NO: 517563 - protein, 10 aa, Influenza virus
WSYIVERTKE

SEQ ID NO: 517564 - protein, 10 aa, Influenza virus
WSYLIEDPAA

SEQ ID NO: 517565 - protein, 10 aa, Influenza virus
WSYLIEDPGA

SEQ ID NO: 517566 - protein, 10 aa, Influenza virus
WSYLIEDPNA

SEQ ID NO: 517567 - protein, 10 aa, Influenza virus
WSYLIEDPSA

SEQ ID NO: 517568 - protein, 10 aa, Influenza virus
WSYLIEDPTA

SEQ ID NO: 517569 - protein, 10 aa, Influenza virus
WSYNADLLVA

SEQ ID NO: 517570 - protein, 10 aa, Influenza virus
WSYNADVLVA

SEQ ID NO: 517571 - protein, 10 aa, Influenza virus
WSYNAEFLVA

SEQ ID NO: 517572 - protein, 10 aa, Influenza virus
WSYNAELLIA

SEQ ID NO: 517573 - protein, 10 aa, Influenza virus
WSYNAELLVA

SEQ ID NO: 517574 - protein, 10 aa, Influenza virus
WSYNAGLLVA

SEQ ID NO: 517575 - protein, 10 aa, Influenza virus
WSYNAKLLVL

SEQ ID NO: 517576 - protein, 10 aa, Influenza virus
WSYNAQLLVL

SEQ ID NO: 517577 - protein, 10 aa, Influenza virus
WSYNAQLLVW

SEQ ID NO: 517578 - protein, 10 aa, Influenza virus
WSYNARLLVL

SEQ ID NO: 517579 - protein, 10 aa, Influenza virus
WTANSIIVFC

SEQ ID NO: 517580 - protein, 10 aa, Influenza virus
WTCNSGNCRF

SEQ ID NO: 517581 - protein, 10 aa, Influenza virus
WTCSNGSCRC

SEQ ID NO: 517582 - protein, 10 aa, Influenza virus
WTGLIDGWYG

SEQ ID NO: 517583 - protein, 10 aa, Influenza virus
WTGMIDGWYG

SEQ ID NO: 517584 - protein, 10 aa, Influenza virus
WTGMVDGWYG

SEQ ID NO: 517585 - protein, 10 aa, Influenza virus
WTGMVNGWYG

SEQ ID NO: 517586 - protein, 10 aa, Influenza virus
WTGTNRPILV

SEQ ID NO: 517587 - protein, 10 aa, Influenza virus
WTGTNRPVLI

SEQ ID NO: 517588 - protein, 10 aa, Influenza virus
WTGTNRPVLV

SEQ ID NO: 517589 - protein, 10 aa, Influenza virus
WTGTNRPVVV

SEQ ID NO: 517590 - protein, 10 aa, Influenza virus
WTKDSITDIW

SEQ ID NO: 517591 - protein, 10 aa, Influenza virus
WTLGENMAPE

SEQ ID NO: 517592 - protein, 10 aa, Influenza virus
WTLNRNQPAA

SEQ ID NO: 517593 - protein, 10 aa, Influenza virus
WTLVNPGDSI

SEQ ID NO: 517594 - protein, 10 aa, Influenza virus
WTPKRNRSIL

SEQ ID NO: 517595 - protein, 10 aa, Influenza virus
WTQDAMTEVW

SEQ ID NO: 517596 - protein, 10 aa, Influenza virus
WTRDAMTEIW

SEQ ID NO: 517597 - protein, 10 aa, Influenza virus
WTRDAMTEVW

SEQ ID NO: 517598 - protein, 10 aa, Influenza virus
WTRDSITEVW

SEQ ID NO: 517599 - protein, 10 aa, Influenza virus
WTRDSLTEIW

SEQ ID NO: 517600 - protein, 10 aa, Influenza virus
WTRDSMTEIW

SEQ ID NO: 517601 - protein, 10 aa, Influenza virus
WTRDSMTEVW

SEQ ID NO: 517602 - protein, 10 aa, Influenza virus
WTRDSVTELW

SEQ ID NO: 517603 - protein, 10 aa, Influenza virus
WTSGSIISFC

SEQ ID NO: 517604 - protein, 10 aa, Influenza virus
WTSGSSIAFC

SEQ ID NO: 517605 - protein, 10 aa, Influenza virus
WTSGSSISFC

SEQ ID NO: 517606 - protein, 10 aa, Influenza virus
WTSNSIAVFC

SEQ ID NO: 517607 - protein, 10 aa, Influenza virus
WTSNSIIAFC

SEQ ID NO: 517608 - protein, 10 aa, Influenza virus
WTSNSIISMC

SEQ ID NO: 517609 - protein, 10 aa, Influenza virus
WTSNSIIVFC

SEQ ID NO: 517610 - protein, 10 aa, Influenza virus
WTSNSIVAFC

SEQ ID NO: 517611 - protein, 10 aa, Influenza virus
WTSNSIVALC

SEQ ID NO: 517612 - protein, 10 aa, Influenza virus
WTSNSIVSMC

SEQ ID NO: 517613 - protein, 10 aa, Influenza virus
WTSNSIVTFC

SEQ ID NO: 517614 - protein, 10 aa, Influenza virus
WTSNSIVVFC

SEQ ID NO: 517615 - protein, 10 aa, Influenza virus
WTSNSLIALC

SEQ ID NO: 517616 - protein, 10 aa, Influenza virus
WTSNSLVALC

SEQ ID NO: 517617 - protein, 10 aa, Influenza virus
WTSNSMVTFC

SEQ ID NO: 517618 - protein, 10 aa, Influenza virus
WTSSSIVVFC

SEQ ID NO: 517619 - protein, 10 aa, Influenza virus
WTSSSSIVMC

SEQ ID NO: 517620 - protein, 10 aa, Influenza virus
WTSSSSTVFC

SEQ ID NO: 517621 - protein, 10 aa, Influenza virus
WTSSSSVVMC

SEQ ID NO: 517622 - protein, 10 aa, Influenza virus
WTTNSIVVFC

SEQ ID NO: 517623 - protein, 10 aa, Influenza virus
WTYNAELFVL

SEQ ID NO: 517624 - protein, 10 aa, Influenza virus
WTYNAELLIL

SEQ ID NO: 517625 - protein, 10 aa, Influenza virus
WTYNAELLVA

SEQ ID NO: 517626 - protein, 10 aa, Influenza virus
WTYNAELLVL

SEQ ID NO: 517627 - protein, 10 aa, Influenza virus
WTYNAEVLVL

SEQ ID NO: 517628 - protein, 10 aa, Influenza virus
WTYNTELLVL

SEQ ID NO: 517629 - protein, 10 aa, Influenza virus
WTYNVELLVL

SEQ ID NO: 517630 - protein, 10 aa, Influenza virus
WTYQAELLVA

SEQ ID NO: 517631 - protein, 10 aa, Influenza virus
WTYQEELLVA

SEQ ID NO: 517632 - protein, 10 aa, Influenza virus
WVAVAKDNAI

SEQ ID NO: 517633 - protein, 10 aa, Influenza virus
WVCSNGSCRC

SEQ ID NO: 517634 - protein, 10 aa, Influenza virus
WVDDAVTDIW

SEQ ID NO: 517635 - protein, 10 aa, Influenza virus
WVELDEIGED

SEQ ID NO: 517636 - protein, 10 aa, Influenza virus
WVELIRGQPK

SEQ ID NO: 517637 - protein, 10 aa, Influenza virus
WVELIRGRPE

SEQ ID NO: 517638 - protein, 10 aa, Influenza virus
WVELIRGRPK

SEQ ID NO: 517639 - protein, 10 aa, Influenza virus
WVELVRGRPK

SEQ ID NO: 517640 - protein, 10 aa, Influenza virus
WVEMIRGEPE

SEQ ID NO: 517641 - protein, 10 aa, Influenza virus
WVEMIRGKPE

SEQ ID NO: 517642 - protein, 10 aa, Influenza virus
WVEMIRGQPK

SEQ ID NO: 517643 - protein, 10 aa, Influenza virus
WVEMIRGRPE

SEQ ID NO: 517644 - protein, 10 aa, Influenza virus
WVLGENMAPE

SEQ ID NO: 517645 - protein, 10 aa, Influenza virus
WVLLNASWFN

SEQ ID NO: 517646 - protein, 10 aa, Influenza virus
WVLWISFAIS

SEQ ID NO: 517647 - protein, 10 aa, Influenza virus
WVMTDGPANK

SEQ ID NO: 517648 - protein, 10 aa, Influenza virus
WVMTDGPANN

SEQ ID NO: 517649 - protein, 10 aa, Influenza virus
WVMTDGPANR

SEQ ID NO: 517650 - protein, 10 aa, Influenza virus
WVMTDGPANS

SEQ ID NO: 517651 - protein, 10 aa, Influenza virus
WVMTDGPASN

SEQ ID NO: 517652 - protein, 10 aa, Influenza virus
WVPILNTSQR

SEQ ID NO: 517653 - protein, 10 aa, Influenza virus
WVPKRNRSIL

SEQ ID NO: 517654 - protein, 10 aa, Influenza virus
WVQNEFNKAC

SEQ ID NO: 517655 - protein, 10 aa, Influenza virus
WVQSEFNKAC

SEQ ID NO: 517656 - protein, 10 aa, Influenza virus
WVRFNSDLDY

SEQ ID NO: 517657 - protein, 10 aa, Influenza virus
WVRINNETIL

SEQ ID NO: 517658 - protein, 10 aa, Influenza virus
WVRMNNETIL

SEQ ID NO: 517659 - protein, 10 aa, Influenza virus
WVSFSISCFL

SEQ ID NO: 517660 - protein, 10 aa, Influenza virus
WVSTDKDSNG

SEQ ID NO: 517661 - protein, 10 aa, Influenza virus
WVSTDKNSNG

SEQ ID NO: 517662 - protein, 10 aa, Influenza virus
WVSTDKSSNG

SEQ ID NO: 517663 - protein, 10 aa, Influenza virus
WVTRELYVSC

SEQ ID NO: 517664 - protein, 10 aa, Influenza virus
WVTREPYVSC

SEQ ID NO: 517665 - protein, 10 aa, Influenza virus
WVVIAKDNAI

SEQ ID NO: 517666 - protein, 10 aa, Influenza virus
WVVIAKDNAV

SEQ ID NO: 517667 - protein, 10 aa, Influenza virus
WVVIAQDNAI

SEQ ID NO: 517668 - protein, 10 aa, Influenza virus
WVVIEKDNAV

SEQ ID NO: 517669 - protein, 10 aa, Influenza virus
WVVVAKDNAI

SEQ ID NO: 517670 - protein, 10 aa, Influenza virus
WVVVAKDNAV

SEQ ID NO: 517671 - protein, 10 aa, Influenza virus
WVWLWLVLRE

SEQ ID NO: 517672 - protein, 10 aa, Influenza virus
WWASNSLIAL

SEQ ID NO: 517673 - protein, 10 aa, Influenza virus
WWDGLQSSDD

SEQ ID NO: 517674 - protein, 10 aa, Influenza virus
WWTSNSIAVF

SEQ ID NO: 517675 - protein, 10 aa, Influenza virus
WWTSNSIISM

SEQ ID NO: 517676 - protein, 10 aa, Influenza virus
WWTSNSIIVF

SEQ ID NO: 517677 - protein, 10 aa, Influenza virus
WWTSNSIVAF

SEQ ID NO: 517678 - protein, 10 aa, Influenza virus
WWTSNSIVAL

SEQ ID NO: 517679 - protein, 10 aa, Influenza virus
WWTSNSIVSM

SEQ ID NO: 517680 - protein, 10 aa, Influenza virus
WWTSNSIVVF

SEQ ID NO: 517681 - protein, 10 aa, Influenza virus
WWTSNSLIAL

SEQ ID NO: 517682 - protein, 10 aa, Influenza virus
WWTSNSLVAL

SEQ ID NO: 517683 - protein, 10 aa, Influenza virus
WWTTNSIVVF

SEQ ID NO: 517684 - protein, 10 aa, Influenza virus
WWVWLWLVLR

SEQ ID NO: 517685 - protein, 10 aa, Influenza virus
WYGFHHSNAE

SEQ ID NO: 517686 - protein, 10 aa, Influenza virus
WYGFHHSNSE

SEQ ID NO: 517687 - protein, 10 aa, Influenza virus
WYGFKHQNAQ

SEQ ID NO: 517688 - protein, 10 aa, Influenza virus
WYGFQHQNAE

SEQ ID NO: 517689 - protein, 10 aa, Influenza virus
WYGFQHQNEQ

SEQ ID NO: 517690 - protein, 10 aa, Influenza virus
WYGFQHQNSE

SEQ ID NO: 517691 - protein, 10 aa, Influenza virus
WYGFQHRNDE

SEQ ID NO: 517692 - protein, 10 aa, Influenza virus
WYGFQHRNEE

SEQ ID NO: 517693 - protein, 10 aa, Influenza virus
WYGFQHSNAQ

SEQ ID NO: 517694 - protein, 10 aa, Influenza virus
WYGFQHSNDQ

SEQ ID NO: 517695 - protein, 10 aa, Influenza virus
WYGFQHSNEQ

SEQ ID NO: 517696 - protein, 10 aa, Influenza virus
WYGFQHTNDQ

SEQ ID NO: 517697 - protein, 10 aa, Influenza virus
WYGFRHHNSE

SEQ ID NO: 517698 - protein, 10 aa, Influenza virus
WYGFRHLNSE

SEQ ID NO: 517699 - protein, 10 aa, Influenza virus
WYGFRHQKAQ

SEQ ID NO: 517700 - protein, 10 aa, Influenza virus
WYGFRHQNAE

SEQ ID NO: 517701 - protein, 10 aa, Influenza virus
WYGFRHQNAQ

SEQ ID NO: 517702 - protein, 10 aa, Influenza virus
WYGFRHQNSE

SEQ ID NO: 517703 - protein, 10 aa, Influenza virus
WYGFRHQNSQ

SEQ ID NO: 517704 - protein, 10 aa, Influenza virus
WYGFRHQNTQ

SEQ ID NO: 517705 - protein, 10 aa, Influenza virus
WYGFRYQNSE

SEQ ID NO: 517706 - protein, 10 aa, Influenza virus
WYGYHHENSQ

SEQ ID NO: 517707 - protein, 10 aa, Influenza virus
WYGYHHQNEQ

SEQ ID NO: 517708 - protein, 10 aa, Influenza virus
WYGYHHQNGQ

SEQ ID NO: 517709 - protein, 10 aa, Influenza virus
WYGYHHSNDQ

SEQ ID NO: 517710 - protein, 10 aa, Influenza virus
WYGYKHQNAQ

SEQ ID NO: 517711 - protein, 10 aa, Influenza virus
WYGYRHQNAQ

SEQ ID NO: 517712 - protein, 10 aa, Influenza virus
YAADKASTQK

SEQ ID NO: 517713 - protein, 10 aa, Influenza virus
YAADKESTQK

SEQ ID NO: 517714 - protein, 10 aa, Influenza virus
YAADKESTQR

SEQ ID NO: 517715 - protein, 10 aa, Influenza virus
YAADKKSTQK

SEQ ID NO: 517716 - protein, 10 aa, Influenza virus
YAADQESTQK

SEQ ID NO: 517717 - protein, 10 aa, Influenza virus
YAADRESTQK

SEQ ID NO: 517718 - protein, 10 aa, Influenza virus
YAADRESTQR

SEQ ID NO: 517719 - protein, 10 aa, Influenza virus
YAADRKSTQK

SEQ ID NO: 517720 - protein, 10 aa, Influenza virus
YAEESKLKRQ

SEQ ID NO: 517721 - protein, 10 aa, Influenza virus
YAELKWLISK

SEQ ID NO: 517722 - protein, 10 aa, Influenza virus
YAELKWLVSK

SEQ ID NO: 517723 - protein, 10 aa, Influenza virus
YAELLVAMEN

SEQ ID NO: 517724 - protein, 10 aa, Influenza virus
YAEMEWLLSN

SEQ ID NO: 517725 - protein, 10 aa, Influenza virus
YAEMKWLLSD

SEQ ID NO: 517726 - protein, 10 aa, Influenza virus
YAEMKWLLSN

SEQ ID NO: 517727 - protein, 10 aa, Influenza virus
YAEMKWLLSS

SEQ ID NO: 517728 - protein, 10 aa, Influenza virus
YAGAINSSKP

SEQ ID NO: 517729 - protein, 10 aa, Influenza virus
YAGAINSSRP

SEQ ID NO: 517730 - protein, 10 aa, Influenza virus
YAGAVNSSKP

SEQ ID NO: 517731 - protein, 10 aa, Influenza virus
YAKKASLRLA

SEQ ID NO: 517732 - protein, 10 aa, Influenza virus
YALHQGTTIR

SEQ ID NO: 517733 - protein, 10 aa, Influenza virus
YALSQGTTIR

SEQ ID NO: 517734 - protein, 10 aa, Influenza virus
YAQTDCVLEA

SEQ ID NO: 517735 - protein, 10 aa, Influenza virus
YARLYIWGVH

SEQ ID NO: 517736 - protein, 10 aa, Influenza virus
YASKNPYTLV

SEQ ID NO: 517737 - protein, 10 aa, Influenza virus
YASKTRISEI

SEQ ID NO: 517738 - protein, 10 aa, Influenza virus
YASPQLEGFS

SEQ ID NO: 517739 - protein, 10 aa, Influenza virus
YASSQLEGFS

SEQ ID NO: 517740 - protein, 10 aa, Influenza virus
YATVAGSLSL

SEQ ID NO: 517741 - protein, 10 aa, Influenza virus
YAVIHYGGIP

SEQ ID NO: 517742 - protein, 10 aa, Influenza virus
YAVIHYGGMP

SEQ ID NO: 517743 - protein, 10 aa, Influenza virus
YAVIHYGGVP

SEQ ID NO: 517744 - protein, 10 aa, Influenza virus
YCFTVMTDGP

SEQ ID NO: 517745 - protein, 10 aa, Influenza virus
YCICRDNWKG

SEQ ID NO: 517746 - protein, 10 aa, Influenza virus
YCNTDLGAPL

SEQ ID NO: 517747 - protein, 10 aa, Influenza virus
YCNTDLGSPL

SEQ ID NO: 517748 - protein, 10 aa, Influenza virus
YCNTDLGTPL

SEQ ID NO: 517749 - protein, 10 aa, Influenza virus
YCRATEYIMK

SEQ ID NO: 517750 - protein, 10 aa, Influenza virus
YCSLNGISPI

SEQ ID NO: 517751 - protein, 10 aa, Influenza virus
YCSLNGISPV

SEQ ID NO: 517752 - protein, 10 aa, Influenza virus
YCSLNGVSPI

SEQ ID NO: 517753 - protein, 10 aa, Influenza virus
YCSLNGVSPV

SEQ ID NO: 517754 - protein, 10 aa, Influenza virus
YCVCRDNWKG

SEQ ID NO: 517755 - protein, 10 aa, Influenza virus
YCYPGATMNE

SEQ ID NO: 517756 - protein, 10 aa, Influenza virus
YCYPGATVNE

SEQ ID NO: 517757 - protein, 10 aa, Influenza virus
YCYPGSTVNE

SEQ ID NO: 517758 - protein, 10 aa, Influenza virus
YCYPGTTVNE

SEQ ID NO: 517759 - protein, 10 aa, Influenza virus
YDAIEECLIN

SEQ ID NO: 517760 - protein, 10 aa, Influenza virus
YDAVATTHSW

SEQ ID NO: 517761 - protein, 10 aa, Influenza virus
YDFEKEGYSL

SEQ ID NO: 517762 - protein, 10 aa, Influenza virus
YDFEREGYSL

SEQ ID NO: 517763 - protein, 10 aa, Influenza virus
YDGKAWLHIC

SEQ ID NO: 517764 - protein, 10 aa, Influenza virus
YDGKAWLHVC

SEQ ID NO: 517765 - protein, 10 aa, Influenza virus
YDHAQYREEA

SEQ ID NO: 517766 - protein, 10 aa, Influenza virus
YDHKDYEEEA

SEQ ID NO: 517767 - protein, 10 aa, Influenza virus
YDHKEFEEES

SEQ ID NO: 517768 - protein, 10 aa, Influenza virus
YDHKEFEKES

SEQ ID NO: 517769 - protein, 10 aa, Influenza virus
YDHKEFKEES

SEQ ID NO: 517770 - protein, 10 aa, Influenza virus
YDHKEYEEEA

SEQ ID NO: 517771 - protein, 10 aa, Influenza virus
YDHNIYRDEA

SEQ ID NO: 517772 - protein, 10 aa, Influenza virus
YDHSQYREEA

SEQ ID NO: 517773 - protein, 10 aa, Influenza virus
YDHTQYREEA

SEQ ID NO: 517774 - protein, 10 aa, Influenza virus
YDKICIGYQT

SEQ ID NO: 517775 - protein, 10 aa, Influenza virus
YDKVRLQLKD

SEQ ID NO: 517776 - protein, 10 aa, Influenza virus
YDKVRLQLRD

SEQ ID NO: 517777 - protein, 10 aa, Influenza virus
YDKVRMQLKD

SEQ ID NO: 517778 - protein, 10 aa, Influenza virus
YDKVRMQLRD

SEQ ID NO: 517779 - protein, 10 aa, Influenza virus
YDNGVWIGRT

SEQ ID NO: 517780 - protein, 10 aa, Influenza virus
YDRICIGYQS

SEQ ID NO: 517781 - protein, 10 aa, Influenza virus
YDRRLTTTIK

SEQ ID NO: 517782 - protein, 10 aa, Influenza virus
YDRVRKQLRQ

SEQ ID NO: 517783 - protein, 10 aa, Influenza virus
YDRVRLQLRD

SEQ ID NO: 517784 - protein, 10 aa, Influenza virus
YDRVRMQLRD

SEQ ID NO: 517785 - protein, 10 aa, Influenza virus
YDSIRGEFNQ

SEQ ID NO: 517786 - protein, 10 aa, Influenza virus
YDSIRGEFSQ

SEQ ID NO: 517787 - protein, 10 aa, Influenza virus
YDVGYLCAGI

SEQ ID NO: 517788 - protein, 10 aa, Influenza virus
YDWTLNRNQP

SEQ ID NO: 517789 - protein, 10 aa, Influenza virus
YDYIKYEEES

SEQ ID NO: 517790 - protein, 10 aa, Influenza virus
YDYPKYEEES

SEQ ID NO: 517791 - protein, 10 aa, Influenza virus
YDYPKYSEEA

SEQ ID NO: 517792 - protein, 10 aa, Influenza virus
YDYPKYSEES

SEQ ID NO: 517793 - protein, 10 aa, Influenza virus
YDYPKYSKES

SEQ ID NO: 517794 - protein, 10 aa, Influenza virus
YDYSKYEEES

SEQ ID NO: 517795 - protein, 10 aa, Influenza virus
YEAIEECLIN

SEQ ID NO: 517796 - protein, 10 aa, Influenza virus
YEAVEECLIN

SEQ ID NO: 517797 - protein, 10 aa, Influenza virus
YEDESRIERQ

SEQ ID NO: 517798 - protein, 10 aa, Influenza virus
YEECSCYPDA

SEQ ID NO: 517799 - protein, 10 aa, Influenza virus
YEECSCYPDS

SEQ ID NO: 517800 - protein, 10 aa, Influenza virus
YEECSCYPDT

SEQ ID NO: 517801 - protein, 10 aa, Influenza virus
YEECSCYPES

SEQ ID NO: 517802 - protein, 10 aa, Influenza virus
YEECSCYPNA

SEQ ID NO: 517803 - protein, 10 aa, Influenza virus
YEEEAKLEKS

SEQ ID NO: 517804 - protein, 10 aa, Influenza virus
YEEEAKLERS

SEQ ID NO: 517805 - protein, 10 aa, Influenza virus
YEEESKIERQ

SEQ ID NO: 517806 - protein, 10 aa, Influenza virus
YEEESKLERQ

SEQ ID NO: 517807 - protein, 10 aa, Influenza virus
YEEESKLKRN

SEQ ID NO: 517808 - protein, 10 aa, Influenza virus
YEEESKLKRQ

SEQ ID NO: 517809 - protein, 10 aa, Influenza virus
YEEESKLNKN

SEQ ID NO: 517810 - protein, 10 aa, Influenza virus
YEEESKLNRN

SEQ ID NO: 517811 - protein, 10 aa, Influenza virus
YEEESKLNRS

SEQ ID NO: 517812 - protein, 10 aa, Influenza virus
YEEESKLNRT

SEQ ID NO: 517813 - protein, 10 aa, Influenza virus
YEEESRIERQ

SEQ ID NO: 517814 - protein, 10 aa, Influenza virus
YEEESRLNRN

SEQ ID NO: 517815 - protein, 10 aa, Influenza virus
YEELKEQLST

SEQ ID NO: 517816 - protein, 10 aa, Influenza virus
YEELKHLLNR

SEQ ID NO: 517817 - protein, 10 aa, Influenza virus
YEELKHLLSR

SEQ ID NO: 517818 - protein, 10 aa, Influenza virus
YEELKHLLSS

SEQ ID NO: 517819 - protein, 10 aa, Influenza virus
YEELKHLMSS

SEQ ID NO: 517820 - protein, 10 aa, Influenza virus
YEELREHLSS

SEQ ID NO: 517821 - protein, 10 aa, Influenza virus
YEELREQLSS

SEQ ID NO: 517822 - protein, 10 aa, Influenza virus
YEELREQLST

SEQ ID NO: 517823 - protein, 10 aa, Influenza virus
YEFSNLERRI

SEQ ID NO: 517824 - protein, 10 aa, Influenza virus
YEILKVPNAE

SEQ ID NO: 517825 - protein, 10 aa, Influenza virus
YEKNATASFI

SEQ ID NO: 517826 - protein, 10 aa, Influenza virus
YEKVRLQLRD

SEQ ID NO: 517827 - protein, 10 aa, Influenza virus
YEKVRMQLRD

SEQ ID NO: 517828 - protein, 10 aa, Influenza virus
YEKVRRQLRE

SEQ ID NO: 517829 - protein, 10 aa, Influenza virus
YELEIGARIG

SEQ ID NO: 517830 - protein, 10 aa, Influenza virus
YELEIGTRIG

SEQ ID NO: 517831 - protein, 10 aa, Influenza virus
YEMLKVPDAE

SEQ ID NO: 517832 - protein, 10 aa, Influenza virus
YEMLKVPNAE

SEQ ID NO: 517833 - protein, 10 aa, Influenza virus
YEMLKVPNAL

SEQ ID NO: 517834 - protein, 10 aa, Influenza virus
YENNTWVNQT

SEQ ID NO: 517835 - protein, 10 aa, Influenza virus
YENTTWVNQT

SEQ ID NO: 517836 - protein, 10 aa, Influenza virus
YEQMETDGDR

SEQ ID NO: 517837 - protein, 10 aa, Influenza virus
YEQMETDGER

SEQ ID NO: 517838 - protein, 10 aa, Influenza virus
YEQMETGGER

SEQ ID NO: 517839 - protein, 10 aa, Influenza virus
YEQMETSGER

SEQ ID NO: 517840 - protein, 10 aa, Influenza virus
YERMCNILKG

SEQ ID NO: 517841 - protein, 10 aa, Influenza virus
YERRLTTTIK

SEQ ID NO: 517842 - protein, 10 aa, Influenza virus
YERVKKQLRE

SEQ ID NO: 517843 - protein, 10 aa, Influenza virus
YERVKMFDFI

SEQ ID NO: 517844 - protein, 10 aa, Influenza virus
YERVKMFDFS

SEQ ID NO: 517845 - protein, 10 aa, Influenza virus
YERVKMFDFT

SEQ ID NO: 517846 - protein, 10 aa, Influenza virus
YERVKRQLRE

SEQ ID NO: 517847 - protein, 10 aa, Influenza virus
YERVRKQLRA

SEQ ID NO: 517848 - protein, 10 aa, Influenza virus
YERVRKQLRE

SEQ ID NO: 517849 - protein, 10 aa, Influenza virus
YERVRKQLRQ

SEQ ID NO: 517850 - protein, 10 aa, Influenza virus
YERVRRQLRE

SEQ ID NO: 517851 - protein, 10 aa, Influenza virus
YESIEECLIN

SEQ ID NO: 517852 - protein, 10 aa, Influenza virus
YESTQAAIDQ

SEQ ID NO: 517853 - protein, 10 aa, Influenza virus
YETFKVIGGW

SEQ ID NO: 517854 - protein, 10 aa, Influenza virus
YETFRVIDGW

SEQ ID NO: 517855 - protein, 10 aa, Influenza virus
YETFRVIGGW

SEQ ID NO: 517856 - protein, 10 aa, Influenza virus
YETFRVISGW

SEQ ID NO: 517857 - protein, 10 aa, Influenza virus
YEVGYLCAGI

SEQ ID NO: 517858 - protein, 10 aa, Influenza virus
YEVLKVPDAE

SEQ ID NO: 517859 - protein, 10 aa, Influenza virus
YEVLKVPNAE

SEQ ID NO: 517860 - protein, 10 aa, Influenza virus
YFFGDNAEEF

SEQ ID NO: 517861 - protein, 10 aa, Influenza virus
YFFGDNAEEY

SEQ ID NO: 517862 - protein, 10 aa, Influenza virus
YFFGDNAKEY

SEQ ID NO: 517863 - protein, 10 aa, Influenza virus
YFFGDSAEEY

SEQ ID NO: 517864 - protein, 10 aa, Influenza virus
YFFLKVPVQN

SEQ ID NO: 517865 - protein, 10 aa, Influenza virus
YFHDSNVKNL

SEQ ID NO: 517866 - protein, 10 aa, Influenza virus
YFHKGIVIKE

SEQ ID NO: 517867 - protein, 10 aa, Influenza virus
YFHKGLIIKE

SEQ ID NO: 517868 - protein, 10 aa, Influenza virus
YFHKGLLIKE

SEQ ID NO: 517869 - protein, 10 aa, Influenza virus
YFHKGLVIKE

SEQ ID NO: 517870 - protein, 10 aa, Influenza virus
YFHKGLVVKE

SEQ ID NO: 517871 - protein, 10 aa, Influenza virus
YFLDVFAGDT

SEQ ID NO: 517872 - protein, 10 aa, Influenza virus
YFQLFLVCVS

SEQ ID NO: 517873 - protein, 10 aa, Influenza virus
YFTAEISHCR

SEQ ID NO: 517874 - protein, 10 aa, Influenza virus
YFTAEVSHCR

SEQ ID NO: 517875 - protein, 10 aa, Influenza virus
YFTAEVSYCR

SEQ ID NO: 517876 - protein, 10 aa, Influenza virus
YFTTEVSHCR

SEQ ID NO: 517877 - protein, 10 aa, Influenza virus
YFVKEGKIVH

SEQ ID NO: 517878 - protein, 10 aa, Influenza virus
YGAGNKLITV

SEQ ID NO: 517879 - protein, 10 aa, Influenza virus
YGAGSWPDGA

SEQ ID NO: 517880 - protein, 10 aa, Influenza virus
YGAIEECLIN

SEQ ID NO: 517881 - protein, 10 aa, Influenza virus
YGAQSLSISV

SEQ ID NO: 517882 - protein, 10 aa, Influenza virus
YGDGVWIGRT

SEQ ID NO: 517883 - protein, 10 aa, Influenza virus
YGFHHSNAEG

SEQ ID NO: 517884 - protein, 10 aa, Influenza virus
YGFHHSNSEG

SEQ ID NO: 517885 - protein, 10 aa, Influenza virus
YGFIIKGRSH

SEQ ID NO: 517886 - protein, 10 aa, Influenza virus
YGFIVKGRSH

SEQ ID NO: 517887 - protein, 10 aa, Influenza virus
YGFKHQNAQG

SEQ ID NO: 517888 - protein, 10 aa, Influenza virus
YGFKISKRGG

SEQ ID NO: 517889 - protein, 10 aa, Influenza virus
YGFKISKRGN

SEQ ID NO: 517890 - protein, 10 aa, Influenza virus
YGFKISKRGS

SEQ ID NO: 517891 - protein, 10 aa, Influenza virus
YGFQHQNAEG

SEQ ID NO: 517892 - protein, 10 aa, Influenza virus
YGFQHQNEQG

SEQ ID NO: 517893 - protein, 10 aa, Influenza virus
YGFQHQNSEG

SEQ ID NO: 517894 - protein, 10 aa, Influenza virus
YGFQHRDEEG

SEQ ID NO: 517895 - protein, 10 aa, Influenza virus
YGFQHRNEEG

SEQ ID NO: 517896 - protein, 10 aa, Influenza virus
YGFQHSNAQG

SEQ ID NO: 517897 - protein, 10 aa, Influenza virus
YGFQHSNDQG

SEQ ID NO: 517898 - protein, 10 aa, Influenza virus
YGFQHSNEQG

SEQ ID NO: 517899 - protein, 10 aa, Influenza virus
YGFQHTNDQG

SEQ ID NO: 517900 - protein, 10 aa, Influenza virus
YGFRHHNSEG

SEQ ID NO: 517901 - protein, 10 aa, Influenza virus
YGFRHLNSEG

SEQ ID NO: 517902 - protein, 10 aa, Influenza virus
YGFRHQKAQG

SEQ ID NO: 517903 - protein, 10 aa, Influenza virus
YGFRHQNAEG

SEQ ID NO: 517904 - protein, 10 aa, Influenza virus
YGFRHQNAQG

SEQ ID NO: 517905 - protein, 10 aa, Influenza virus
YGFRHQNSEG

SEQ ID NO: 517906 - protein, 10 aa, Influenza virus
YGFRHQNSQG

SEQ ID NO: 517907 - protein, 10 aa, Influenza virus
YGFRHQNTQG

SEQ ID NO: 517908 - protein, 10 aa, Influenza virus
YGFRISKRGS

SEQ ID NO: 517909 - protein, 10 aa, Influenza virus
YGFRYQNSEG

SEQ ID NO: 517910 - protein, 10 aa, Influenza virus
YGFVANFSME

SEQ ID NO: 517911 - protein, 10 aa, Influenza virus
YGGIPTDVVR

SEQ ID NO: 517912 - protein, 10 aa, Influenza virus
YGGLNKSKPY

SEQ ID NO: 517913 - protein, 10 aa, Influenza virus
YGGMPTDVVR

SEQ ID NO: 517914 - protein, 10 aa, Influenza virus
YGGVPTDVIR

SEQ ID NO: 517915 - protein, 10 aa, Influenza virus
YGGVPTDVMR

SEQ ID NO: 517916 - protein, 10 aa, Influenza virus
YGGVPTDVVR

SEQ ID NO: 517917 - protein, 10 aa, Influenza virus
YGHLITGKSH

SEQ ID NO: 517918 - protein, 10 aa, Influenza virus
YGHLTTGKSH

SEQ ID NO: 517919 - protein, 10 aa, Influenza virus
YGHLVTGKSH

SEQ ID NO: 517920 - protein, 10 aa, Influenza virus
YGKDNAIRIG

SEQ ID NO: 517921 - protein, 10 aa, Influenza virus
YGKDNAVRIG

SEQ ID NO: 517922 - protein, 10 aa, Influenza virus
YGKGRIFQSH

SEQ ID NO: 517923 - protein, 10 aa, Influenza virus
YGKGRIFQSP

SEQ ID NO: 517924 - protein, 10 aa, Influenza virus
YGKGRIFQSR

SEQ ID NO: 517925 - protein, 10 aa, Influenza virus
YGNCDAKCQT

SEQ ID NO: 517926 - protein, 10 aa, Influenza virus
YGNCDTKCQT

SEQ ID NO: 517927 - protein, 10 aa, Influenza virus
YGNCNAKCQT

SEQ ID NO: 517928 - protein, 10 aa, Influenza virus
YGNCNTKCQT

SEQ ID NO: 517929 - protein, 10 aa, Influenza virus
YGNDVWMGRT

SEQ ID NO: 517930 - protein, 10 aa, Influenza virus
YGNGAWIGRT

SEQ ID NO: 517931 - protein, 10 aa, Influenza virus
YGNGVWIGRT

SEQ ID NO: 517932 - protein, 10 aa, Influenza virus
YGNGVWMGRT

SEQ ID NO: 517933 - protein, 10 aa, Influenza virus
YGNPKCDIHL

SEQ ID NO: 517934 - protein, 10 aa, Influenza virus
YGNPKCDTHL

SEQ ID NO: 517935 - protein, 10 aa, Influenza virus
YGNPKCDVHL

SEQ ID NO: 517936 - protein, 10 aa, Influenza virus
YGPALSINEL

SEQ ID NO: 517937 - protein, 10 aa, Influenza virus
YGPALSISEL

SEQ ID NO: 517938 - protein, 10 aa, Influenza virus
YGPINVTKEN

SEQ ID NO: 517939 - protein, 10 aa, Influenza virus
YGRGRIFQSR

SEQ ID NO: 517940 - protein, 10 aa, Influenza virus
YGRIIQNEDI

SEQ ID NO: 517941 - protein, 10 aa, Influenza virus
YGSDVWMGRT

SEQ ID NO: 517942 - protein, 10 aa, Influenza virus
YGSENKLITV

SEQ ID NO: 517943 - protein, 10 aa, Influenza virus
YGSGAKLITV

SEQ ID NO: 517944 - protein, 10 aa, Influenza virus
YGSGNKLITV

SEQ ID NO: 517945 - protein, 10 aa, Influenza virus
YGSGNKLVTV

SEQ ID NO: 517946 - protein, 10 aa, Influenza virus
YGSGRIFQSG

SEQ ID NO: 517947 - protein, 10 aa, Influenza virus
YGSGSKLITV

SEQ ID NO: 517948 - protein, 10 aa, Influenza virus
YGSGSWPDGA

SEQ ID NO: 517949 - protein, 10 aa, Influenza virus
YGTGNKLITV

SEQ ID NO: 517950 - protein, 10 aa, Influenza virus
YGTGRIFQSG

SEQ ID NO: 517951 - protein, 10 aa, Influenza virus
YGTGRIFQSR

SEQ ID NO: 517952 - protein, 10 aa, Influenza virus
YGTGSWPDGA

SEQ ID NO: 517953 - protein, 10 aa, Influenza virus
YGTGTWPDGA

SEQ ID NO: 517954 - protein, 10 aa, Influenza virus
YGTQPLSISV

SEQ ID NO: 517955 - protein, 10 aa, Influenza virus
YGTQSLSISI

SEQ ID NO: 517956 - protein, 10 aa, Influenza virus
YGTQSLSISV

SEQ ID NO: 517957 - protein, 10 aa, Influenza virus
YGVKGFGFRQ

SEQ ID NO: 517958 - protein, 10 aa, Influenza virus
YGVKGFSFRY

SEQ ID NO: 517959 - protein, 10 aa, Influenza virus
YGYHHENSQG

SEQ ID NO: 517960 - protein, 10 aa, Influenza virus
YGYHHQNEQG

SEQ ID NO: 517961 - protein, 10 aa, Influenza virus
YGYHHQNGQG

SEQ ID NO: 517962 - protein, 10 aa, Influenza virus
YGYHHSNDQG

SEQ ID NO: 517963 - protein, 10 aa, Influenza virus
YGYIIEEYGK

SEQ ID NO: 517964 - protein, 10 aa, Influenza virus
YGYIIEEYGR

SEQ ID NO: 517965 - protein, 10 aa, Influenza virus
YGYIIEKYGS

SEQ ID NO: 517966 - protein, 10 aa, Influenza virus
YGYIIEKYGT

SEQ ID NO: 517967 - protein, 10 aa, Influenza virus
YGYKHQNAQG

SEQ ID NO: 517968 - protein, 10 aa, Influenza virus
YGYLITGKSH

SEQ ID NO: 517969 - protein, 10 aa, Influenza virus
YGYRHQNAQG

SEQ ID NO: 517970 - protein, 10 aa, Influenza virus
YHANNSKKQI

SEQ ID NO: 517971 - protein, 10 aa, Influenza virus
YHANNSTDTI

SEQ ID NO: 517972 - protein, 10 aa, Influenza virus
YHANNSTDTV

SEQ ID NO: 517973 - protein, 10 aa, Influenza virus
YHANNSTEQV

SEQ ID NO: 517974 - protein, 10 aa, Influenza virus
YHANNSTETV

SEQ ID NO: 517975 - protein, 10 aa, Influenza virus
YHANNSTKQI

SEQ ID NO: 517976 - protein, 10 aa, Influenza virus
YHANNSTKQV

SEQ ID NO: 517977 - protein, 10 aa, Influenza virus
YHANNSTTKV

SEQ ID NO: 517978 - protein, 10 aa, Influenza virus
YHANNSTTQI

SEQ ID NO: 517979 - protein, 10 aa, Influenza virus
YHANNSTTQV

SEQ ID NO: 517980 - protein, 10 aa, Influenza virus
YHDSNVKNLY

SEQ ID NO: 517981 - protein, 10 aa, Influenza virus
YHFEECSCYP

SEQ ID NO: 517982 - protein, 10 aa, Influenza virus
YHHENSQGSG

SEQ ID NO: 517983 - protein, 10 aa, Influenza virus
YHHQNAQGSG

SEQ ID NO: 517984 - protein, 10 aa, Influenza virus
YHHQNEQGSG

SEQ ID NO: 517985 - protein, 10 aa, Influenza virus
YHHQNGQGSG

SEQ ID NO: 517986 - protein, 10 aa, Influenza virus
YHHSNDQGAG

SEQ ID NO: 517987 - protein, 10 aa, Influenza virus
YHHSNDQGSG

SEQ ID NO: 517988 - protein, 10 aa, Influenza virus
YHKCDDECIE

SEQ ID NO: 517989 - protein, 10 aa, Influenza virus
YHKCDDECMD

SEQ ID NO: 517990 - protein, 10 aa, Influenza virus
YHKCDDECMN

SEQ ID NO: 517991 - protein, 10 aa, Influenza virus
YHKCDDECMS

SEQ ID NO: 517992 - protein, 10 aa, Influenza virus
YHKCDNECIE

SEQ ID NO: 517993 - protein, 10 aa, Influenza virus
YHKCDNECMD

SEQ ID NO: 517994 - protein, 10 aa, Influenza virus
YHKCDNGCIE

SEQ ID NO: 517995 - protein, 10 aa, Influenza virus
YHKCDNKCIE

SEQ ID NO: 517996 - protein, 10 aa, Influenza virus
YHKCNDECMN

SEQ ID NO: 517997 - protein, 10 aa, Influenza virus
YHKCNNECIE

SEQ ID NO: 517998 - protein, 10 aa, Influenza virus
YHQIEKEFEQ

SEQ ID NO: 517999 - protein, 10 aa, Influenza virus
YHQIEKEFGQ

SEQ ID NO: 518000 - protein, 10 aa, Influenza virus
YHQSFVPSPG

SEQ ID NO: 518001 - protein, 10 aa, Influenza virus
YHTGRSSFFR

SEQ ID NO: 518002 - protein, 10 aa, Influenza virus
YHWNLALDIV

SEQ ID NO: 518003 - protein, 10 aa, Influenza virus
YHYEECSCYP

SEQ ID NO: 518004 - protein, 10 aa, Influenza virus
YICSGFFGDN

SEQ ID NO: 518005 - protein, 10 aa, Influenza virus
YICSGIFGDN

SEQ ID NO: 518006 - protein, 10 aa, Influenza virus
YICSGLVGDT

SEQ ID NO: 518007 - protein, 10 aa, Influenza virus
YICSGVFGDN

SEQ ID NO: 518008 - protein, 10 aa, Influenza virus
YICSGVFGDS

SEQ ID NO: 518009 - protein, 10 aa, Influenza virus
YICSGVFGDT

SEQ ID NO: 518010 - protein, 10 aa, Influenza virus
YICSGVLGDN

SEQ ID NO: 518011 - protein, 10 aa, Influenza virus
YICSKFHSDT

SEQ ID NO: 518012 - protein, 10 aa, Influenza virus
YICSPVLTDN

SEQ ID NO: 518013 - protein, 10 aa, Influenza virus
YICTGILTDT

SEQ ID NO: 518014 - protein, 10 aa, Influenza virus
YICTGVLTDT

SEQ ID NO: 518015 - protein, 10 aa, Influenza virus
YIEGKLSQMS

SEQ ID NO: 518016 - protein, 10 aa, Influenza virus
YIELIRGKPN

SEQ ID NO: 518017 - protein, 10 aa, Influenza virus
YIELIRGRPN

SEQ ID NO: 518018 - protein, 10 aa, Influenza virus
YIEVLHLTQG

SEQ ID NO: 518019 - protein, 10 aa, Influenza virus
YIGKCPKYIP

SEQ ID NO: 518020 - protein, 10 aa, Influenza virus
YIGKCPKYIS

SEQ ID NO: 518021 - protein, 10 aa, Influenza virus
YIGKCPRYIP

SEQ ID NO: 518022 - protein, 10 aa, Influenza virus
YIIEEYGKGR

SEQ ID NO: 518023 - protein, 10 aa, Influenza virus
YIIEEYGRGR

SEQ ID NO: 518024 - protein, 10 aa, Influenza virus
YIIEKYGSGR

SEQ ID NO: 518025 - protein, 10 aa, Influenza virus
YIIEKYGTGR

SEQ ID NO: 518026 - protein, 10 aa, Influenza virus
YIIRALTLNT

SEQ ID NO: 518027 - protein, 10 aa, Influenza virus
YIKQGSLKLA

SEQ ID NO: 518028 - protein, 10 aa, Influenza virus
YIKQNTLKLA

SEQ ID NO: 518029 - protein, 10 aa, Influenza virus
YIKSDQLKLA

SEQ ID NO: 518030 - protein, 10 aa, Influenza virus
YIKSGQLKLA

SEQ ID NO: 518031 - protein, 10 aa, Influenza virus
YINKTGTFEF

SEQ ID NO: 518032 - protein, 10 aa, Influenza virus
YINRTGTFEF

SEQ ID NO: 518033 - protein, 10 aa, Influenza virus
YINTALLNAS

SEQ ID NO: 518034 - protein, 10 aa, Influenza virus
YINTAMLNAS

SEQ ID NO: 518035 - protein, 10 aa, Influenza virus
YIPSGSLKLA

SEQ ID NO: 518036 - protein, 10 aa, Influenza virus
YIPSNSLKLA

SEQ ID NO: 518037 - protein, 10 aa, Influenza virus
YIPSRSLKLA

SEQ ID NO: 518038 - protein, 10 aa, Influenza virus
YIQMCTELKL

SEQ ID NO: 518039 - protein, 10 aa, Influenza virus
YIQMCTELQL

SEQ ID NO: 518040 - protein, 10 aa, Influenza virus
YIRTNGTSKI

SEQ ID NO: 518041 - protein, 10 aa, Influenza virus
YISIGTSTLN

SEQ ID NO: 518042 - protein, 10 aa, Influenza virus
YISSGSLKLA

SEQ ID NO: 518043 - protein, 10 aa, Influenza virus
YISVGTSTLN

SEQ ID NO: 518044 - protein, 10 aa, Influenza virus
YIVERPKEIE

SEQ ID NO: 518045 - protein, 10 aa, Influenza virus
YIVERPKEME

SEQ ID NO: 518046 - protein, 10 aa, Influenza virus
YIVERPSAPE

SEQ ID NO: 518047 - protein, 10 aa, Influenza virus
YIVERTKEME

SEQ ID NO: 518048 - protein, 10 aa, Influenza virus
YIWGVHHPST

SEQ ID NO: 518049 - protein, 10 aa, Influenza virus
YIWTYQAELL

SEQ ID NO: 518050 - protein, 10 aa, Influenza virus
YKALSIYSCI

SEQ ID NO: 518051 - protein, 10 aa, Influenza virus
YKDIILWFSF

SEQ ID NO: 518052 - protein, 10 aa, Influenza virus
YKDIILWISF

SEQ ID NO: 518053 - protein, 10 aa, Influenza virus
YKDIILWVSF

SEQ ID NO: 518054 - protein, 10 aa, Influenza virus
YKDVIIWFSF

SEQ ID NO: 518055 - protein, 10 aa, Influenza virus
YKDVILWFSF

SEQ ID NO: 518056 - protein, 10 aa, Influenza virus
YKDVILWFSL

SEQ ID NO: 518057 - protein, 10 aa, Influenza virus
YKDWILWISF

SEQ ID NO: 518058 - protein, 10 aa, Influenza virus
YKDWVLWISF

SEQ ID NO: 518059 - protein, 10 aa, Influenza virus
YKEESQLKRQ

SEQ ID NO: 518060 - protein, 10 aa, Influenza virus
YKEICIAWSS

SEQ ID NO: 518061 - protein, 10 aa, Influenza virus
YKEICVAWSS

SEQ ID NO: 518062 - protein, 10 aa, Influenza virus
YKEIRIAWSS

SEQ ID NO: 518063 - protein, 10 aa, Influenza virus
YKEVILWFSF

SEQ ID NO: 518064 - protein, 10 aa, Influenza virus
YKGRLCNPLN

SEQ ID NO: 518065 - protein, 10 aa, Influenza virus
YKHQNAQGEG

SEQ ID NO: 518066 - protein, 10 aa, Influenza virus
YKILKIKKGK

SEQ ID NO: 518067 - protein, 10 aa, Influenza virus
YKILKIRKGK

SEQ ID NO: 518068 - protein, 10 aa, Influenza virus
YKILSICSCI

SEQ ID NO: 518069 - protein, 10 aa, Influenza virus
YKILSIYSCI

SEQ ID NO: 518070 - protein, 10 aa, Influenza virus
YKILSIYSSV

SEQ ID NO: 518071 - protein, 10 aa, Influenza virus
YKILSIYSTV

SEQ ID NO: 518072 - protein, 10 aa, Influenza virus
YKILTIYSTA

SEQ ID NO: 518073 - protein, 10 aa, Influenza virus
YKILTIYSTV

SEQ ID NO: 518074 - protein, 10 aa, Influenza virus
YKISKSTKST

SEQ ID NO: 518075 - protein, 10 aa, Influenza virus
YKKLKREITF

SEQ ID NO: 518076 - protein, 10 aa, Influenza virus
YKKLKREMTF

SEQ ID NO: 518077 - protein, 10 aa, Influenza virus
YKMNIQILIL

SEQ ID NO: 518078 - protein, 10 aa, Influenza virus
YKMNNQILIL

SEQ ID NO: 518079 - protein, 10 aa, Influenza virus
YKMNTKILVL

SEQ ID NO: 518080 - protein, 10 aa, Influenza virus
YKMNTQILIF

SEQ ID NO: 518081 - protein, 10 aa, Influenza virus
YKMNTQILIL

SEQ ID NO: 518082 - protein, 10 aa, Influenza virus
YKMNTQILVF

SEQ ID NO: 518083 - protein, 10 aa, Influenza virus
YKMNTRILIL

SEQ ID NO: 518084 - protein, 10 aa, Influenza virus
YKNANTLSSV

SEQ ID NO: 518085 - protein, 10 aa, Influenza virus
YKNANTLTSV

SEQ ID NO: 518086 - protein, 10 aa, Influenza virus
YKNNTWVNQT

SEQ ID NO: 518087 - protein, 10 aa, Influenza virus
YKNTNTLSSV

SEQ ID NO: 518088 - protein, 10 aa, Influenza virus
YKNWILWISF

SEQ ID NO: 518089 - protein, 10 aa, Influenza virus
YKRIRLFDYS

SEQ ID NO: 518090 - protein, 10 aa, Influenza virus
YKRVRLFDYS

SEQ ID NO: 518091 - protein, 10 aa, Influenza virus
YKSTPSAIDQ

SEQ ID NO: 518092 - protein, 10 aa, Influenza virus
YKSTQAAIDQ

SEQ ID NO: 518093 - protein, 10 aa, Influenza virus
YKSTQAAVDQ

SEQ ID NO: 518094 - protein, 10 aa, Influenza virus
YKSTQKTIDQ

SEQ ID NO: 518095 - protein, 10 aa, Influenza virus
YKSTQSAIDQ

SEQ ID NO: 518096 - protein, 10 aa, Influenza virus
YKSTQSAINQ

SEQ ID NO: 518097 - protein, 10 aa, Influenza virus
YKSTQSAVDQ

SEQ ID NO: 518098 - protein, 10 aa, Influenza virus
YKSTQSAVNQ

SEQ ID NO: 518099 - protein, 10 aa, Influenza virus
YKSWSKPQCQ

SEQ ID NO: 518100 - protein, 10 aa, Influenza virus
YKVATGRVTV

SEQ ID NO: 518101 - protein, 10 aa, Influenza virus
YKVGYLCAGI

SEQ ID NO: 518102 - protein, 10 aa, Influenza virus
YKVLAIYSCI

SEQ ID NO: 518103 - protein, 10 aa, Influenza virus
YKVLSIYSCI

SEQ ID NO: 518104 - protein, 10 aa, Influenza virus
YKYGNGVWIG

SEQ ID NO: 518105 - protein, 10 aa, Influenza virus
YKYKIFKNGK

SEQ ID NO: 518106 - protein, 10 aa, Influenza virus
YLCAGIPSDT

SEQ ID NO: 518107 - protein, 10 aa, Influenza virus
YLCAGIPTDT

SEQ ID NO: 518108 - protein, 10 aa, Influenza virus
YLCAGLPSDT

SEQ ID NO: 518109 - protein, 10 aa, Influenza virus
YLCSGLVGDT

SEQ ID NO: 518110 - protein, 10 aa, Influenza virus
YLCSKILTDT

SEQ ID NO: 518111 - protein, 10 aa, Influenza virus
YLCSKTLTDT

SEQ ID NO: 518112 - protein, 10 aa, Influenza virus
YLCSKVLTDT

SEQ ID NO: 518113 - protein, 10 aa, Influenza virus
YLCSRILTDT

SEQ ID NO: 518114 - protein, 10 aa, Influenza virus
YLCSRVLTDT

SEQ ID NO: 518115 - protein, 10 aa, Influenza virus
YLCTGILTDT

SEQ ID NO: 518116 - protein, 10 aa, Influenza virus
YLCTGVLTDT

SEQ ID NO: 518117 - protein, 10 aa, Influenza virus
YLECRTFFLT

SEQ ID NO: 518118 - protein, 10 aa, Influenza virus
YLEEHPNAGK

SEQ ID NO: 518119 - protein, 10 aa, Influenza virus
YLEEHPSAGK

SEQ ID NO: 518120 - protein, 10 aa, Influenza virus
YLEEHPSAGR

SEQ ID NO: 518121 - protein, 10 aa, Influenza virus
YLEEHPSTGK

SEQ ID NO: 518122 - protein, 10 aa, Influenza virus
YLEENPSAGK

SEQ ID NO: 518123 - protein, 10 aa, Influenza virus
YLEKANKIKS

SEQ ID NO: 518124 - protein, 10 aa, Influenza virus
YLEKANKIKT

SEQ ID NO: 518125 - protein, 10 aa, Influenza virus
YLEKASKIKS

SEQ ID NO: 518126 - protein, 10 aa, Influenza virus
YLIEDPAAPH

SEQ ID NO: 518127 - protein, 10 aa, Influenza virus
YLIEDPGAPH

SEQ ID NO: 518128 - protein, 10 aa, Influenza virus
YLIEDPNAPH

SEQ ID NO: 518129 - protein, 10 aa, Influenza virus
YLIEDPNAPN

SEQ ID NO: 518130 - protein, 10 aa, Influenza virus
YLIEDPSAPH

SEQ ID NO: 518131 - protein, 10 aa, Influenza virus
YLIEDPTAPH

SEQ ID NO: 518132 - protein, 10 aa, Influenza virus
YLIGKTSWSY

SEQ ID NO: 518133 - protein, 10 aa, Influenza virus
YLIRALTLNT

SEQ ID NO: 518134 - protein, 10 aa, Influenza virus
YLIRTLTLNT

SEQ ID NO: 518135 - protein, 10 aa, Influenza virus
YLITGKSHGR

SEQ ID NO: 518136 - protein, 10 aa, Influenza virus
YLLFQDILMR

SEQ ID NO: 518137 - protein, 10 aa, Influenza virus
YLLKGESHCR

SEQ ID NO: 518138 - protein, 10 aa, Influenza virus
YLLKGESHGK

SEQ ID NO: 518139 - protein, 10 aa, Influenza virus
YLLKGESHGR

SEQ ID NO: 518140 - protein, 10 aa, Influenza virus
YLLKGESYGR

SEQ ID NO: 518141 - protein, 10 aa, Influenza virus
YLLLNKSLCN

SEQ ID NO: 518142 - protein, 10 aa, Influenza virus
YLLLNKSLCS

SEQ ID NO: 518143 - protein, 10 aa, Influenza virus
YLLRGESHGR

SEQ ID NO: 518144 - protein, 10 aa, Influenza virus
YLMLNKSLCK

SEQ ID NO: 518145 - protein, 10 aa, Influenza virus
YLMLSKSLCK

SEQ ID NO: 518146 - protein, 10 aa, Influenza virus
YLNGREWSYI

SEQ ID NO: 518147 - protein, 10 aa, Influenza virus
YLPDLYDYKE

SEQ ID NO: 518148 - protein, 10 aa, Influenza virus
YLQSFTPSPG

SEQ ID NO: 518149 - protein, 10 aa, Influenza virus
YLSGREWSYI

SEQ ID NO: 518150 - protein, 10 aa, Influenza virus
YLSNNATDTV

SEQ ID NO: 518151 - protein, 10 aa, Influenza virus
YLSNNSSDTV

SEQ ID NO: 518152 - protein, 10 aa, Influenza virus
YLSNNSTDKI

SEQ ID NO: 518153 - protein, 10 aa, Influenza virus
YLSNNSTDKV

SEQ ID NO: 518154 - protein, 10 aa, Influenza virus
YLSNNSTDTV

SEQ ID NO: 518155 - protein, 10 aa, Influenza virus
YLSNNSTEKV

SEQ ID NO: 518156 - protein, 10 aa, Influenza virus
YLSNNSTERV

SEQ ID NO: 518157 - protein, 10 aa, Influenza virus
YLSTNSSDKV

SEQ ID NO: 518158 - protein, 10 aa, Influenza virus
YLSTNSSEKV

SEQ ID NO: 518159 - protein, 10 aa, Influenza virus
YLSTNSSERV

SEQ ID NO: 518160 - protein, 10 aa, Influenza virus
YLSTNSTEKV

SEQ ID NO: 518161 - protein, 10 aa, Influenza virus
YLSTNSTETV

SEQ ID NO: 518162 - protein, 10 aa, Influenza virus
YLTGTWDTLI

SEQ ID NO: 518163 - protein, 10 aa, Influenza virus
YLVLNKSLCK

SEQ ID NO: 518164 - protein, 10 aa, Influenza virus
YLWGVHHPSS

SEQ ID NO: 518165 - protein, 10 aa, Influenza virus
YMCSGLVGDT

SEQ ID NO: 518166 - protein, 10 aa, Influenza virus
YMEKANKIKS

SEQ ID NO: 518167 - protein, 10 aa, Influenza virus
YMLERELVRK

SEQ ID NO: 518168 - protein, 10 aa, Influenza virus
YMNTALLNAS

SEQ ID NO: 518169 - protein, 10 aa, Influenza virus
YMNVKSLKLA

SEQ ID NO: 518170 - protein, 10 aa, Influenza virus
YMSNNSTEKV

SEQ ID NO: 518171 - protein, 10 aa, Influenza virus
YNADLLVAME

SEQ ID NO: 518172 - protein, 10 aa, Influenza virus
YNADVLVALE

SEQ ID NO: 518173 - protein, 10 aa, Influenza virus
YNAEFLVALE

SEQ ID NO: 518174 - protein, 10 aa, Influenza virus
YNAEFLVAVE

SEQ ID NO: 518175 - protein, 10 aa, Influenza virus
YNAEILVALE

SEQ ID NO: 518176 - protein, 10 aa, Influenza virus
YNAEILVLME

SEQ ID NO: 518177 - protein, 10 aa, Influenza virus
YNAELFVLME

SEQ ID NO: 518178 - protein, 10 aa, Influenza virus
YNAELIVLLE

SEQ ID NO: 518179 - protein, 10 aa, Influenza virus
YNAELLIAME

SEQ ID NO: 518180 - protein, 10 aa, Influenza virus
YNAELLILLE

SEQ ID NO: 518181 - protein, 10 aa, Influenza virus
YNAELLVALE

SEQ ID NO: 518182 - protein, 10 aa, Influenza virus
YNAELLVAME

SEQ ID NO: 518183 - protein, 10 aa, Influenza virus
YNAELLVLIE

SEQ ID NO: 518184 - protein, 10 aa, Influenza virus
YNAELLVLLE

SEQ ID NO: 518185 - protein, 10 aa, Influenza virus
YNAELLVLLG

SEQ ID NO: 518186 - protein, 10 aa, Influenza virus
YNAELLVLME

SEQ ID NO: 518187 - protein, 10 aa, Influenza virus
YNAEVLVLME

SEQ ID NO: 518188 - protein, 10 aa, Influenza virus
YNAGLLVALE

SEQ ID NO: 518189 - protein, 10 aa, Influenza virus
YNAKLLVLIE

SEQ ID NO: 518190 - protein, 10 aa, Influenza virus
YNAKLLVLLE

SEQ ID NO: 518191 - protein, 10 aa, Influenza virus
YNAQLLVLLE

SEQ ID NO: 518192 - protein, 10 aa, Influenza virus
YNAQLLVWLE

SEQ ID NO: 518193 - protein, 10 aa, Influenza virus
YNARLLVLLE

SEQ ID NO: 518194 - protein, 10 aa, Influenza virus
YNETFVNITN

SEQ ID NO: 518195 - protein, 10 aa, Influenza virus
YNETFVNVTH

SEQ ID NO: 518196 - protein, 10 aa, Influenza virus
YNETFVNVTN

SEQ ID NO: 518197 - protein, 10 aa, Influenza virus
YNFEKEGYSL

SEQ ID NO: 518198 - protein, 10 aa, Influenza virus
YNGIITDTFK

SEQ ID NO: 518199 - protein, 10 aa, Influenza virus
YNGIITDTLK

SEQ ID NO: 518200 - protein, 10 aa, Influenza virus
YNGKSLGIQS

SEQ ID NO: 518201 - protein, 10 aa, Influenza virus
YNGQKSWMKI

SEQ ID NO: 518202 - protein, 10 aa, Influenza virus
YNGQKSWTKI

SEQ ID NO: 518203 - protein, 10 aa, Influenza virus
YNGQRSWMKI

SEQ ID NO: 518204 - protein, 10 aa, Influenza virus
YNGVITDTLK

SEQ ID NO: 518205 - protein, 10 aa, Influenza virus
YNHEDYKEES

SEQ ID NO: 518206 - protein, 10 aa, Influenza virus
YNHEDYREES

SEQ ID NO: 518207 - protein, 10 aa, Influenza virus
YNHKDYEEEA

SEQ ID NO: 518208 - protein, 10 aa, Influenza virus
YNHKEYEEEA

SEQ ID NO: 518209 - protein, 10 aa, Influenza virus
YNHTEYRQEA

SEQ ID NO: 518210 - protein, 10 aa, Influenza virus
YNIRNLHIPE

SEQ ID NO: 518211 - protein, 10 aa, Influenza virus
YNKIEFEPFQ

SEQ ID NO: 518212 - protein, 10 aa, Influenza virus
YNKLEFEPFQ

SEQ ID NO: 518213 - protein, 10 aa, Influenza virus
YNKMEFEPFQ

SEQ ID NO: 518214 - protein, 10 aa, Influenza virus
YNKTVINNIT

SEQ ID NO: 518215 - protein, 10 aa, Influenza virus
YNKVEFEPFQ

SEQ ID NO: 518216 - protein, 10 aa, Influenza virus
YNKVRMQLRD

SEQ ID NO: 518217 - protein, 10 aa, Influenza virus
YNNTNGEQIL

SEQ ID NO: 518218 - protein, 10 aa, Influenza virus
YNNTSGEQIL

SEQ ID NO: 518219 - protein, 10 aa, Influenza virus
YNNTSGEQML

SEQ ID NO: 518220 - protein, 10 aa, Influenza virus
YNNTSGEQVL

SEQ ID NO: 518221 - protein, 10 aa, Influenza virus
YNNTSGKQML

SEQ ID NO: 518222 - protein, 10 aa, Influenza virus
YNNTTGRDVL

SEQ ID NO: 518223 - protein, 10 aa, Influenza virus
YNNTVINNIT

SEQ ID NO: 518224 - protein, 10 aa, Influenza virus
YNNTVINNMT

SEQ ID NO: 518225 - protein, 10 aa, Influenza virus
YNNTVVNNIT

SEQ ID NO: 518226 - protein, 10 aa, Influenza virus
YNPCFYVELI

SEQ ID NO: 518227 - protein, 10 aa, Influenza virus
YNRKEYEEEA

SEQ ID NO: 518228 - protein, 10 aa, Influenza virus
YNRRLTTTIK

SEQ ID NO: 518229 - protein, 10 aa, Influenza virus
YNRRPTTTIK

SEQ ID NO: 518230 - protein, 10 aa, Influenza virus
YNSKFESVAW

SEQ ID NO: 518231 - protein, 10 aa, Influenza virus
YNSRFESVAW

SEQ ID NO: 518232 - protein, 10 aa, Influenza virus
YNSTVVNNIT

SEQ ID NO: 518233 - protein, 10 aa, Influenza virus
YNTELLVLME

SEQ ID NO: 518234 - protein, 10 aa, Influenza virus
YNVELLVLME

SEQ ID NO: 518235 - protein, 10 aa, Influenza virus
YNVGYLCAGI

SEQ ID NO: 518236 - protein, 10 aa, Influenza virus
YNYPKYEEES

SEQ ID NO: 518237 - protein, 10 aa, Influenza virus
YNYPKYSEES

SEQ ID NO: 518238 - protein, 10 aa, Influenza virus
YPDVRCICRD

SEQ ID NO: 518239 - protein, 10 aa, Influenza virus
YPDVRCTCRD

SEQ ID NO: 518240 - protein, 10 aa, Influenza virus
YPDVRCVCRD

SEQ ID NO: 518241 - protein, 10 aa, Influenza virus
YPFDVPDYQS

SEQ ID NO: 518242 - protein, 10 aa, Influenza virus
YPFDVPEYQS

SEQ ID NO: 518243 - protein, 10 aa, Influenza virus
YPFDVPGYQS

SEQ ID NO: 518244 - protein, 10 aa, Influenza virus
YPFDVPNYQS

SEQ ID NO: 518245 - protein, 10 aa, Influenza virus
YPGATINEEA

SEQ ID NO: 518246 - protein, 10 aa, Influenza virus
YPGATVNEEA

SEQ ID NO: 518247 - protein, 10 aa, Influenza virus
YPGATVNEGA

SEQ ID NO: 518248 - protein, 10 aa, Influenza virus
YPGELDNNGE

SEQ ID NO: 518249 - protein, 10 aa, Influenza virus
YPGELNNNGE

SEQ ID NO: 518250 - protein, 10 aa, Influenza virus
YPGEVDNNGE

SEQ ID NO: 518251 - protein, 10 aa, Influenza virus
YPGFVENLEE

SEQ ID NO: 518252 - protein, 10 aa, Influenza virus
YPGKFTNEEA

SEQ ID NO: 518253 - protein, 10 aa, Influenza virus
YPGNFNDYEE

SEQ ID NO: 518254 - protein, 10 aa, Influenza virus
YPGNNNKGVK

SEQ ID NO: 518255 - protein, 10 aa, Influenza virus
YPGNNNNGVK

SEQ ID NO: 518256 - protein, 10 aa, Influenza virus
YPGNPVICLG

SEQ ID NO: 518257 - protein, 10 aa, Influenza virus
YPGNSNNGVK

SEQ ID NO: 518258 - protein, 10 aa, Influenza virus
YPGRFTNEEA

SEQ ID NO: 518259 - protein, 10 aa, Influenza virus
YPGSFNDYEE

SEQ ID NO: 518260 - protein, 10 aa, Influenza virus
YPGSFNNYEE

SEQ ID NO: 518261 - protein, 10 aa, Influenza virus
YPGSIENLEE

SEQ ID NO: 518262 - protein, 10 aa, Influenza virus
YPGSIENQEE

SEQ ID NO: 518263 - protein, 10 aa, Influenza virus
YPGSIKNQEE

SEQ ID NO: 518264 - protein, 10 aa, Influenza virus
YPGSLNDYEE

SEQ ID NO: 518265 - protein, 10 aa, Influenza virus
YPGSNNNGVK

SEQ ID NO: 518266 - protein, 10 aa, Influenza virus
YPGSTVNEEA

SEQ ID NO: 518267 - protein, 10 aa, Influenza virus
YPGSVENLEE

SEQ ID NO: 518268 - protein, 10 aa, Influenza virus
YPGSVENQEE

SEQ ID NO: 518269 - protein, 10 aa, Influenza virus
YPGTTVNEEA

SEQ ID NO: 518270 - protein, 10 aa, Influenza virus
YPGVKGWAFD

SEQ ID NO: 518271 - protein, 10 aa, Influenza virus
YPGVRCICRD

SEQ ID NO: 518272 - protein, 10 aa, Influenza virus
YPIQNLTKVN

SEQ ID NO: 518273 - protein, 10 aa, Influenza virus
YPKYEEESKL

SEQ ID NO: 518274 - protein, 10 aa, Influenza virus
YPKYEEESRL

SEQ ID NO: 518275 - protein, 10 aa, Influenza virus
YPKYSEEAKL

SEQ ID NO: 518276 - protein, 10 aa, Influenza virus
YPKYSEESKL

SEQ ID NO: 518277 - protein, 10 aa, Influenza virus
YPKYSEESRL

SEQ ID NO: 518278 - protein, 10 aa, Influenza virus
YPKYSKEAKL

SEQ ID NO: 518279 - protein, 10 aa, Influenza virus
YPKYSKESKL

SEQ ID NO: 518280 - protein, 10 aa, Influenza virus
YPLQNLTKIN

SEQ ID NO: 518281 - protein, 10 aa, Influenza virus
YPLQNLTKTN

SEQ ID NO: 518282 - protein, 10 aa, Influenza virus
YPLQNLTKVN

SEQ ID NO: 518283 - protein, 10 aa, Influenza virus
YPNDGKVECV

SEQ ID NO: 518284 - protein, 10 aa, Influenza virus
YPNEGKVECI

SEQ ID NO: 518285 - protein, 10 aa, Influenza virus
YPNEGKVECV

SEQ ID NO: 518286 - protein, 10 aa, Influenza virus
YPNLGIVECV

SEQ ID NO: 518287 - protein, 10 aa, Influenza virus
YPNLGKVECV

SEQ ID NO: 518288 - protein, 10 aa, Influenza virus
YPNLGQVECV

SEQ ID NO: 518289 - protein, 10 aa, Influenza virus
YPNMGKVECV

SEQ ID NO: 518290 - protein, 10 aa, Influenza virus
YPNNGKVECI

SEQ ID NO: 518291 - protein, 10 aa, Influenza virus
YPNSGKVECV

SEQ ID NO: 518292 - protein, 10 aa, Influenza virus
YPNVRCVCRD

SEQ ID NO: 518293 - protein, 10 aa, Influenza virus
YPQYPNVRCV

SEQ ID NO: 518294 - protein, 10 aa, Influenza virus
YPRYPDVRCV

SEQ ID NO: 518295 - protein, 10 aa, Influenza virus
YPRYPNVRCV

SEQ ID NO: 518296 - protein, 10 aa, Influenza virus
YQAELLIAME

SEQ ID NO: 518297 - protein, 10 aa, Influenza virus
YQAELLVAME

SEQ ID NO: 518298 - protein, 10 aa, Influenza virus
YQAKFEAVAW

SEQ ID NO: 518299 - protein, 10 aa, Influenza virus
YQAKFESVAW

SEQ ID NO: 518300 - protein, 10 aa, Influenza virus
YQARFEAVAW

SEQ ID NO: 518301 - protein, 10 aa, Influenza virus
YQARFESVAW

SEQ ID NO: 518302 - protein, 10 aa, Influenza virus
YQFALGHGTT

SEQ ID NO: 518303 - protein, 10 aa, Influenza virus
YQFALGQGAT

SEQ ID NO: 518304 - protein, 10 aa, Influenza virus
YQFALGQGTT

SEQ ID NO: 518305 - protein, 10 aa, Influenza virus
YQGRLCNPLN

SEQ ID NO: 518306 - protein, 10 aa, Influenza virus
YQGRLCNPMN

SEQ ID NO: 518307 - protein, 10 aa, Influenza virus
YQIGNVINWT

SEQ ID NO: 518308 - protein, 10 aa, Influenza virus
YQIGYICSGV

SEQ ID NO: 518309 - protein, 10 aa, Influenza virus
YQIGYVCSGI

SEQ ID NO: 518310 - protein, 10 aa, Influenza virus
YQIGYVCSGV

SEQ ID NO: 518311 - protein, 10 aa, Influenza virus
YQILAIYATV

SEQ ID NO: 518312 - protein, 10 aa, Influenza virus
YQILAIYSTA

SEQ ID NO: 518313 - protein, 10 aa, Influenza virus
YQILAIYSTV

SEQ ID NO: 518314 - protein, 10 aa, Influenza virus
YQILSIYSTA

SEQ ID NO: 518315 - protein, 10 aa, Influenza virus
YQILSIYSTV

SEQ ID NO: 518316 - protein, 10 aa, Influenza virus
YQILSLYSTV

SEQ ID NO: 518317 - protein, 10 aa, Influenza virus
YQILVIYATV

SEQ ID NO: 518318 - protein, 10 aa, Influenza virus
YQKCCNLFEK

SEQ ID NO: 518319 - protein, 10 aa, Influenza virus
YQKCCSLFEK

SEQ ID NO: 518320 - protein, 10 aa, Influenza virus
YQKCCTLFEK

SEQ ID NO: 518321 - protein, 10 aa, Influenza virus
YQKQMTRGLF

SEQ ID NO: 518322 - protein, 10 aa, Influenza virus
YQKRMGLQMQ

SEQ ID NO: 518323 - protein, 10 aa, Influenza virus
YQKRMGVQIQ

SEQ ID NO: 518324 - protein, 10 aa, Influenza virus
YQKRMGVQLQ

SEQ ID NO: 518325 - protein, 10 aa, Influenza virus
YQKRMGVQMH

SEQ ID NO: 518326 - protein, 10 aa, Influenza virus
YQKRMGVQMQ

SEQ ID NO: 518327 - protein, 10 aa, Influenza virus
YQKRMTRGLF

SEQ ID NO: 518328 - protein, 10 aa, Influenza virus
YQNNFVPVIG

SEQ ID NO: 518329 - protein, 10 aa, Influenza virus
YQNNFVPVMG

SEQ ID NO: 518330 - protein, 10 aa, Influenza virus
YQNNFVPVVG

SEQ ID NO: 518331 - protein, 10 aa, Influenza virus
YQNNFVPVVR

SEQ ID NO: 518332 - protein, 10 aa, Influenza virus
YQNSFVPVVG

SEQ ID NO: 518333 - protein, 10 aa, Influenza virus
YQQSFSPSPG

SEQ ID NO: 518334 - protein, 10 aa, Influenza virus
YQQSFTPSPE

SEQ ID NO: 518335 - protein, 10 aa, Influenza virus
YQQSFTPSPG

SEQ ID NO: 518336 - protein, 10 aa, Influenza virus
YQQSFVPSPG

SEQ ID NO: 518337 - protein, 10 aa, Influenza virus
YQRCCNLFEK

SEQ ID NO: 518338 - protein, 10 aa, Influenza virus
YQRSKFLLMD

SEQ ID NO: 518339 - protein, 10 aa, Influenza virus
YQRTRALVRS

SEQ ID NO: 518340 - protein, 10 aa, Influenza virus
YQRTRALVRT

SEQ ID NO: 518341 - protein, 10 aa, Influenza virus
YQSIRSILAN

SEQ ID NO: 518342 - protein, 10 aa, Influenza virus
YQSLRSILAN

SEQ ID NO: 518343 - protein, 10 aa, Influenza virus
YQSLRSILAS

SEQ ID NO: 518344 - protein, 10 aa, Influenza virus
YQSNNSTDTV

SEQ ID NO: 518345 - protein, 10 aa, Influenza virus
YQSNNSTNTV

SEQ ID NO: 518346 - protein, 10 aa, Influenza virus
YQSRFEAVAW

SEQ ID NO: 518347 - protein, 10 aa, Influenza virus
YQSTNSTEAV

SEQ ID NO: 518348 - protein, 10 aa, Influenza virus
YQSTNSTEIV

SEQ ID NO: 518349 - protein, 10 aa, Influenza virus
YQSTNSTETV

SEQ ID NO: 518350 - protein, 10 aa, Influenza virus
YQTNNSTDTV

SEQ ID NO: 518351 - protein, 10 aa, Influenza virus
YQTNNSTETV

SEQ ID NO: 518352 - protein, 10 aa, Influenza virus
YRACFYVELI

SEQ ID NO: 518353 - protein, 10 aa, Influenza virus
YRAESLQNRI

SEQ ID NO: 518354 - protein, 10 aa, Influenza virus
YRALISWEMG

SEQ ID NO: 518355 - protein, 10 aa, Influenza virus
YRALISWPLS

SEQ ID NO: 518356 - protein, 10 aa, Influenza virus
YRALISWPQS

SEQ ID NO: 518357 - protein, 10 aa, Influenza virus
YRALMSVPLG

SEQ ID NO: 518358 - protein, 10 aa, Influenza virus
YRALMSVPMG

SEQ ID NO: 518359 - protein, 10 aa, Influenza virus
YRALSIYSCI

SEQ ID NO: 518360 - protein, 10 aa, Influenza virus
YRALVSWPLS

SEQ ID NO: 518361 - protein, 10 aa, Influenza virus
YRCHKGDTQI

SEQ ID NO: 518362 - protein, 10 aa, Influenza virus
YRCHRGDAQI

SEQ ID NO: 518363 - protein, 10 aa, Influenza virus
YRCHRGDMQI

SEQ ID NO: 518364 - protein, 10 aa, Influenza virus
YRCHRGDTHI

SEQ ID NO: 518365 - protein, 10 aa, Influenza virus
YRCHRGDTQI

SEQ ID NO: 518366 - protein, 10 aa, Influenza virus
YRDEAINNRF

SEQ ID NO: 518367 - protein, 10 aa, Influenza virus
YRDEAINNRI

SEQ ID NO: 518368 - protein, 10 aa, Influenza virus
YRDEAINSRF

SEQ ID NO: 518369 - protein, 10 aa, Influenza virus
YRDEAISNRF

SEQ ID NO: 518370 - protein, 10 aa, Influenza virus
YRDEALNNRF

SEQ ID NO: 518371 - protein, 10 aa, Influenza virus
YRDEALNNRS

SEQ ID NO: 518372 - protein, 10 aa, Influenza virus
YRDEAVNNRF

SEQ ID NO: 518373 - protein, 10 aa, Influenza virus
YRDNWKGSNR

SEQ ID NO: 518374 - protein, 10 aa, Influenza virus
YRDWSKPQCQ

SEQ ID NO: 518375 - protein, 10 aa, Influenza virus
YREEALLNRI

SEQ ID NO: 518376 - protein, 10 aa, Influenza virus
YREEALLNRL

SEQ ID NO: 518377 - protein, 10 aa, Influenza virus
YREEAMQNRI

SEQ ID NO: 518378 - protein, 10 aa, Influenza virus
YREEAMQNRL

SEQ ID NO: 518379 - protein, 10 aa, Influenza virus
YREEAMQNRM

SEQ ID NO: 518380 - protein, 10 aa, Influenza virus
YREEAMQNRV

SEQ ID NO: 518381 - protein, 10 aa, Influenza virus
YREESLLNRL

SEQ ID NO: 518382 - protein, 10 aa, Influenza virus
YREESQLKKQ

SEQ ID NO: 518383 - protein, 10 aa, Influenza virus
YREESQLKRQ

SEQ ID NO: 518384 - protein, 10 aa, Influenza virus
YREICIAWSS

SEQ ID NO: 518385 - protein, 10 aa, Influenza virus
YREVCIAWSS

SEQ ID NO: 518386 - protein, 10 aa, Influenza virus
YRGRLCNPLN

SEQ ID NO: 518387 - protein, 10 aa, Influenza virus
YRHQNAQGEG

SEQ ID NO: 518388 - protein, 10 aa, Influenza virus
YRICKLVGIN

SEQ ID NO: 518389 - protein, 10 aa, Influenza virus
YRILSIYSTV

SEQ ID NO: 518390 - protein, 10 aa, Influenza virus
YRIWSKPQCQ

SEQ ID NO: 518391 - protein, 10 aa, Influenza virus
YRKLKREITF

SEQ ID NO: 518392 - protein, 10 aa, Influenza virus
YRKRMTRGLF

SEQ ID NO: 518393 - protein, 10 aa, Influenza virus
YRNEAINNRF

SEQ ID NO: 518394 - protein, 10 aa, Influenza virus
YRNEALNNRF

SEQ ID NO: 518395 - protein, 10 aa, Influenza virus
YRNMRWLTLK

SEQ ID NO: 518396 - protein, 10 aa, Influenza virus
YRNNRKEPAL

SEQ ID NO: 518397 - protein, 10 aa, Influenza virus
YRNTRKEPAL

SEQ ID NO: 518398 - protein, 10 aa, Influenza virus
YRNVVWLIKK

SEQ ID NO: 518399 - protein, 10 aa, Influenza virus
YRNWSKPQCQ

SEQ ID NO: 518400 - protein, 10 aa, Influenza virus
YRQEALQNRI

SEQ ID NO: 518401 - protein, 10 aa, Influenza virus
YRQSFSPSPG

SEQ ID NO: 518402 - protein, 10 aa, Influenza virus
YRRPIGISSM

SEQ ID NO: 518403 - protein, 10 aa, Influenza virus
YRRPVGISSM

SEQ ID NO: 518404 - protein, 10 aa, Influenza virus
YRSINWLTKK

SEQ ID NO: 518405 - protein, 10 aa, Influenza virus
YRSIRWLTLK

SEQ ID NO: 518406 - protein, 10 aa, Influenza virus
YRSLIKFPIG

SEQ ID NO: 518407 - protein, 10 aa, Influenza virus
YRSLIQFPIG

SEQ ID NO: 518408 - protein, 10 aa, Influenza virus
YRSLIQFPMG

SEQ ID NO: 518409 - protein, 10 aa, Influenza virus
YRSLIRFPIG

SEQ ID NO: 518410 - protein, 10 aa, Influenza virus
YRSLIRFPVG

SEQ ID NO: 518411 - protein, 10 aa, Influenza virus
YRSLISWPLS

SEQ ID NO: 518412 - protein, 10 aa, Influenza virus
YRSMKWLTLK

SEQ ID NO: 518413 - protein, 10 aa, Influenza virus
YRSMRWLTLK

SEQ ID NO: 518414 - protein, 10 aa, Influenza virus
YRSWSKPQCQ

SEQ ID NO: 518415 - protein, 10 aa, Influenza virus
YRTCKLLGIN

SEQ ID NO: 518416 - protein, 10 aa, Influenza virus
YRTCKLVGIN

SEQ ID NO: 518417 - protein, 10 aa, Influenza virus
YRTESLQNRI

SEQ ID NO: 518418 - protein, 10 aa, Influenza virus
YRTLLMNELG

SEQ ID NO: 518419 - protein, 10 aa, Influenza virus
YRTLLMSELG

SEQ ID NO: 518420 - protein, 10 aa, Influenza virus
YRYGFVANFS

SEQ ID NO: 518421 - protein, 10 aa, Influenza virus
YRYTYRCHKG

SEQ ID NO: 518422 - protein, 10 aa, Influenza virus
YRYTYRCHRG

SEQ ID NO: 518423 - protein, 10 aa, Influenza virus
YSAGALASCM

SEQ ID NO: 518424 - protein, 10 aa, Influenza virus
YSCIASSIVL

SEQ ID NO: 518425 - protein, 10 aa, Influenza virus
YSCIASSIVM

SEQ ID NO: 518426 - protein, 10 aa, Influenza virus
YSCIASSLIL

SEQ ID NO: 518427 - protein, 10 aa, Influenza virus
YSCIASSLVL

SEQ ID NO: 518428 - protein, 10 aa, Influenza virus
YSCIASSTVL

SEQ ID NO: 518429 - protein, 10 aa, Influenza virus
YSCIASSTVM

SEQ ID NO: 518430 - protein, 10 aa, Influenza virus
YSCIASSVVL

SEQ ID NO: 518431 - protein, 10 aa, Influenza virus
YSDFHFIDEQ

SEQ ID NO: 518432 - protein, 10 aa, Influenza virus
YSDFHFIDER

SEQ ID NO: 518433 - protein, 10 aa, Influenza virus
YSDFHFINEL

SEQ ID NO: 518434 - protein, 10 aa, Influenza virus
YSDFHFINEQ

SEQ ID NO: 518435 - protein, 10 aa, Influenza virus
YSDFHFINER

SEQ ID NO: 518436 - protein, 10 aa, Influenza virus
YSEMKWLLSS

SEQ ID NO: 518437 - protein, 10 aa, Influenza virus
YSEMKWLSSS

SEQ ID NO: 518438 - protein, 10 aa, Influenza virus
YSGFVRTLFQ

SEQ ID NO: 518439 - protein, 10 aa, Influenza virus
YSGGTINSPL

SEQ ID NO: 518440 - protein, 10 aa, Influenza virus
YSGIFSVEGK

SEQ ID NO: 518441 - protein, 10 aa, Influenza virus
YSGIFSVEHK

SEQ ID NO: 518442 - protein, 10 aa, Influenza virus
YSGIFSVENK

SEQ ID NO: 518443 - protein, 10 aa, Influenza virus
YSGIFSVESK

SEQ ID NO: 518444 - protein, 10 aa, Influenza virus
YSGIKTDGAT

SEQ ID NO: 518445 - protein, 10 aa, Influenza virus
YSGIRTDGAT

SEQ ID NO: 518446 - protein, 10 aa, Influenza virus
YSGSFIDYWA

SEQ ID NO: 518447 - protein, 10 aa, Influenza virus
YSGSFIDYWD

SEQ ID NO: 518448 - protein, 10 aa, Influenza virus
YSGSFIDYWN

SEQ ID NO: 518449 - protein, 10 aa, Influenza virus
YSGSFIQHPE

SEQ ID NO: 518450 - protein, 10 aa, Influenza virus
YSGSFMDYWA

SEQ ID NO: 518451 - protein, 10 aa, Influenza virus
YSGSFSIRGE

SEQ ID NO: 518452 - protein, 10 aa, Influenza virus
YSGSFSIRWE

SEQ ID NO: 518453 - protein, 10 aa, Influenza virus
YSGSFTLPIE

SEQ ID NO: 518454 - protein, 10 aa, Influenza virus
YSGSFTLPVE

SEQ ID NO: 518455 - protein, 10 aa, Influenza virus
YSGSFTLPVG

SEQ ID NO: 518456 - protein, 10 aa, Influenza virus
YSGSFVDYWA

SEQ ID NO: 518457 - protein, 10 aa, Influenza virus
YSGSFVQHPE

SEQ ID NO: 518458 - protein, 10 aa, Influenza virus
YSGVFSVEGK

SEQ ID NO: 518459 - protein, 10 aa, Influenza virus
YSHGTGTGYT

SEQ ID NO: 518460 - protein, 10 aa, Influenza virus
YSIADKICIG

SEQ ID NO: 518461 - protein, 10 aa, Influenza virus
YSIDSGYVCS

SEQ ID NO: 518462 - protein, 10 aa, Influenza virus
YSIDSNYVCS

SEQ ID NO: 518463 - protein, 10 aa, Influenza virus
YSIDSSYICS

SEQ ID NO: 518464 - protein, 10 aa, Influenza virus
YSIDSSYVCS

SEQ ID NO: 518465 - protein, 10 aa, Influenza virus
YSKADKICIG

SEQ ID NO: 518466 - protein, 10 aa, Influenza virus
YSKDNGIRIG

SEQ ID NO: 518467 - protein, 10 aa, Influenza virus
YSKDNSIRIG

SEQ ID NO: 518468 - protein, 10 aa, Influenza virus
YSKYEEESKL

SEQ ID NO: 518469 - protein, 10 aa, Influenza virus
YSLVGIDPFK

SEQ ID NO: 518470 - protein, 10 aa, Influenza virus
YSLVGIDPFR

SEQ ID NO: 518471 - protein, 10 aa, Influenza virus
YSLVGVDPFK

SEQ ID NO: 518472 - protein, 10 aa, Influenza virus
YSQITNGTTG

SEQ ID NO: 518473 - protein, 10 aa, Influenza virus
YSRADKICIG

SEQ ID NO: 518474 - protein, 10 aa, Influenza virus
YSSPMMWEIN

SEQ ID NO: 518475 - protein, 10 aa, Influenza virus
YSSPQLEGFS

SEQ ID NO: 518476 - protein, 10 aa, Influenza virus
YSSSLMWEIN

SEQ ID NO: 518477 - protein, 10 aa, Influenza virus
YSSSMMWEIN

SEQ ID NO: 518478 - protein, 10 aa, Influenza virus
YSSSMMWEVN

SEQ ID NO: 518479 - protein, 10 aa, Influenza virus
YSSVASSLVL

SEQ ID NO: 518480 - protein, 10 aa, Influenza virus
YSTAASSLAL

SEQ ID NO: 518481 - protein, 10 aa, Influenza virus
YSTAASSLVL

SEQ ID NO: 518482 - protein, 10 aa, Influenza virus
YSTGALASCM

SEQ ID NO: 518483 - protein, 10 aa, Influenza virus
YSTISSSLVL

SEQ ID NO: 518484 - protein, 10 aa, Influenza virus
YSTVAASLCL

SEQ ID NO: 518485 - protein, 10 aa, Influenza virus
YSTVASSLAL

SEQ ID NO: 518486 - protein, 10 aa, Influenza virus
YSTVASSLIL

SEQ ID NO: 518487 - protein, 10 aa, Influenza virus
YSTVASSLTL

SEQ ID NO: 518488 - protein, 10 aa, Influenza virus
YSTVASSLVL

SEQ ID NO: 518489 - protein, 10 aa, Influenza virus
YSTVASSSVL

SEQ ID NO: 518490 - protein, 10 aa, Influenza virus
YSTVSSSLVL

SEQ ID NO: 518491 - protein, 10 aa, Influenza virus
YSTVVSSLAL

SEQ ID NO: 518492 - protein, 10 aa, Influenza virus
YTENPVICLG

SEQ ID NO: 518493 - protein, 10 aa, Influenza virus
YTGAINSSKP

SEQ ID NO: 518494 - protein, 10 aa, Influenza virus
YTGAINSSRP

SEQ ID NO: 518495 - protein, 10 aa, Influenza virus
YTGDPPYSHG

SEQ ID NO: 518496 - protein, 10 aa, Influenza virus
YTGNPVICLG

SEQ ID NO: 518497 - protein, 10 aa, Influenza virus
YTGNPVICMG

SEQ ID NO: 518498 - protein, 10 aa, Influenza virus
YTIDEESRAR

SEQ ID NO: 518499 - protein, 10 aa, Influenza virus
YTKCQTYAGA

SEQ ID NO: 518500 - protein, 10 aa, Influenza virus
YTKILYFHKG

SEQ ID NO: 518501 - protein, 10 aa, Influenza virus
YTKIMYFHKG

SEQ ID NO: 518502 - protein, 10 aa, Influenza virus
YTKVLYFHKG

SEQ ID NO: 518503 - protein, 10 aa, Influenza virus
YTKVMYFHKG

SEQ ID NO: 518504 - protein, 10 aa, Influenza virus
YTLDEESRAR

SEQ ID NO: 518505 - protein, 10 aa, Influenza virus
YTLITDGPSD

SEQ ID NO: 518506 - protein, 10 aa, Influenza virus
YTLITDGPSN

SEQ ID NO: 518507 - protein, 10 aa, Influenza virus
YTLMTDGPSD

SEQ ID NO: 518508 - protein, 10 aa, Influenza virus
YTLVSTGSWS

SEQ ID NO: 518509 - protein, 10 aa, Influenza virus
YTLVSTKEWS

SEQ ID NO: 518510 - protein, 10 aa, Influenza virus
YTLVSTKSWS

SEQ ID NO: 518511 - protein, 10 aa, Influenza virus
YTLVSTRSWS

SEQ ID NO: 518512 - protein, 10 aa, Influenza virus
YTLVSTSSWS

SEQ ID NO: 518513 - protein, 10 aa, Influenza virus
YTLVTDGPSD

SEQ ID NO: 518514 - protein, 10 aa, Influenza virus
YTLVTTSSWS

SEQ ID NO: 518515 - protein, 10 aa, Influenza virus
YTMDTVNRTH

SEQ ID NO: 518516 - protein, 10 aa, Influenza virus
YTMDTVSRTH

SEQ ID NO: 518517 - protein, 10 aa, Influenza virus
YTPGGEVIND

SEQ ID NO: 518518 - protein, 10 aa, Influenza virus
YTPGGEVKND

SEQ ID NO: 518519 - protein, 10 aa, Influenza virus
YTPGGEVRND

SEQ ID NO: 518520 - protein, 10 aa, Influenza virus
YTPGGGVRND

SEQ ID NO: 518521 - protein, 10 aa, Influenza virus
YTPGGKVRND

SEQ ID NO: 518522 - protein, 10 aa, Influenza virus
YTRLYIWGVH

SEQ ID NO: 518523 - protein, 10 aa, Influenza virus
YTSARQEKNP

SEQ ID NO: 518524 - protein, 10 aa, Influenza virus
YTSGRQEKNP

SEQ ID NO: 518525 - protein, 10 aa, Influenza virus
YTYRCHKGDT

SEQ ID NO: 518526 - protein, 10 aa, Influenza virus
YTYRCHRGDM

SEQ ID NO: 518527 - protein, 10 aa, Influenza virus
YTYRCHRGDT

SEQ ID NO: 518528 - protein, 10 aa, Influenza virus
YVCSGIFGDN

SEQ ID NO: 518529 - protein, 10 aa, Influenza virus
YVCSGLVGDT

SEQ ID NO: 518530 - protein, 10 aa, Influenza virus
YVCSGVFGDN

SEQ ID NO: 518531 - protein, 10 aa, Influenza virus
YVCSKFHSDT

SEQ ID NO: 518532 - protein, 10 aa, Influenza virus
YVCTGILTDT

SEQ ID NO: 518533 - protein, 10 aa, Influenza virus
YVCTGVLTDT

SEQ ID NO: 518534 - protein, 10 aa, Influenza virus
YVDGFEPNGC

SEQ ID NO: 518535 - protein, 10 aa, Influenza virus
YVDGFEPNGS

SEQ ID NO: 518536 - protein, 10 aa, Influenza virus
YVDGFEPNGY

SEQ ID NO: 518537 - protein, 10 aa, Influenza virus
YVDGFKPNGC

SEQ ID NO: 518538 - protein, 10 aa, Influenza virus
YVEDTKIDLW

SEQ ID NO: 518539 - protein, 10 aa, Influenza virus
YVEDTKVDLW

SEQ ID NO: 518540 - protein, 10 aa, Influenza virus
YVELIRGMPK

SEQ ID NO: 518541 - protein, 10 aa, Influenza virus
YVELIRGMPQ

SEQ ID NO: 518542 - protein, 10 aa, Influenza virus
YVELIRGRKQ

SEQ ID NO: 518543 - protein, 10 aa, Influenza virus
YVELIRGRLN

SEQ ID NO: 518544 - protein, 10 aa, Influenza virus
YVELIRGRPE

SEQ ID NO: 518545 - protein, 10 aa, Influenza virus
YVELIRGRPI

SEQ ID NO: 518546 - protein, 10 aa, Influenza virus
YVELIRGRPK

SEQ ID NO: 518547 - protein, 10 aa, Influenza virus
YVELIRGRPN

SEQ ID NO: 518548 - protein, 10 aa, Influenza virus
YVELIRGRPQ

SEQ ID NO: 518549 - protein, 10 aa, Influenza virus
YVELIRGRPR

SEQ ID NO: 518550 - protein, 10 aa, Influenza virus
YVELIRGRQQ

SEQ ID NO: 518551 - protein, 10 aa, Influenza virus
YVELIRGRSQ

SEQ ID NO: 518552 - protein, 10 aa, Influenza virus
YVEMIRGRPK

SEQ ID NO: 518553 - protein, 10 aa, Influenza virus
YVEVLHLTQG

SEQ ID NO: 518554 - protein, 10 aa, Influenza virus
YVEWTSNSLI

SEQ ID NO: 518555 - protein, 10 aa, Influenza virus
YVKKASLRLA

SEQ ID NO: 518556 - protein, 10 aa, Influenza virus
YVKKESLRLA

SEQ ID NO: 518557 - protein, 10 aa, Influenza virus
YVKQGSLKLA

SEQ ID NO: 518558 - protein, 10 aa, Influenza virus
YVKQGSLMLA

SEQ ID NO: 518559 - protein, 10 aa, Influenza virus
YVKQGSLRLA

SEQ ID NO: 518560 - protein, 10 aa, Influenza virus
YVKQKTLKLA

SEQ ID NO: 518561 - protein, 10 aa, Influenza virus
YVKQNTLKLA

SEQ ID NO: 518562 - protein, 10 aa, Influenza virus
YVKQSSLPLA

SEQ ID NO: 518563 - protein, 10 aa, Influenza virus
YVKQSTLKLA

SEQ ID NO: 518564 - protein, 10 aa, Influenza virus
YVKSDRLVLA

SEQ ID NO: 518565 - protein, 10 aa, Influenza virus
YVKSEKLVLA

SEQ ID NO: 518566 - protein, 10 aa, Influenza virus
YVKSERLVLA

SEQ ID NO: 518567 - protein, 10 aa, Influenza virus
YVLSIIPSGP

SEQ ID NO: 518568 - protein, 10 aa, Influenza virus
YVLSIVPSGP

SEQ ID NO: 518569 - protein, 10 aa, Influenza virus
YVLSVIPSGP

SEQ ID NO: 518570 - protein, 10 aa, Influenza virus
YVNIKSLKLA

SEQ ID NO: 518571 - protein, 10 aa, Influenza virus
YVNKNPYTLV

SEQ ID NO: 518572 - protein, 10 aa, Influenza virus
YVNKTTVINK

SEQ ID NO: 518573 - protein, 10 aa, Influenza virus
YVNNTTIISK

SEQ ID NO: 518574 - protein, 10 aa, Influenza virus
YVNNTTIITK

SEQ ID NO: 518575 - protein, 10 aa, Influenza virus
YVNNTTVINK

SEQ ID NO: 518576 - protein, 10 aa, Influenza virus
YVNNTTVISK

SEQ ID NO: 518577 - protein, 10 aa, Influenza virus
YVNTALLNAS

SEQ ID NO: 518578 - protein, 10 aa, Influenza virus
YVNVKSLKLA

SEQ ID NO: 518579 - protein, 10 aa, Influenza virus
YVNVRSLKLA

SEQ ID NO: 518580 - protein, 10 aa, Influenza virus
YVQMCTELKL

SEQ ID NO: 518581 - protein, 10 aa, Influenza virus
YVRKASLRLA

SEQ ID NO: 518582 - protein, 10 aa, Influenza virus
YVRLYLWGVH

SEQ ID NO: 518583 - protein, 10 aa, Influenza virus
YVRQNTLKLA

SEQ ID NO: 518584 - protein, 10 aa, Influenza virus
YVRSEKLVLA

SEQ ID NO: 518585 - protein, 10 aa, Influenza virus
YVRTNGTSKI

SEQ ID NO: 518586 - protein, 10 aa, Influenza virus
YVRTNGTSKV

SEQ ID NO: 518587 - protein, 10 aa, Influenza virus
YVSCDPDECR

SEQ ID NO: 518588 - protein, 10 aa, Influenza virus
YVSCDPDGCR

SEQ ID NO: 518589 - protein, 10 aa, Influenza virus
YVSCDPLGCK

SEQ ID NO: 518590 - protein, 10 aa, Influenza virus
YVSCDPLGCR

SEQ ID NO: 518591 - protein, 10 aa, Influenza virus
YVSCDPNECR

SEQ ID NO: 518592 - protein, 10 aa, Influenza virus
YVSCDPSGCK

SEQ ID NO: 518593 - protein, 10 aa, Influenza virus
YVSCDPTGCK

SEQ ID NO: 518594 - protein, 10 aa, Influenza virus
YVSCEPDECR

SEQ ID NO: 518595 - protein, 10 aa, Influenza virus
YVSIGTSTLN

SEQ ID NO: 518596 - protein, 10 aa, Influenza virus
YVSMEFSLTD

SEQ ID NO: 518597 - protein, 10 aa, Influenza virus
YVSVGTSTLN

SEQ ID NO: 518598 - protein, 10 aa, Influenza virus
YVWWASNSLI

SEQ ID NO: 518599 - protein, 10 aa, Influenza virus
YVWWTSNSLI

SEQ ID NO: 518600 - protein, 10 aa, Influenza virus
YVWWTSNSLV

SEQ ID NO: 518601 - protein, 10 aa, Influenza virus
YWAEGDCYRA

SEQ ID NO: 518602 - protein, 10 aa, Influenza virus
YWAEGECYRA

SEQ ID NO: 518603 - protein, 10 aa, Influenza virus
YWAILKPGQT

SEQ ID NO: 518604 - protein, 10 aa, Influenza virus
YWAIRTRSGG

SEQ ID NO: 518605 - protein, 10 aa, Influenza virus
YWAKEECYRA

SEQ ID NO: 518606 - protein, 10 aa, Influenza virus
YWAKGDCYRA

SEQ ID NO: 518607 - protein, 10 aa, Influenza virus
YWAKGECYRA

SEQ ID NO: 518608 - protein, 10 aa, Influenza virus
YWAVLKPGQT

SEQ ID NO: 518609 - protein, 10 aa, Influenza virus
YWGILKRGET

SEQ ID NO: 518610 - protein, 10 aa, Influenza virus
YWHLMHPGER

SEQ ID NO: 518611 - protein, 10 aa, Influenza virus
YWHLMRPGER

SEQ ID NO: 518612 - protein, 10 aa, Influenza virus
YWHLMSPGER

SEQ ID NO: 518613 - protein, 10 aa, Influenza virus
YWTLVNPGDS

SEQ ID NO: 518614 - protein, 10 aa, Influenza virus
YWVMTDGPAN

SEQ ID NO: 518615 - protein, 10 aa, Influenza virus
YWVMTDGPAS

SEQ ID NO: 518616 - protein, 10 aa, Influenza virus
YWWDGLQSSD

SEQ ID NO: 518617 - protein, 10 aa, Influenza virus
YYDRRLTTTI

SEQ ID NO: 518618 - protein, 10 aa, Influenza virus
YYDRRLTTTV

SEQ ID NO: 518619 - protein, 10 aa, Influenza virus
YYEECSCYPD

SEQ ID NO: 518620 - protein, 10 aa, Influenza virus
YYERRLTTTI

SEQ ID NO: 518621 - protein, 10 aa, Influenza virus
YYFVKEGKIV

SEQ ID NO: 518622 - protein, 10 aa, Influenza virus
YYLEKANKIK

SEQ ID NO: 518623 - protein, 10 aa, Influenza virus
YYLEKASKIK

SEQ ID NO: 518624 - protein, 10 aa, Influenza virus
YYNETFVNMT

SEQ ID NO: 518625 - protein, 10 aa, Influenza virus
YYNETFVNVT

SEQ ID NO: 518626 - protein, 10 aa, Influenza virus
YYNGRLTTTI

SEQ ID NO: 518627 - protein, 10 aa, Influenza virus
YYNGRSSFFR

SEQ ID NO: 518628 - protein, 10 aa, Influenza virus
YYNKRLTTTI

SEQ ID NO: 518629 - protein, 10 aa, Influenza virus
YYNRRLTTTI

SEQ ID NO: 518630 - protein, 10 aa, Influenza virus
YYPKYEEESK

SEQ ID NO: 518631 - protein, 10 aa, Influenza virus
YYWAILKPGQ

SEQ ID NO: 518632 - protein, 10 aa, Influenza virus
YYWAVLKPGQ

SEQ ID NO: 518633 - protein, 10 aa, Influenza virus
YYWGILKRGE

SEQ ID NO: 518634 - protein, 10 aa, Influenza virus
YYYEECSCYP

SEQ ID NO: 518635 - protein, 10 aa, Influenza virus
YYYPKYEEES

SEQ ID NO: 518636 - protein, 11 aa, Influenza virus
AADFKSTQAAI

SEQ ID NO: 518637 - protein, 11 aa, Influenza virus
AADKASTQKAI

SEQ ID NO: 518638 - protein, 11 aa, Influenza virus
AADKESTQKAF

SEQ ID NO: 518639 - protein, 11 aa, Influenza virus
AADKESTQKAI

SEQ ID NO: 518640 - protein, 11 aa, Influenza virus
AADKESTQKAV

SEQ ID NO: 518641 - protein, 11 aa, Influenza virus
AADKESTQRAF

SEQ ID NO: 518642 - protein, 11 aa, Influenza virus
AADKTSTQKAI

SEQ ID NO: 518643 - protein, 11 aa, Influenza virus
AADKVSTQKAI

SEQ ID NO: 518644 - protein, 11 aa, Influenza virus
AADKVSTQKAL

SEQ ID NO: 518645 - protein, 11 aa, Influenza virus
AADLKSTQAAI

SEQ ID NO: 518646 - protein, 11 aa, Influenza virus
AADLKSTQAAV

SEQ ID NO: 518647 - protein, 11 aa, Influenza virus
AADLKSTQTAI

SEQ ID NO: 518648 - protein, 11 aa, Influenza virus
AADQKSTQEAI

SEQ ID NO: 518649 - protein, 11 aa, Influenza virus
AADRDSTQKAI

SEQ ID NO: 518650 - protein, 11 aa, Influenza virus
AADRDSTQMAI

SEQ ID NO: 518651 - protein, 11 aa, Influenza virus
AADRDSTQRAI

SEQ ID NO: 518652 - protein, 11 aa, Influenza virus
AADRGSTQKAI

SEQ ID NO: 518653 - protein, 11 aa, Influenza virus
AADYESTQAAI

SEQ ID NO: 518654 - protein, 11 aa, Influenza virus
AADYKSTPSAI

SEQ ID NO: 518655 - protein, 11 aa, Influenza virus
AADYKSTQAAI

SEQ ID NO: 518656 - protein, 11 aa, Influenza virus
AADYKSTQAAV

SEQ ID NO: 518657 - protein, 11 aa, Influenza virus
AADYKSTQATI

SEQ ID NO: 518658 - protein, 11 aa, Influenza virus
AADYKSTQKTI

SEQ ID NO: 518659 - protein, 11 aa, Influenza virus
AADYKSTQSAI

SEQ ID NO: 518660 - protein, 11 aa, Influenza virus
AADYKSTQSAV

SEQ ID NO: 518661 - protein, 11 aa, Influenza virus
AADYKSTQTAI

SEQ ID NO: 518662 - protein, 11 aa, Influenza virus
AAEKESTQKAI

SEQ ID NO: 518663 - protein, 11 aa, Influenza virus
AAGAAIKGVGT

SEQ ID NO: 518664 - protein, 11 aa, Influenza virus
AAGAAVKGIGT

SEQ ID NO: 518665 - protein, 11 aa, Influenza virus
AAGAAVKGVGT

SEQ ID NO: 518666 - protein, 11 aa, Influenza virus
AAGFHFEECSC

SEQ ID NO: 518667 - protein, 11 aa, Influenza virus
AAGGAIWVTRE

SEQ ID NO: 518668 - protein, 11 aa, Influenza virus
AAGGDIWVTRE

SEQ ID NO: 518669 - protein, 11 aa, Influenza virus
AAICTHLEICF

SEQ ID NO: 518670 - protein, 11 aa, Influenza virus
AAICTHLEVCF

SEQ ID NO: 518671 - protein, 11 aa, Influenza virus
AAICTHMEVCF

SEQ ID NO: 518672 - protein, 11 aa, Influenza virus
AAIDKINGKLN

SEQ ID NO: 518673 - protein, 11 aa, Influenza virus
AAIDQINGKLN

SEQ ID NO: 518674 - protein, 11 aa, Influenza virus
AAIDQITGKLN

SEQ ID NO: 518675 - protein, 11 aa, Influenza virus
AAIGLRISSSF

SEQ ID NO: 518676 - protein, 11 aa, Influenza virus
AAINQINGKLN

SEQ ID NO: 518677 - protein, 11 aa, Influenza virus
AALGLRISSSF

SEQ ID NO: 518678 - protein, 11 aa, Influenza virus
AALGSPGCDHL

SEQ ID NO: 518679 - protein, 11 aa, Influenza virus
AAMDDFQLIPM

SEQ ID NO: 518680 - protein, 11 aa, Influenza virus
AAMDDYQLIPM

SEQ ID NO: 518681 - protein, 11 aa, Influenza virus
AAMDEFQLIPM

SEQ ID NO: 518682 - protein, 11 aa, Influenza virus
AAMEDFQLIPM

SEQ ID NO: 518683 - protein, 11 aa, Influenza virus
AAMGLKISSSF

SEQ ID NO: 518684 - protein, 11 aa, Influenza virus
AAMGLRISSSF

SEQ ID NO: 518685 - protein, 11 aa, Influenza virus
AAMGMRISSSF

SEQ ID NO: 518686 - protein, 11 aa, Influenza virus
AANNADHRIYW

SEQ ID NO: 518687 - protein, 11 aa, Influenza virus
AANNADHRVYW

SEQ ID NO: 518688 - protein, 11 aa, Influenza virus
AANSADHRIYW

SEQ ID NO: 518689 - protein, 11 aa, Influenza virus
AANSADHRVYW

SEQ ID NO: 518690 - protein, 11 aa, Influenza virus
AAPHGLCYPGE

SEQ ID NO: 518691 - protein, 11 aa, Influenza virus
AAQKAMMDQVR

SEQ ID NO: 518692 - protein, 11 aa, Influenza virus
AAQRAMMDQVR

SEQ ID NO: 518693 - protein, 11 aa, Influenza virus
AAQRAMVDQVR

SEQ ID NO: 518694 - protein, 11 aa, Influenza virus
AARNIVRRAAV

SEQ ID NO: 518695 - protein, 11 aa, Influenza virus
AARNIVRRAIV

SEQ ID NO: 518696 - protein, 11 aa, Influenza virus
AARNIVRRATV

SEQ ID NO: 518697 - protein, 11 aa, Influenza virus
AARSIVRRATV

SEQ ID NO: 518698 - protein, 11 aa, Influenza virus
AASLCLAILIA

SEQ ID NO: 518699 - protein, 11 aa, Influenza virus
AASLCLAILVA

SEQ ID NO: 518700 - protein, 11 aa, Influenza virus
AASLCLAVLIA

SEQ ID NO: 518701 - protein, 11 aa, Influenza virus
AASLSPGMMMG

SEQ ID NO: 518702 - protein, 11 aa, Influenza virus
AASYKRIRLFD

SEQ ID NO: 518703 - protein, 11 aa, Influenza virus
AASYKRVRLFD

SEQ ID NO: 518704 - protein, 11 aa, Influenza virus
AATALANTIEI

SEQ ID NO: 518705 - protein, 11 aa, Influenza virus
AATALANTIEV

SEQ ID NO: 518706 - protein, 11 aa, Influenza virus
AATLCLGHHAV

SEQ ID NO: 518707 - protein, 11 aa, Influenza virus
AATQTLVSNND

SEQ ID NO: 518708 - protein, 11 aa, Influenza virus
AATVTLHFKQH

SEQ ID NO: 518709 - protein, 11 aa, Influenza virus
AAVCTHLEVCF

SEQ ID NO: 518710 - protein, 11 aa, Influenza virus
AAVDQITGKLN

SEQ ID NO: 518711 - protein, 11 aa, Influenza virus
AAVSADPLASL

SEQ ID NO: 518712 - protein, 11 aa, Influenza virus
AAWSSSSCFDG

SEQ ID NO: 518713 - protein, 11 aa, Influenza virus
AAWSSSSCHDG

SEQ ID NO: 518714 - protein, 11 aa, Influenza virus
ACFQPCFYVEL

SEQ ID NO: 518715 - protein, 11 aa, Influenza virus
ACFYVELIRGR

SEQ ID NO: 518716 - protein, 11 aa, Influenza virus
ACGNGSCRCTI

SEQ ID NO: 518717 - protein, 11 aa, Influenza virus
ACGPAECRTFF

SEQ ID NO: 518718 - protein, 11 aa, Influenza virus
ACGPSECRTFF

SEQ ID NO: 518719 - protein, 11 aa, Influenza virus
ACGPTECRTFF

SEQ ID NO: 518720 - protein, 11 aa, Influenza virus
ACHSAAFEDLR

SEQ ID NO: 518721 - protein, 11 aa, Influenza virus
ACITPNGSIPN

SEQ ID NO: 518722 - protein, 11 aa, Influenza virus
ACKRTVSSFYS

SEQ ID NO: 518723 - protein, 11 aa, Influenza virus
ACLRGGRNSFF

SEQ ID NO: 518724 - protein, 11 aa, Influenza virus
ACNALTGGQSF

SEQ ID NO: 518725 - protein, 11 aa, Influenza virus
ACNASTGAQSF

SEQ ID NO: 518726 - protein, 11 aa, Influenza virus
ACNASTGGQAF

SEQ ID NO: 518727 - protein, 11 aa, Influenza virus
ACNASTGGQSF

SEQ ID NO: 518728 - protein, 11 aa, Influenza virus
ACNNGSCRCTI

SEQ ID NO: 518729 - protein, 11 aa, Influenza virus
ACNSAAFEDLR

SEQ ID NO: 518730 - protein, 11 aa, Influenza virus
ACQKGNIKCNI

SEQ ID NO: 518731 - protein, 11 aa, Influenza virus
ACQKGNIRCDI

SEQ ID NO: 518732 - protein, 11 aa, Influenza virus
ACQKGNIRCNI

SEQ ID NO: 518733 - protein, 11 aa, Influenza virus
ACQKGNIRCSI

SEQ ID NO: 518734 - protein, 11 aa, Influenza virus
ACQNGNIRCQI

SEQ ID NO: 518735 - protein, 11 aa, Influenza virus
ACQNGNLRCQI

SEQ ID NO: 518736 - protein, 11 aa, Influenza virus
ACQNGNVRCQI

SEQ ID NO: 518737 - protein, 11 aa, Influenza virus
ACQRGNIRCNI

SEQ ID NO: 518738 - protein, 11 aa, Influenza virus
ACSASTGGQSF

SEQ ID NO: 518739 - protein, 11 aa, Influenza virus
ACSDGPGWLTI

SEQ ID NO: 518740 - protein, 11 aa, Influenza virus
ACSDGPGWLTL

SEQ ID NO: 518741 - protein, 11 aa, Influenza virus
ACSDGSGWLTL

SEQ ID NO: 518742 - protein, 11 aa, Influenza virus
ACSNGNCRFNV

SEQ ID NO: 518743 - protein, 11 aa, Influenza virus
ACSNGSCRCTI

SEQ ID NO: 518744 - protein, 11 aa, Influenza virus
ACSNGSCRFNV

SEQ ID NO: 518745 - protein, 11 aa, Influenza virus
ACSPSECRTFF

SEQ ID NO: 518746 - protein, 11 aa, Influenza virus
ACSSGNCRFNV

SEQ ID NO: 518747 - protein, 11 aa, Influenza virus
ACSSGNCRFSV

SEQ ID NO: 518748 - protein, 11 aa, Influenza virus
ACWEQLYTPGG

SEQ ID NO: 518749 - protein, 11 aa, Influenza virus
ACYNPCFYVEL

SEQ ID NO: 518750 - protein, 11 aa, Influenza virus
ADAQHRSHRQM

SEQ ID NO: 518751 - protein, 11 aa, Influenza virus
ADDDAYAVIHY

SEQ ID NO: 518752 - protein, 11 aa, Influenza virus
ADDEAYAVIHY

SEQ ID NO: 518753 - protein, 11 aa, Influenza virus
ADEICIGHLSN

SEQ ID NO: 518754 - protein, 11 aa, Influenza virus
ADEICIGYLSN

SEQ ID NO: 518755 - protein, 11 aa, Influenza virus
ADEICIGYMSN

SEQ ID NO: 518756 - protein, 11 aa, Influenza virus
ADFKSTQAAIN

SEQ ID NO: 518757 - protein, 11 aa, Influenza virus
ADGDIWVTREP

SEQ ID NO: 518758 - protein, 11 aa, Influenza virus
ADGGPNLYNIR

SEQ ID NO: 518759 - protein, 11 aa, Influenza virus
ADHPPKVAWSS

SEQ ID NO: 518760 - protein, 11 aa, Influenza virus
ADHRIYWIREG

SEQ ID NO: 518761 - protein, 11 aa, Influenza virus
ADHRIYWIRKG

SEQ ID NO: 518762 - protein, 11 aa, Influenza virus
ADHRVYWIREG

SEQ ID NO: 518763 - protein, 11 aa, Influenza virus
ADIKSHAYISF

SEQ ID NO: 518764 - protein, 11 aa, Influenza virus
ADINLHAYISF

SEQ ID NO: 518765 - protein, 11 aa, Influenza virus
ADKASTQKAID

SEQ ID NO: 518766 - protein, 11 aa, Influenza virus
ADKASTQKAIN

SEQ ID NO: 518767 - protein, 11 aa, Influenza virus
ADKDSNGVQDI

SEQ ID NO: 518768 - protein, 11 aa, Influenza virus
ADKESTQKAID

SEQ ID NO: 518769 - protein, 11 aa, Influenza virus
ADKICIGYLSN

SEQ ID NO: 518770 - protein, 11 aa, Influenza virus
ADKICLGHHAA

SEQ ID NO: 518771 - protein, 11 aa, Influenza virus
ADKICLGHHAV

SEQ ID NO: 518772 - protein, 11 aa, Influenza virus
ADKICLGRHAV

SEQ ID NO: 518773 - protein, 11 aa, Influenza virus
ADKICVGYLST

SEQ ID NO: 518774 - protein, 11 aa, Influenza virus
ADKISLGHHAV

SEQ ID NO: 518775 - protein, 11 aa, Influenza virus
ADKTSTQKAIN

SEQ ID NO: 518776 - protein, 11 aa, Influenza virus
ADKVSTQKAIN

SEQ ID NO: 518777 - protein, 11 aa, Influenza virus
ADKVSTQKALN

SEQ ID NO: 518778 - protein, 11 aa, Influenza virus
ADLEALMEWLK

SEQ ID NO: 518779 - protein, 11 aa, Influenza virus
ADLIIERRNSS

SEQ ID NO: 518780 - protein, 11 aa, Influenza virus
ADLKSTQAAID

SEQ ID NO: 518781 - protein, 11 aa, Influenza virus
ADLKSTQAAIN

SEQ ID NO: 518782 - protein, 11 aa, Influenza virus
ADLKSTQAAIT

SEQ ID NO: 518783 - protein, 11 aa, Influenza virus
ADLKSTQAAVN

SEQ ID NO: 518784 - protein, 11 aa, Influenza virus
ADLKSTQTAID

SEQ ID NO: 518785 - protein, 11 aa, Influenza virus
ADLLVAMENQH

SEQ ID NO: 518786 - protein, 11 aa, Influenza virus
ADMSIGITVIK

SEQ ID NO: 518787 - protein, 11 aa, Influenza virus
ADMSIGVAVIK

SEQ ID NO: 518788 - protein, 11 aa, Influenza virus
ADMSIGVTVIK

SEQ ID NO: 518789 - protein, 11 aa, Influenza virus
ADMSIGVTVIR

SEQ ID NO: 518790 - protein, 11 aa, Influenza virus
ADNDAYAVIHY

SEQ ID NO: 518791 - protein, 11 aa, Influenza virus
ADNKADHRIYW

SEQ ID NO: 518792 - protein, 11 aa, Influenza virus
ADPLASLLEMC

SEQ ID NO: 518793 - protein, 11 aa, Influenza virus
ADPLLSLLEMC

SEQ ID NO: 518794 - protein, 11 aa, Influenza virus
ADPLVSLLEMC

SEQ ID NO: 518795 - protein, 11 aa, Influenza virus
ADQELGDAPFL

SEQ ID NO: 518796 - protein, 11 aa, Influenza virus
ADQKSTQEAID

SEQ ID NO: 518797 - protein, 11 aa, Influenza virus
ADQKSTQEAIE

SEQ ID NO: 518798 - protein, 11 aa, Influenza virus
ADQKSTQEAIG

SEQ ID NO: 518799 - protein, 11 aa, Influenza virus
ADQKSTQEAIN

SEQ ID NO: 518800 - protein, 11 aa, Influenza virus
ADRDSTQKAID

SEQ ID NO: 518801 - protein, 11 aa, Influenza virus
ADRDSTQMAID

SEQ ID NO: 518802 - protein, 11 aa, Influenza virus
ADRDSTQRAID

SEQ ID NO: 518803 - protein, 11 aa, Influenza virus
ADRGSTQKAID

SEQ ID NO: 518804 - protein, 11 aa, Influenza virus
ADRICIGYLST

SEQ ID NO: 518805 - protein, 11 aa, Influenza virus
ADRICVGYLST

SEQ ID NO: 518806 - protein, 11 aa, Influenza virus
ADRIDDAVTDI

SEQ ID NO: 518807 - protein, 11 aa, Influenza virus
ADRIDDAVTDV

SEQ ID NO: 518808 - protein, 11 aa, Influenza virus
ADRVDDAVTDI

SEQ ID NO: 518809 - protein, 11 aa, Influenza virus
ADRVDDAVTDV

SEQ ID NO: 518810 - protein, 11 aa, Influenza virus
ADSEMDKLYER

SEQ ID NO: 518811 - protein, 11 aa, Influenza virus
ADSEMDKLYTR

SEQ ID NO: 518812 - protein, 11 aa, Influenza virus
ADSEMLNLYDR

SEQ ID NO: 518813 - protein, 11 aa, Influenza virus
ADSEMLNLYEG

SEQ ID NO: 518814 - protein, 11 aa, Influenza virus
ADSEMLNLYER

SEQ ID NO: 518815 - protein, 11 aa, Influenza virus
ADSEMNKLFER

SEQ ID NO: 518816 - protein, 11 aa, Influenza virus
ADSEMNKLYER

SEQ ID NO: 518817 - protein, 11 aa, Influenza virus
ADSEMSKLYER

SEQ ID NO: 518818 - protein, 11 aa, Influenza virus
ADSHHRSHRQM

SEQ ID NO: 518819 - protein, 11 aa, Influenza virus
ADSQHKSHRQM

SEQ ID NO: 518820 - protein, 11 aa, Influenza virus
ADSQHRSHRQM

SEQ ID NO: 518821 - protein, 11 aa, Influenza virus
ADTICIGYHAN

SEQ ID NO: 518822 - protein, 11 aa, Influenza virus
ADTICVGYHAN

SEQ ID NO: 518823 - protein, 11 aa, Influenza virus
ADTILERNVTV

SEQ ID NO: 518824 - protein, 11 aa, Influenza virus
ADTKILFIEEG

SEQ ID NO: 518825 - protein, 11 aa, Influenza virus
ADTLCIGYHAN

SEQ ID NO: 518826 - protein, 11 aa, Influenza virus
ADTRILFIEEG

SEQ ID NO: 518827 - protein, 11 aa, Influenza virus
ADTRILFIKEG

SEQ ID NO: 518828 - protein, 11 aa, Influenza virus
ADTRILFIREG

SEQ ID NO: 518829 - protein, 11 aa, Influenza virus
ADTRILFVKEG

SEQ ID NO: 518830 - protein, 11 aa, Influenza virus
ADWVDDAVTDI

SEQ ID NO: 518831 - protein, 11 aa, Influenza virus
ADYESTQAAID

SEQ ID NO: 518832 - protein, 11 aa, Influenza virus
ADYKSTPSAID

SEQ ID NO: 518833 - protein, 11 aa, Influenza virus
ADYKSTQAAID

SEQ ID NO: 518834 - protein, 11 aa, Influenza virus
ADYKSTQAAVD

SEQ ID NO: 518835 - protein, 11 aa, Influenza virus
ADYKSTQKTID

SEQ ID NO: 518836 - protein, 11 aa, Influenza virus
ADYKSTQSAID

SEQ ID NO: 518837 - protein, 11 aa, Influenza virus
ADYKSTQSAIN

SEQ ID NO: 518838 - protein, 11 aa, Influenza virus
ADYKSTQSAVD

SEQ ID NO: 518839 - protein, 11 aa, Influenza virus
ADYKSTQSAVN

SEQ ID NO: 518840 - protein, 11 aa, Influenza virus
AECRTFFLTQG

SEQ ID NO: 518841 - protein, 11 aa, Influenza virus
AEDKGNGCFEI

SEQ ID NO: 518842 - protein, 11 aa, Influenza virus
AEDMGNGCFKI

SEQ ID NO: 518843 - protein, 11 aa, Influenza virus
AEDMGNGCFRI

SEQ ID NO: 518844 - protein, 11 aa, Influenza virus
AEDMGNGCFTI

SEQ ID NO: 518845 - protein, 11 aa, Influenza virus
AEDMGNGCLKI

SEQ ID NO: 518846 - protein, 11 aa, Influenza virus
AEDQGNGCFEI

SEQ ID NO: 518847 - protein, 11 aa, Influenza virus
AEDRGNGCFEI

SEQ ID NO: 518848 - protein, 11 aa, Influenza virus
AEEDCTGCFEI

SEQ ID NO: 518849 - protein, 11 aa, Influenza virus
AEEDGKGCFEI

SEQ ID NO: 518850 - protein, 11 aa, Influenza virus
AEEDGNGCFEI

SEQ ID NO: 518851 - protein, 11 aa, Influenza virus
AEEDGRGCFEI

SEQ ID NO: 518852 - protein, 11 aa, Influenza virus
AEEDGTGCFEI

SEQ ID NO: 518853 - protein, 11 aa, Influenza virus
AEEDGTGCFEL

SEQ ID NO: 518854 - protein, 11 aa, Influenza virus
AEEMGNGCFKI

SEQ ID NO: 518855 - protein, 11 aa, Influenza virus
AEESKLKRQEI

SEQ ID NO: 518856 - protein, 11 aa, Influenza virus
AEFLVAVENQH

SEQ ID NO: 518857 - protein, 11 aa, Influenza virus
AEGDCYRACFY

SEQ ID NO: 518858 - protein, 11 aa, Influenza virus
AEGECYRACFY

SEQ ID NO: 518859 - protein, 11 aa, Influenza virus
AEGTGMAADQK

SEQ ID NO: 518860 - protein, 11 aa, Influenza virus
AEGTGTAADLK

SEQ ID NO: 518861 - protein, 11 aa, Influenza virus
AEIAQKLEDVF

SEQ ID NO: 518862 - protein, 11 aa, Influenza virus
AEIAQRLEDVF

SEQ ID NO: 518863 - protein, 11 aa, Influenza virus
AEIAQRLEGVF

SEQ ID NO: 518864 - protein, 11 aa, Influenza virus
AEIAQRLENVF

SEQ ID NO: 518865 - protein, 11 aa, Influenza virus
AEIAQRLESVF

SEQ ID NO: 518866 - protein, 11 aa, Influenza virus
AEIEDLIFLAR

SEQ ID NO: 518867 - protein, 11 aa, Influenza virus
AEIEDLIFLTR

SEQ ID NO: 518868 - protein, 11 aa, Influenza virus
AEIEDLIFMAR

SEQ ID NO: 518869 - protein, 11 aa, Influenza virus
AEIEDLIFSAR

SEQ ID NO: 518870 - protein, 11 aa, Influenza virus
AEIEDLTFLAR

SEQ ID NO: 518871 - protein, 11 aa, Influenza virus
AEILVLMENER

SEQ ID NO: 518872 - protein, 11 aa, Influenza virus
AEINTWARNIL

SEQ ID NO: 518873 - protein, 11 aa, Influenza virus
AEISHCRATEY

SEQ ID NO: 518874 - protein, 11 aa, Influenza virus
AEKESTQKAID

SEQ ID NO: 518875 - protein, 11 aa, Influenza virus
AELIVLLENQK

SEQ ID NO: 518876 - protein, 11 aa, Influenza virus
AELKWLISKSK

SEQ ID NO: 518877 - protein, 11 aa, Influenza virus
AELKWLVSKDK

SEQ ID NO: 518878 - protein, 11 aa, Influenza virus
AELKWLVSKNK

SEQ ID NO: 518879 - protein, 11 aa, Influenza virus
AELKWLVSKSK

SEQ ID NO: 518880 - protein, 11 aa, Influenza virus
AELKWLVSKTK

SEQ ID NO: 518881 - protein, 11 aa, Influenza virus
AELLIAMENQH

SEQ ID NO: 518882 - protein, 11 aa, Influenza virus
AELLILLENER

SEQ ID NO: 518883 - protein, 11 aa, Influenza virus
AELLVAIENQH

SEQ ID NO: 518884 - protein, 11 aa, Influenza virus
AELLVALENQH

SEQ ID NO: 518885 - protein, 11 aa, Influenza virus
AELLVAMENQH

SEQ ID NO: 518886 - protein, 11 aa, Influenza virus
AELLVLIENQK

SEQ ID NO: 518887 - protein, 11 aa, Influenza virus
AELLVLLEDER

SEQ ID NO: 518888 - protein, 11 aa, Influenza virus
AELLVLLENER

SEQ ID NO: 518889 - protein, 11 aa, Influenza virus
AELLVLLENGR

SEQ ID NO: 518890 - protein, 11 aa, Influenza virus
AELLVLLENQK

SEQ ID NO: 518891 - protein, 11 aa, Influenza virus
AELLVLLGNQK

SEQ ID NO: 518892 - protein, 11 aa, Influenza virus
AELLVLMENEM

SEQ ID NO: 518893 - protein, 11 aa, Influenza virus
AELLVLMENER

SEQ ID NO: 518894 - protein, 11 aa, Influenza virus
AEMKWLLSNAD

SEQ ID NO: 518895 - protein, 11 aa, Influenza virus
AEMKWLLSNND

SEQ ID NO: 518896 - protein, 11 aa, Influenza virus
AEMKWLLSNSD

SEQ ID NO: 518897 - protein, 11 aa, Influenza virus
AEMKWLLSNTD

SEQ ID NO: 518898 - protein, 11 aa, Influenza virus
AEMKWLLSSSD

SEQ ID NO: 518899 - protein, 11 aa, Influenza virus
AEMKWLLSSTD

SEQ ID NO: 518900 - protein, 11 aa, Influenza virus
AEMLVLLENER

SEQ ID NO: 518901 - protein, 11 aa, Influenza virus
AEQFTWNGVKV

SEQ ID NO: 518902 - protein, 11 aa, Influenza virus
AERGKLKRRAI

SEQ ID NO: 518903 - protein, 11 aa, Influenza virus
AESEMNKLYER

SEQ ID NO: 518904 - protein, 11 aa, Influenza virus
AESLQNRIQID

SEQ ID NO: 518905 - protein, 11 aa, Influenza virus
AESRKLLLIAQ

SEQ ID NO: 518906 - protein, 11 aa, Influenza virus
AESRKLLLITQ

SEQ ID NO: 518907 - protein, 11 aa, Influenza virus
AESRKLLLIVQ

SEQ ID NO: 518908 - protein, 11 aa, Influenza virus
AESRKLLLVVQ

SEQ ID NO: 518909 - protein, 11 aa, Influenza virus
AESRKMLLIVQ

SEQ ID NO: 518910 - protein, 11 aa, Influenza virus
AESSIKEKDMT

SEQ ID NO: 518911 - protein, 11 aa, Influenza virus
AESSVKEKDLT

SEQ ID NO: 518912 - protein, 11 aa, Influenza virus
AESSVKEKDMT

SEQ ID NO: 518913 - protein, 11 aa, Influenza virus
AESSVREKDMT

SEQ ID NO: 518914 - protein, 11 aa, Influenza virus
AEVLVLMENER

SEQ ID NO: 518915 - protein, 11 aa, Influenza virus
AEVSHCRATEY

SEQ ID NO: 518916 - protein, 11 aa, Influenza virus
AEVSYCRATEY

SEQ ID NO: 518917 - protein, 11 aa, Influenza virus
AFCGTSGTYGT

SEQ ID NO: 518918 - protein, 11 aa, Influenza virus
AFCGVDSDTTG

SEQ ID NO: 518919 - protein, 11 aa, Influenza virus
AFCGVDSDTTS

SEQ ID NO: 518920 - protein, 11 aa, Influenza virus
AFCGVNSDTTG

SEQ ID NO: 518921 - protein, 11 aa, Influenza virus
AFCGVNSDTTS

SEQ ID NO: 518922 - protein, 11 aa, Influenza virus
AFCGVNSNTTG

SEQ ID NO: 518923 - protein, 11 aa, Influenza virus
AFDERRNKYLE

SEQ ID NO: 518924 - protein, 11 aa, Influenza virus
AFDERRNRYLE

SEQ ID NO: 518925 - protein, 11 aa, Influenza virus
AFGLICATCEQ

SEQ ID NO: 518926 - protein, 11 aa, Influenza virus
AFGLVCATCEQ

SEQ ID NO: 518927 - protein, 11 aa, Influenza virus
AFIAPDRASFF

SEQ ID NO: 518928 - protein, 11 aa, Influenza virus
AFIAPDRASFL

SEQ ID NO: 518929 - protein, 11 aa, Influenza virus
AFIAPDRATFL

SEQ ID NO: 518930 - protein, 11 aa, Influenza virus
AFIAPNRASFF

SEQ ID NO: 518931 - protein, 11 aa, Influenza virus
AFILWACSSGN

SEQ ID NO: 518932 - protein, 11 aa, Influenza virus
AFIMWACSNGN

SEQ ID NO: 518933 - protein, 11 aa, Influenza virus
AFIMWACSNGS

SEQ ID NO: 518934 - protein, 11 aa, Influenza virus
AFIMWACSSGN

SEQ ID NO: 518935 - protein, 11 aa, Influenza virus
AFKQGNSVWAG

SEQ ID NO: 518936 - protein, 11 aa, Influenza virus
AFLTSSIVCPG

SEQ ID NO: 518937 - protein, 11 aa, Influenza virus
AFRDNLEPGTF

SEQ ID NO: 518938 - protein, 11 aa, Influenza virus
AFRGLISTHLG

SEQ ID NO: 518939 - protein, 11 aa, Influenza virus
AFRGLISTPLG

SEQ ID NO: 518940 - protein, 11 aa, Influenza virus
AFRGLISTQLG

SEQ ID NO: 518941 - protein, 11 aa, Influenza virus
AFRGLMSTPLG

SEQ ID NO: 518942 - protein, 11 aa, Influenza virus
AFSGMSANGDI

SEQ ID NO: 518943 - protein, 11 aa, Influenza virus
AFSVQRNLPFD

SEQ ID NO: 518944 - protein, 11 aa, Influenza virus
AFYKILKIKKG

SEQ ID NO: 518945 - protein, 11 aa, Influenza virus
AFYKILKIRKG

SEQ ID NO: 518946 - protein, 11 aa, Influenza virus
AFYRSINWLTK

SEQ ID NO: 518947 - protein, 11 aa, Influenza virus
AGAAIKGIGTM

SEQ ID NO: 518948 - protein, 11 aa, Influenza virus
AGAAIKGVGTM

SEQ ID NO: 518949 - protein, 11 aa, Influenza virus
AGAAVKGIGTM

SEQ ID NO: 518950 - protein, 11 aa, Influenza virus
AGAAVKGVGTI

SEQ ID NO: 518951 - protein, 11 aa, Influenza virus
AGAAVKGVGTM

SEQ ID NO: 518952 - protein, 11 aa, Influenza virus
AGAGALAEDPD

SEQ ID NO: 518953 - protein, 11 aa, Influenza virus
AGALASCMGLI

SEQ ID NO: 518954 - protein, 11 aa, Influenza virus
AGDGCFEILHK

SEQ ID NO: 518955 - protein, 11 aa, Influenza virus
AGFAPFSKDNS

SEQ ID NO: 518956 - protein, 11 aa, Influenza virus
AGFIEGGWCGM

SEQ ID NO: 518957 - protein, 11 aa, Influenza virus
AGFIEGGWPGL

SEQ ID NO: 518958 - protein, 11 aa, Influenza virus
AGFIEGGWQGL

SEQ ID NO: 518959 - protein, 11 aa, Influenza virus
AGFIEGGWQGM

SEQ ID NO: 518960 - protein, 11 aa, Influenza virus
AGFIEGGWSGL

SEQ ID NO: 518961 - protein, 11 aa, Influenza virus
AGFIEGGWSGM

SEQ ID NO: 518962 - protein, 11 aa, Influenza virus
AGFIEGGWTGL

SEQ ID NO: 518963 - protein, 11 aa, Influenza virus
AGFIEGGWTGM

SEQ ID NO: 518964 - protein, 11 aa, Influenza virus
AGFIEGRWPGL

SEQ ID NO: 518965 - protein, 11 aa, Influenza virus
AGFIENGWEGL

SEQ ID NO: 518966 - protein, 11 aa, Influenza virus
AGFIENGWEGM

SEQ ID NO: 518967 - protein, 11 aa, Influenza virus
AGFIENGWQGL

SEQ ID NO: 518968 - protein, 11 aa, Influenza virus
AGGAIWVTREP

SEQ ID NO: 518969 - protein, 11 aa, Influenza virus
AGGAVWVTREP

SEQ ID NO: 518970 - protein, 11 aa, Influenza virus
AGGDIWITREP

SEQ ID NO: 518971 - protein, 11 aa, Influenza virus
AGGDIWVMREP

SEQ ID NO: 518972 - protein, 11 aa, Influenza virus
AGGDIWVTREH

SEQ ID NO: 518973 - protein, 11 aa, Influenza virus
AGGDIWVTREL

SEQ ID NO: 518974 - protein, 11 aa, Influenza virus
AGGDIWVTREP

SEQ ID NO: 518975 - protein, 11 aa, Influenza virus
AGGDIWVTRVP

SEQ ID NO: 518976 - protein, 11 aa, Influenza virus
AGGHIWVTREP

SEQ ID NO: 518977 - protein, 11 aa, Influenza virus
AGGLILGMQNG

SEQ ID NO: 518978 - protein, 11 aa, Influenza virus
AGGNIWITREP

SEQ ID NO: 518979 - protein, 11 aa, Influenza virus
AGIFFWMCSNG

SEQ ID NO: 518980 - protein, 11 aa, Influenza virus
AGIFLWMCSNG

SEQ ID NO: 518981 - protein, 11 aa, Influenza virus
AGIPSDTPRGE

SEQ ID NO: 518982 - protein, 11 aa, Influenza virus
AGIPTDTPRGE

SEQ ID NO: 518983 - protein, 11 aa, Influenza virus
AGIPTDTPRIQ

SEQ ID NO: 518984 - protein, 11 aa, Influenza virus
AGIPTDTPRVQ

SEQ ID NO: 518985 - protein, 11 aa, Influenza virus
AGISFWMCSNG

SEQ ID NO: 518986 - protein, 11 aa, Influenza virus
AGISIWMCSNG

SEQ ID NO: 518987 - protein, 11 aa, Influenza virus
AGISLWMCSNG

SEQ ID NO: 518988 - protein, 11 aa, Influenza virus
AGKDPKKTGGP

SEQ ID NO: 518989 - protein, 11 aa, Influenza virus
AGKILRTQESE

SEQ ID NO: 518990 - protein, 11 aa, Influenza virus
AGKNADLEALM

SEQ ID NO: 518991 - protein, 11 aa, Influenza virus
AGKNSDLEALM

SEQ ID NO: 518992 - protein, 11 aa, Influenza virus
AGKNTDLEALM

SEQ ID NO: 518993 - protein, 11 aa, Influenza virus
AGKNTDLEVLM

SEQ ID NO: 518994 - protein, 11 aa, Influenza virus
AGLFFWMCSNG

SEQ ID NO: 518995 - protein, 11 aa, Influenza virus
AGLFLWMCSNG

SEQ ID NO: 518996 - protein, 11 aa, Influenza virus
AGLLLWMCSNG

SEQ ID NO: 518997 - protein, 11 aa, Influenza virus
AGLPSDTPRGE

SEQ ID NO: 518998 - protein, 11 aa, Influenza virus
AGLSFWMCSNG

SEQ ID NO: 518999 - protein, 11 aa, Influenza virus
AGLSLWMCFNG

SEQ ID NO: 519000 - protein, 11 aa, Influenza virus
AGLSLWMCSNG

SEQ ID NO: 519001 - protein, 11 aa, Influenza virus
AGLTHIMIWHS

SEQ ID NO: 519002 - protein, 11 aa, Influenza virus
AGLTHLMIWHS

SEQ ID NO: 519003 - protein, 11 aa, Influenza virus
AGLTHMMIWHS

SEQ ID NO: 519004 - protein, 11 aa, Influenza virus
AGNGCFDILHK

SEQ ID NO: 519005 - protein, 11 aa, Influenza virus
AGNILRTQESE

SEQ ID NO: 519006 - protein, 11 aa, Influenza virus
AGNKLITVGSS

SEQ ID NO: 519007 - protein, 11 aa, Influenza virus
AGRIDFHWMLL

SEQ ID NO: 519008 - protein, 11 aa, Influenza virus
AGSAQHVEECS

SEQ ID NO: 519009 - protein, 11 aa, Influenza virus
AGSLSLAIMIA

SEQ ID NO: 519010 - protein, 11 aa, Influenza virus
AGSLSLAIMMA

SEQ ID NO: 519011 - protein, 11 aa, Influenza virus
AGSLSLAIMVA

SEQ ID NO: 519012 - protein, 11 aa, Influenza virus
AGSNEQAAEAM

SEQ ID NO: 519013 - protein, 11 aa, Influenza virus
AGSSEQAAEAI

SEQ ID NO: 519014 - protein, 11 aa, Influenza virus
AGSSEQAAEAM

SEQ ID NO: 519015 - protein, 11 aa, Influenza virus
AGTAKHIEECS

SEQ ID NO: 519016 - protein, 11 aa, Influenza virus
AGVDRFYRICK

SEQ ID NO: 519017 - protein, 11 aa, Influenza virus
AGVDRFYRTCK

SEQ ID NO: 519018 - protein, 11 aa, Influenza virus
AGVEFAVLRGF

SEQ ID NO: 519019 - protein, 11 aa, Influenza virus
AGVESAVLRGF

SEQ ID NO: 519020 - protein, 11 aa, Influenza virus
AGVETMVILSA

SEQ ID NO: 519021 - protein, 11 aa, Influenza virus
AGVKMNPNQKI

SEQ ID NO: 519022 - protein, 11 aa, Influenza virus
AGVNRFYRTCK

SEQ ID NO: 519023 - protein, 11 aa, Influenza virus
AGWILGNPMCD

SEQ ID NO: 519024 - protein, 11 aa, Influenza virus
AGWILGNPRCD

SEQ ID NO: 519025 - protein, 11 aa, Influenza virus
AGWLLGNPECD

SEQ ID NO: 519026 - protein, 11 aa, Influenza virus
AGWLLGNPKCD

SEQ ID NO: 519027 - protein, 11 aa, Influenza virus
AGWLLGNPLCD

SEQ ID NO: 519028 - protein, 11 aa, Influenza virus
AGWLLGNPMCD

SEQ ID NO: 519029 - protein, 11 aa, Influenza virus
AGWYGFQHQNA

SEQ ID NO: 519030 - protein, 11 aa, Influenza virus
AGWYGFQHQNS

SEQ ID NO: 519031 - protein, 11 aa, Influenza virus
AGYAADKESTQ

SEQ ID NO: 519032 - protein, 11 aa, Influenza virus
AHALKLVVAML

SEQ ID NO: 519033 - protein, 11 aa, Influenza virus
AHCYPGATINE

SEQ ID NO: 519034 - protein, 11 aa, Influenza virus
AHDRICIGYQS

SEQ ID NO: 519035 - protein, 11 aa, Influenza virus
AHHRVYWIREG

SEQ ID NO: 519036 - protein, 11 aa, Influenza virus
AHILVTREPYL

SEQ ID NO: 519037 - protein, 11 aa, Influenza virus
AHISPLSGSAQ

SEQ ID NO: 519038 - protein, 11 aa, Influenza virus
AHKQLTHHMRK

SEQ ID NO: 519039 - protein, 11 aa, Influenza virus
AHKSCLPACAY

SEQ ID NO: 519040 - protein, 11 aa, Influenza virus
AHKSCLPACIY

SEQ ID NO: 519041 - protein, 11 aa, Influenza virus
AHKSCLPACVY

SEQ ID NO: 519042 - protein, 11 aa, Influenza virus
AHKSQLIWMAC

SEQ ID NO: 519043 - protein, 11 aa, Influenza virus
AHKSQLVWMAC

SEQ ID NO: 519044 - protein, 11 aa, Influenza virus
AHNGKLCRLSG

SEQ ID NO: 519045 - protein, 11 aa, Influenza virus
AHTKVLYFHKG

SEQ ID NO: 519046 - protein, 11 aa, Influenza virus
AHVLVTREPYL

SEQ ID NO: 519047 - protein, 11 aa, Influenza virus
AIAGFIEGGWC

SEQ ID NO: 519048 - protein, 11 aa, Influenza virus
AIAGFIEGGWP

SEQ ID NO: 519049 - protein, 11 aa, Influenza virus
AIAGFIEGGWQ

SEQ ID NO: 519050 - protein, 11 aa, Influenza virus
AIAGFIEGGWS

SEQ ID NO: 519051 - protein, 11 aa, Influenza virus
AIAGFIEGGWT

SEQ ID NO: 519052 - protein, 11 aa, Influenza virus
AIAGFIEGRWP

SEQ ID NO: 519053 - protein, 11 aa, Influenza virus
AIAGFIENGWE

SEQ ID NO: 519054 - protein, 11 aa, Influenza virus
AIAGFIENGWQ

SEQ ID NO: 519055 - protein, 11 aa, Influenza virus
AIAGFLENGWE

SEQ ID NO: 519056 - protein, 11 aa, Influenza virus
AIALGIINLLI

SEQ ID NO: 519057 - protein, 11 aa, Influenza virus
AIALSILNLLI

SEQ ID NO: 519058 - protein, 11 aa, Influenza virus
AIALSVLNLLI

SEQ ID NO: 519059 - protein, 11 aa, Influenza virus
AIAMGLIFMCV

SEQ ID NO: 519060 - protein, 11 aa, Influenza virus
AIATPGMQIRG

SEQ ID NO: 519061 - protein, 11 aa, Influenza virus
AIAWSATACHD

SEQ ID NO: 519062 - protein, 11 aa, Influenza virus
AICTHLEICFM

SEQ ID NO: 519063 - protein, 11 aa, Influenza virus
AICTHLEVCFM

SEQ ID NO: 519064 - protein, 11 aa, Influenza virus
AICTHMEVCFM

SEQ ID NO: 519065 - protein, 11 aa, Influenza virus
AIDAGDGCFEI

SEQ ID NO: 519066 - protein, 11 aa, Influenza virus
AIDAGNGCFDI

SEQ ID NO: 519067 - protein, 11 aa, Influenza virus
AIDEGDGCFNF

SEQ ID NO: 519068 - protein, 11 aa, Influenza virus
AIDEGDGCFNL

SEQ ID NO: 519069 - protein, 11 aa, Influenza virus
AIDEGDGCFSI

SEQ ID NO: 519070 - protein, 11 aa, Influenza virus
AIDEGDGCFSL

SEQ ID NO: 519071 - protein, 11 aa, Influenza virus
AIDEGNGCFEL

SEQ ID NO: 519072 - protein, 11 aa, Influenza virus
AIDEITTKINN

SEQ ID NO: 519073 - protein, 11 aa, Influenza virus
AIDGITNKINS

SEQ ID NO: 519074 - protein, 11 aa, Influenza virus
AIDGITNKVNS

SEQ ID NO: 519075 - protein, 11 aa, Influenza virus
AIDGVTNKVNS

SEQ ID NO: 519076 - protein, 11 aa, Influenza virus
AIDIMQNKLNN

SEQ ID NO: 519077 - protein, 11 aa, Influenza virus
AIDKITNKINN

SEQ ID NO: 519078 - protein, 11 aa, Influenza virus
AIDKITNKVNN

SEQ ID NO: 519079 - protein, 11 aa, Influenza virus
AIDNGDGCFEI

SEQ ID NO: 519080 - protein, 11 aa, Influenza virus
AIDNMQNKLNN

SEQ ID NO: 519081 - protein, 11 aa, Influenza virus
AIDNMQNRLNN

SEQ ID NO: 519082 - protein, 11 aa, Influenza virus
AIDQINGKLNR

SEQ ID NO: 519083 - protein, 11 aa, Influenza virus
AIDQISGKLNR

SEQ ID NO: 519084 - protein, 11 aa, Influenza virus
AIDQITGKLNH

SEQ ID NO: 519085 - protein, 11 aa, Influenza virus
AIDQITGKLNR

SEQ ID NO: 519086 - protein, 11 aa, Influenza virus
AIDQITRKLNR

SEQ ID NO: 519087 - protein, 11 aa, Influenza virus
AIDQITTKINN

SEQ ID NO: 519088 - protein, 11 aa, Influenza virus
AIDQMTGKLNR

SEQ ID NO: 519089 - protein, 11 aa, Influenza virus
AIDQVNGKLNR

SEQ ID NO: 519090 - protein, 11 aa, Influenza virus
AIDQVTGKLNR

SEQ ID NO: 519091 - protein, 11 aa, Influenza virus
AIDRITTKINN

SEQ ID NO: 519092 - protein, 11 aa, Influenza virus
AIDTGDGCFEI

SEQ ID NO: 519093 - protein, 11 aa, Influenza virus
AIDTGKGCFDI

SEQ ID NO: 519094 - protein, 11 aa, Influenza virus
AIDTGNGCFDI

SEQ ID NO: 519095 - protein, 11 aa, Influenza virus
AIEECLINDPW

SEQ ID NO: 519096 - protein, 11 aa, Influenza virus
AIEKITNKVNN

SEQ ID NO: 519097 - protein, 11 aa, Influenza virus
AIENQHTIDLA

SEQ ID NO: 519098 - protein, 11 aa, Influenza virus
AIGAIDSSMPF

SEQ ID NO: 519099 - protein, 11 aa, Influenza virus
AIGDCPKYIKS

SEQ ID NO: 519100 - protein, 11 aa, Influenza virus
AIGDCPKYVNV

SEQ ID NO: 519101 - protein, 11 aa, Influenza virus
AIGECPKYVKS

SEQ ID NO: 519102 - protein, 11 aa, Influenza virus
AIGFWMCSNGS

SEQ ID NO: 519103 - protein, 11 aa, Influenza virus
AIGGSGTNNYG

SEQ ID NO: 519104 - protein, 11 aa, Influenza virus
AIGKITNKVNN

SEQ ID NO: 519105 - protein, 11 aa, Influenza virus
AIGLRISSSFS

SEQ ID NO: 519106 - protein, 11 aa, Influenza virus
AIGLRNTPSIE

SEQ ID NO: 519107 - protein, 11 aa, Influenza virus
AIGLRNVPQAQ

SEQ ID NO: 519108 - protein, 11 aa, Influenza virus
AIGLRNVPQIE

SEQ ID NO: 519109 - protein, 11 aa, Influenza virus
AIGLRNVPQIQ

SEQ ID NO: 519110 - protein, 11 aa, Influenza virus
AIGLRNVPQVQ

SEQ ID NO: 519111 - protein, 11 aa, Influenza virus
AIGNCPKYVKQ

SEQ ID NO: 519112 - protein, 11 aa, Influenza virus
AIGPRNVPQAQ

SEQ ID NO: 519113 - protein, 11 aa, Influenza virus
AIGPRNVPQVQ

SEQ ID NO: 519114 - protein, 11 aa, Influenza virus
AIHHPPTSAEQ

SEQ ID NO: 519115 - protein, 11 aa, Influenza virus
AIHHPPTSDEQ

SEQ ID NO: 519116 - protein, 11 aa, Influenza virus
AIHHPPTSNEQ

SEQ ID NO: 519117 - protein, 11 aa, Influenza virus
AIHHPPTTDEQ

SEQ ID NO: 519118 - protein, 11 aa, Influenza virus
AIIKKYTSARQ

SEQ ID NO: 519119 - protein, 11 aa, Influenza virus
AIIKKYTSGRQ

SEQ ID NO: 519120 - protein, 11 aa, Influenza virus
AILAATVTLHF

SEQ ID NO: 519121 - protein, 11 aa, Influenza virus
AILATTITLHF

SEQ ID NO: 519122 - protein, 11 aa, Influenza virus
AILATTVTLHF

SEQ ID NO: 519123 - protein, 11 aa, Influenza virus
AILIAGGLILG

SEQ ID NO: 519124 - protein, 11 aa, Influenza virus
AILKPGQTVKI

SEQ ID NO: 519125 - protein, 11 aa, Influenza virus
AILPFDFDKIS

SEQ ID NO: 519126 - protein, 11 aa, Influenza virus
AILPFDIDKII

SEQ ID NO: 519127 - protein, 11 aa, Influenza virus
AILVAGGLILG

SEQ ID NO: 519128 - protein, 11 aa, Influenza virus
AILVTTVTLHF

SEQ ID NO: 519129 - protein, 11 aa, Influenza virus
AINEGNGCFEL

SEQ ID NO: 519130 - protein, 11 aa, Influenza virus
AINEITTKINN

SEQ ID NO: 519131 - protein, 11 aa, Influenza virus
AINGVTNKVNS

SEQ ID NO: 519132 - protein, 11 aa, Influenza virus
AINKITNKVNN

SEQ ID NO: 519133 - protein, 11 aa, Influenza virus
AINLYASKNPY

SEQ ID NO: 519134 - protein, 11 aa, Influenza virus
AINNRFQIQGI

SEQ ID NO: 519135 - protein, 11 aa, Influenza virus
AINNRFQIQGV

SEQ ID NO: 519136 - protein, 11 aa, Influenza virus
AINNRIKINPV

SEQ ID NO: 519137 - protein, 11 aa, Influenza virus
AINQITGKLNR

SEQ ID NO: 519138 - protein, 11 aa, Influenza virus
AINSRFQIQGV

SEQ ID NO: 519139 - protein, 11 aa, Influenza virus
AINSSKPFQNA

SEQ ID NO: 519140 - protein, 11 aa, Influenza virus
AINSSKPFQNT

SEQ ID NO: 519141 - protein, 11 aa, Influenza virus
AINSSKPLQNA

SEQ ID NO: 519142 - protein, 11 aa, Influenza virus
AINSSMPFHNI

SEQ ID NO: 519143 - protein, 11 aa, Influenza virus
AINSSMPFHNV

SEQ ID NO: 519144 - protein, 11 aa, Influenza virus
AINSSMPLHNI

SEQ ID NO: 519145 - protein, 11 aa, Influenza virus
AINSSRPFQNA

SEQ ID NO: 519146 - protein, 11 aa, Influenza virus
AINTSMPFHNI

SEQ ID NO: 519147 - protein, 11 aa, Influenza virus
AINTTLPFHNI

SEQ ID NO: 519148 - protein, 11 aa, Influenza virus
AINTTLPFHNV

SEQ ID NO: 519149 - protein, 11 aa, Influenza virus
AIRFGEGEQII

SEQ ID NO: 519150 - protein, 11 aa, Influenza virus
AIRFGESEQII

SEQ ID NO: 519151 - protein, 11 aa, Influenza virus
AIRFGESEQIV

SEQ ID NO: 519152 - protein, 11 aa, Influenza virus
AIRFGESEQVI

SEQ ID NO: 519153 - protein, 11 aa, Influenza virus
AIRNGTYNHED

SEQ ID NO: 519154 - protein, 11 aa, Influenza virus
AIRTKSGGNTN

SEQ ID NO: 519155 - protein, 11 aa, Influenza virus
AIRTRSGGNNN

SEQ ID NO: 519156 - protein, 11 aa, Influenza virus
AIRTRSGGNTN

SEQ ID NO: 519157 - protein, 11 aa, Influenza virus
AIRTRSGGNTS

SEQ ID NO: 519158 - protein, 11 aa, Influenza virus
AISFWMCSGHS

SEQ ID NO: 519159 - protein, 11 aa, Influenza virus
AISFWMCSNGS

SEQ ID NO: 519160 - protein, 11 aa, Influenza virus
AISNRFQIQGV

SEQ ID NO: 519161 - protein, 11 aa, Influenza virus
AISTTFPYTGD

SEQ ID NO: 519162 - protein, 11 aa, Influenza virus
AITRSGQNHGI

SEQ ID NO: 519163 - protein, 11 aa, Influenza virus
AIVLGIINLLI

SEQ ID NO: 519164 - protein, 11 aa, Influenza virus
AIVQITGKLNR

SEQ ID NO: 519165 - protein, 11 aa, Influenza virus
AIVSADPLASL

SEQ ID NO: 519166 - protein, 11 aa, Influenza virus
AIWTSGSSIAF

SEQ ID NO: 519167 - protein, 11 aa, Influenza virus
AIWTSSSSIVM

SEQ ID NO: 519168 - protein, 11 aa, Influenza virus
AIWVTREPYVS

SEQ ID NO: 519169 - protein, 11 aa, Influenza virus
AIYATVAGSLS

SEQ ID NO: 519170 - protein, 11 aa, Influenza virus
AIYSCIASSIV

SEQ ID NO: 519171 - protein, 11 aa, Influenza virus
AIYSTAASSLV

SEQ ID NO: 519172 - protein, 11 aa, Influenza virus
AIYSTISSSLV

SEQ ID NO: 519173 - protein, 11 aa, Influenza virus
AIYSTVASSLI

SEQ ID NO: 519174 - protein, 11 aa, Influenza virus
AIYSTVASSLV

SEQ ID NO: 519175 - protein, 11 aa, Influenza virus
AIYSTVASSSV

SEQ ID NO: 519176 - protein, 11 aa, Influenza virus
AIYSTVSSSLV

SEQ ID NO: 519177 - protein, 11 aa, Influenza virus
AKAGFIEGGWP

SEQ ID NO: 519178 - protein, 11 aa, Influenza virus
AKAGFIENGWE

SEQ ID NO: 519179 - protein, 11 aa, Influenza virus
AKAGVKMNPNQ

SEQ ID NO: 519180 - protein, 11 aa, Influenza virus
AKAMEQMAGSS

SEQ ID NO: 519181 - protein, 11 aa, Influenza virus
AKAMEQVAGSS

SEQ ID NO: 519182 - protein, 11 aa, Influenza virus
AKDEGNGCFTF

SEQ ID NO: 519183 - protein, 11 aa, Influenza virus
AKDILEKAHNG

SEQ ID NO: 519184 - protein, 11 aa, Influenza virus
AKDILEKTHNG

SEQ ID NO: 519185 - protein, 11 aa, Influenza virus
AKDLGNGCFEF

SEQ ID NO: 519186 - protein, 11 aa, Influenza virus
AKDNAIRFGEG

SEQ ID NO: 519187 - protein, 11 aa, Influenza virus
AKDNAIRFGES

SEQ ID NO: 519188 - protein, 11 aa, Influenza virus
AKDNAVRFGES

SEQ ID NO: 519189 - protein, 11 aa, Influenza virus
AKDNSIRLSAG

SEQ ID NO: 519190 - protein, 11 aa, Influenza virus
AKEAQDVIMEI

SEQ ID NO: 519191 - protein, 11 aa, Influenza virus
AKEAQDVIMEV

SEQ ID NO: 519192 - protein, 11 aa, Influenza virus
AKEECYRACFY

SEQ ID NO: 519193 - protein, 11 aa, Influenza virus
AKEIGNGCFEF

SEQ ID NO: 519194 - protein, 11 aa, Influenza virus
AKELGNGCFEF

SEQ ID NO: 519195 - protein, 11 aa, Influenza virus
AKELVETNHTD

SEQ ID NO: 519196 - protein, 11 aa, Influenza virus
AKEMGNGCFEF

SEQ ID NO: 519197 - protein, 11 aa, Influenza virus
AKEQTALYKNA

SEQ ID NO: 519198 - protein, 11 aa, Influenza virus
AKEQTTLYKNA

SEQ ID NO: 519199 - protein, 11 aa, Influenza virus
AKETGNGCFEF

SEQ ID NO: 519200 - protein, 11 aa, Influenza virus
AKEVGNGCFEF

SEQ ID NO: 519201 - protein, 11 aa, Influenza virus
AKEWGNGCFEF

SEQ ID NO: 519202 - protein, 11 aa, Influenza virus
AKFEAVAWSAT

SEQ ID NO: 519203 - protein, 11 aa, Influenza virus
AKFESVAWSAT

SEQ ID NO: 519204 - protein, 11 aa, Influenza virus
AKGDCYRACFY

SEQ ID NO: 519205 - protein, 11 aa, Influenza virus
AKGDKICLGHH

SEQ ID NO: 519206 - protein, 11 aa, Influenza virus
AKGECYRACFY

SEQ ID NO: 519207 - protein, 11 aa, Influenza virus
AKGEKANVLIG

SEQ ID NO: 519208 - protein, 11 aa, Influenza virus
AKGEKTNVLIG

SEQ ID NO: 519209 - protein, 11 aa, Influenza virus
AKGLFGAIAGF

SEQ ID NO: 519210 - protein, 11 aa, Influenza virus
AKGSYNNTNGE

SEQ ID NO: 519211 - protein, 11 aa, Influenza virus
AKGSYNNTSGE

SEQ ID NO: 519212 - protein, 11 aa, Influenza virus
AKHIEECSCYG

SEQ ID NO: 519213 - protein, 11 aa, Influenza virus
AKHVEECSCYP

SEQ ID NO: 519214 - protein, 11 aa, Influenza virus
AKLANVVRKMM

SEQ ID NO: 519215 - protein, 11 aa, Influenza virus
AKLEKSRINGV

SEQ ID NO: 519216 - protein, 11 aa, Influenza virus
AKLERSKINEV

SEQ ID NO: 519217 - protein, 11 aa, Influenza virus
AKLERSKINGV

SEQ ID NO: 519218 - protein, 11 aa, Influenza virus
AKLLVLIENDR

SEQ ID NO: 519219 - protein, 11 aa, Influenza virus
AKLLVLLENDK

SEQ ID NO: 519220 - protein, 11 aa, Influenza virus
AKLLVLLENDR

SEQ ID NO: 519221 - protein, 11 aa, Influenza virus
AKLLVLLENGR

SEQ ID NO: 519222 - protein, 11 aa, Influenza virus
AKNILEKTHNG

SEQ ID NO: 519223 - protein, 11 aa, Influenza virus
AKNILRTQESE

SEQ ID NO: 519224 - protein, 11 aa, Influenza virus
AKRSYNNTSGE

SEQ ID NO: 519225 - protein, 11 aa, Influenza virus
AKSITQTLVSN

SEQ ID NO: 519226 - protein, 11 aa, Influenza virus
AKSLTQTLVSN

SEQ ID NO: 519227 - protein, 11 aa, Influenza virus
AKSVFNCLYAS

SEQ ID NO: 519228 - protein, 11 aa, Influenza virus
AKSVFNNLYAS

SEQ ID NO: 519229 - protein, 11 aa, Influenza virus
AKSVFNSIYAS

SEQ ID NO: 519230 - protein, 11 aa, Influenza virus
AKSVFNSLYAS

SEQ ID NO: 519231 - protein, 11 aa, Influenza virus
AKSVFNSLYSS

SEQ ID NO: 519232 - protein, 11 aa, Influenza virus
AKSVTQTLVSN

SEQ ID NO: 519233 - protein, 11 aa, Influenza virus
AKYVEWTSNSL

SEQ ID NO: 519234 - protein, 11 aa, Influenza virus
AKYVWWASNSL

SEQ ID NO: 519235 - protein, 11 aa, Influenza virus
AKYVWWTSNSL

SEQ ID NO: 519236 - protein, 11 aa, Influenza virus
ALALSHTAYSQ

SEQ ID NO: 519237 - protein, 11 aa, Influenza virus
ALANTIEIFRS

SEQ ID NO: 519238 - protein, 11 aa, Influenza virus
ALANTIEVFKS

SEQ ID NO: 519239 - protein, 11 aa, Influenza virus
ALANTIEVFRA

SEQ ID NO: 519240 - protein, 11 aa, Influenza virus
ALANTIEVFRL

SEQ ID NO: 519241 - protein, 11 aa, Influenza virus
ALANTIEVFRS

SEQ ID NO: 519242 - protein, 11 aa, Influenza virus
ALAQGALLGTK

SEQ ID NO: 519243 - protein, 11 aa, Influenza virus
ALAQGALLGTN

SEQ ID NO: 519244 - protein, 11 aa, Influenza virus
ALAQGALLGTR

SEQ ID NO: 519245 - protein, 11 aa, Influenza virus
ALAQGALVGTK

SEQ ID NO: 519246 - protein, 11 aa, Influenza virus
ALAQGVLLGTK

SEQ ID NO: 519247 - protein, 11 aa, Influenza virus
ALASCMGLIYN

SEQ ID NO: 519248 - protein, 11 aa, Influenza virus
ALCGSKEQLGS

SEQ ID NO: 519249 - protein, 11 aa, Influenza virus
ALCGSKERLGS

SEQ ID NO: 519250 - protein, 11 aa, Influenza virus
ALCGSKKRLGS

SEQ ID NO: 519251 - protein, 11 aa, Influenza virus
ALCGSPFPVGS

SEQ ID NO: 519252 - protein, 11 aa, Influenza virus
ALCGSPISVGS

SEQ ID NO: 519253 - protein, 11 aa, Influenza virus
ALCGSPVPVGS

SEQ ID NO: 519254 - protein, 11 aa, Influenza virus
ALCGSPVSVGS

SEQ ID NO: 519255 - protein, 11 aa, Influenza virus
ALCGSRERLGS

SEQ ID NO: 519256 - protein, 11 aa, Influenza virus
ALDTGDGCFEI

SEQ ID NO: 519257 - protein, 11 aa, Influenza virus
ALENQHIIDVT

SEQ ID NO: 519258 - protein, 11 aa, Influenza virus
ALENQHTIDLA

SEQ ID NO: 519259 - protein, 11 aa, Influenza virus
ALENQHTIDLT

SEQ ID NO: 519260 - protein, 11 aa, Influenza virus
ALENQHTIDMT

SEQ ID NO: 519261 - protein, 11 aa, Influenza virus
ALENQHTIDVT

SEQ ID NO: 519262 - protein, 11 aa, Influenza virus
ALENQHTIHLT

SEQ ID NO: 519263 - protein, 11 aa, Influenza virus
ALENQNTIDLT

SEQ ID NO: 519264 - protein, 11 aa, Influenza virus
ALGDCPKYIKS

SEQ ID NO: 519265 - protein, 11 aa, Influenza virus
ALGECPKYIKS

SEQ ID NO: 519266 - protein, 11 aa, Influenza virus
ALGIINLLIGI

SEQ ID NO: 519267 - protein, 11 aa, Influenza virus
ALGLRISSSFS

SEQ ID NO: 519268 - protein, 11 aa, Influenza virus
ALGLRNTPSIE

SEQ ID NO: 519269 - protein, 11 aa, Influenza virus
ALGLVCATCEQ

SEQ ID NO: 519270 - protein, 11 aa, Influenza virus
ALGMKNVPEKI

SEQ ID NO: 519271 - protein, 11 aa, Influenza virus
ALGNCPKYIKS

SEQ ID NO: 519272 - protein, 11 aa, Influenza virus
ALGQGTTLDNE

SEQ ID NO: 519273 - protein, 11 aa, Influenza virus
ALGQGTTLDNK

SEQ ID NO: 519274 - protein, 11 aa, Influenza virus
ALGQGTTLENK

SEQ ID NO: 519275 - protein, 11 aa, Influenza virus
ALGQGTTLNNK

SEQ ID NO: 519276 - protein, 11 aa, Influenza virus
ALGQGTTLYNK

SEQ ID NO: 519277 - protein, 11 aa, Influenza virus
ALGSPGCDRLQ

SEQ ID NO: 519278 - protein, 11 aa, Influenza virus
ALGYSTGALAS

SEQ ID NO: 519279 - protein, 11 aa, Influenza virus
ALHLLLEVEQE

SEQ ID NO: 519280 - protein, 11 aa, Influenza virus
ALHQGTTIRNK

SEQ ID NO: 519281 - protein, 11 aa, Influenza virus
ALHQGTTIRNR

SEQ ID NO: 519282 - protein, 11 aa, Influenza virus
ALILGFVLWAC

SEQ ID NO: 519283 - protein, 11 aa, Influenza virus
ALILRGAVAHK

SEQ ID NO: 519284 - protein, 11 aa, Influenza virus
ALILRGSIAHK

SEQ ID NO: 519285 - protein, 11 aa, Influenza virus
ALILRGSVAHK

SEQ ID NO: 519286 - protein, 11 aa, Influenza virus
ALILVALALSH

SEQ ID NO: 519287 - protein, 11 aa, Influenza virus
ALISWEMGLAP

SEQ ID NO: 519288 - protein, 11 aa, Influenza virus
ALISWEMGQAP

SEQ ID NO: 519289 - protein, 11 aa, Influenza virus
ALISWGMGQAP

SEQ ID NO: 519290 - protein, 11 aa, Influenza virus
ALISWPLSSPP

SEQ ID NO: 519291 - protein, 11 aa, Influenza virus
ALISWPQSSPP

SEQ ID NO: 519292 - protein, 11 aa, Influenza virus
ALIVWGVHHSS

SEQ ID NO: 519293 - protein, 11 aa, Influenza virus
ALKDNLEPGTF

SEQ ID NO: 519294 - protein, 11 aa, Influenza virus
ALKMTIASDIL

SEQ ID NO: 519295 - protein, 11 aa, Influenza virus
ALLAKSVFNSL

SEQ ID NO: 519296 - protein, 11 aa, Influenza virus
ALLGTKHSNGT

SEQ ID NO: 519297 - protein, 11 aa, Influenza virus
ALLGTNHSNGT

SEQ ID NO: 519298 - protein, 11 aa, Influenza virus
ALLGTRHSNGT

SEQ ID NO: 519299 - protein, 11 aa, Influenza virus
ALLIAFVLWAC

SEQ ID NO: 519300 - protein, 11 aa, Influenza virus
ALLKHRFEIIE

SEQ ID NO: 519301 - protein, 11 aa, Influenza virus
ALLLAFILWAC

SEQ ID NO: 519302 - protein, 11 aa, Influenza virus
ALLLAFMLWAC

SEQ ID NO: 519303 - protein, 11 aa, Influenza virus
ALLLAFVLWAC

SEQ ID NO: 519304 - protein, 11 aa, Influenza virus
ALLLTFILWAC

SEQ ID NO: 519305 - protein, 11 aa, Influenza virus
ALLNASCAAMD

SEQ ID NO: 519306 - protein, 11 aa, Influenza virus
ALLNASCAAME

SEQ ID NO: 519307 - protein, 11 aa, Influenza virus
ALLNDKHSNET

SEQ ID NO: 519308 - protein, 11 aa, Influenza virus
ALLNDKHSNGS

SEQ ID NO: 519309 - protein, 11 aa, Influenza virus
ALLNDKHSNGT

SEQ ID NO: 519310 - protein, 11 aa, Influenza virus
ALLNDKHSNNT

SEQ ID NO: 519311 - protein, 11 aa, Influenza virus
ALLNDRHSNGT

SEQ ID NO: 519312 - protein, 11 aa, Influenza virus
ALLNRLNINPV

SEQ ID NO: 519313 - protein, 11 aa, Influenza virus
ALLNRLNINSV

SEQ ID NO: 519314 - protein, 11 aa, Influenza virus
ALLNRLSINPV

SEQ ID NO: 519315 - protein, 11 aa, Influenza virus
ALLSRLNINPV

SEQ ID NO: 519316 - protein, 11 aa, Influenza virus
ALMEWIKTRPI

SEQ ID NO: 519317 - protein, 11 aa, Influenza virus
ALMEWLKTRPI

SEQ ID NO: 519318 - protein, 11 aa, Influenza virus
ALMSVLLGSSP

SEQ ID NO: 519319 - protein, 11 aa, Influenza virus
ALMSVPLGSSP

SEQ ID NO: 519320 - protein, 11 aa, Influenza virus
ALMSVPLGSSS

SEQ ID NO: 519321 - protein, 11 aa, Influenza virus
ALNEITTKINN

SEQ ID NO: 519322 - protein, 11 aa, Influenza virus
ALNGNGDPNNM

SEQ ID NO: 519323 - protein, 11 aa, Influenza virus
ALNTTLPFHNI

SEQ ID NO: 519324 - protein, 11 aa, Influenza virus
ALNYHYEECSC

SEQ ID NO: 519325 - protein, 11 aa, Influenza virus
ALQGTKRSYEQ

SEQ ID NO: 519326 - protein, 11 aa, Influenza virus
ALQLFIKDYRY

SEQ ID NO: 519327 - protein, 11 aa, Influenza virus
ALQLLFEVEQE

SEQ ID NO: 519328 - protein, 11 aa, Influenza virus
ALQLLLEVENE

SEQ ID NO: 519329 - protein, 11 aa, Influenza virus
ALQLLLEVEQE

SEQ ID NO: 519330 - protein, 11 aa, Influenza virus
ALQLLLEVESE

SEQ ID NO: 519331 - protein, 11 aa, Influenza virus
ALQLNPIDGPL

SEQ ID NO: 519332 - protein, 11 aa, Influenza virus
ALQNRIMINPV

SEQ ID NO: 519333 - protein, 11 aa, Influenza virus
ALRDNLEPGTF

SEQ ID NO: 519334 - protein, 11 aa, Influenza virus
ALRDSLEPGTF

SEQ ID NO: 519335 - protein, 11 aa, Influenza virus
ALRELWQCYYL

SEQ ID NO: 519336 - protein, 11 aa, Influenza virus
ALRMKWMMAMK

SEQ ID NO: 519337 - protein, 11 aa, Influenza virus
ALRMKWMMAMR

SEQ ID NO: 519338 - protein, 11 aa, Influenza virus
ALRQIIRESGG

SEQ ID NO: 519339 - protein, 11 aa, Influenza virus
ALRQKIMESGE

SEQ ID NO: 519340 - protein, 11 aa, Influenza virus
ALRQKIMESGG

SEQ ID NO: 519341 - protein, 11 aa, Influenza virus
ALSGNGDPNNM

SEQ ID NO: 519342 - protein, 11 aa, Influenza virus
ALSGVAIALSI

SEQ ID NO: 519343 - protein, 11 aa, Influenza virus
ALSGVAIALSV

SEQ ID NO: 519344 - protein, 11 aa, Influenza virus
ALSHTAYSQIT

SEQ ID NO: 519345 - protein, 11 aa, Influenza virus
ALSIAPIMFSN

SEQ ID NO: 519346 - protein, 11 aa, Influenza virus
ALSILNLLIGI

SEQ ID NO: 519347 - protein, 11 aa, Influenza virus
ALSIYSCIASS

SEQ ID NO: 519348 - protein, 11 aa, Influenza virus
ALSQGTTIRGK

SEQ ID NO: 519349 - protein, 11 aa, Influenza virus
ALSQGTTIRGR

SEQ ID NO: 519350 - protein, 11 aa, Influenza virus
ALSQGTTLKGR

SEQ ID NO: 519351 - protein, 11 aa, Influenza virus
ALSQGTTLRGQ

SEQ ID NO: 519352 - protein, 11 aa, Influenza virus
ALSQGTTLRGR

SEQ ID NO: 519353 - protein, 11 aa, Influenza virus
ALSVLNLLIGI

SEQ ID NO: 519354 - protein, 11 aa, Influenza virus
ALSVLNLLIGV

SEQ ID NO: 519355 - protein, 11 aa, Influenza virus
ALSYSAGALAS

SEQ ID NO: 519356 - protein, 11 aa, Influenza virus
ALSYSTGALAS

SEQ ID NO: 519357 - protein, 11 aa, Influenza virus
ALTGGQSFYRS

SEQ ID NO: 519358 - protein, 11 aa, Influenza virus
ALTLNTMTKDA

SEQ ID NO: 519359 - protein, 11 aa, Influenza virus
ALVGTKHSNGT

SEQ ID NO: 519360 - protein, 11 aa, Influenza virus
ALVRGQQGRMD

SEQ ID NO: 519361 - protein, 11 aa, Influenza virus
ALVRSGMDPRM

SEQ ID NO: 519362 - protein, 11 aa, Influenza virus
ALVRTGMDPRM

SEQ ID NO: 519363 - protein, 11 aa, Influenza virus
ALVSWEMGQAP

SEQ ID NO: 519364 - protein, 11 aa, Influenza virus
ALVSWPLSSPP

SEQ ID NO: 519365 - protein, 11 aa, Influenza virus
ALYGTQSLSIS

SEQ ID NO: 519366 - protein, 11 aa, Influenza virus
ALYKNANTLSS

SEQ ID NO: 519367 - protein, 11 aa, Influenza virus
AMASQGTKRSF

SEQ ID NO: 519368 - protein, 11 aa, Influenza virus
AMASQGTKRSY

SEQ ID NO: 519369 - protein, 11 aa, Influenza virus
AMDAGNGCFDI

SEQ ID NO: 519370 - protein, 11 aa, Influenza virus
AMDDFQLIPII

SEQ ID NO: 519371 - protein, 11 aa, Influenza virus
AMDDFQLIPMI

SEQ ID NO: 519372 - protein, 11 aa, Influenza virus
AMDDYQLIPMI

SEQ ID NO: 519373 - protein, 11 aa, Influenza virus
AMDEFQLIPMI

SEQ ID NO: 519374 - protein, 11 aa, Influenza virus
AMDGVTNKVNS

SEQ ID NO: 519375 - protein, 11 aa, Influenza virus
AMDHTSQYLCT

SEQ ID NO: 519376 - protein, 11 aa, Influenza virus
AMEDFQLIPMI

SEQ ID NO: 519377 - protein, 11 aa, Influenza virus
AMEHTSQYLCT

SEQ ID NO: 519378 - protein, 11 aa, Influenza virus
AMELIRMIKRG

SEQ ID NO: 519379 - protein, 11 aa, Influenza virus
AMENQHTIDLA

SEQ ID NO: 519380 - protein, 11 aa, Influenza virus
AMENQHTIDLT

SEQ ID NO: 519381 - protein, 11 aa, Influenza virus
AMENQHTIDMA

SEQ ID NO: 519382 - protein, 11 aa, Influenza virus
AMENQHTIDMG

SEQ ID NO: 519383 - protein, 11 aa, Influenza virus
AMEQIAGSSEQ

SEQ ID NO: 519384 - protein, 11 aa, Influenza virus
AMEQMAGSSEQ

SEQ ID NO: 519385 - protein, 11 aa, Influenza virus
AMEQVAGSSEQ

SEQ ID NO: 519386 - protein, 11 aa, Influenza virus
AMGLIFMCVKN

SEQ ID NO: 519387 - protein, 11 aa, Influenza virus
AMGLKISSSFS

SEQ ID NO: 519388 - protein, 11 aa, Influenza virus
AMGLRISSSFS

SEQ ID NO: 519389 - protein, 11 aa, Influenza virus
AMGLVFICIKN

SEQ ID NO: 519390 - protein, 11 aa, Influenza virus
AMGLVFICMKN

SEQ ID NO: 519391 - protein, 11 aa, Influenza virus
AMGLVFICVKN

SEQ ID NO: 519392 - protein, 11 aa, Influenza virus
AMGLVFMCVKN

SEQ ID NO: 519393 - protein, 11 aa, Influenza virus
AMGMRISSSFS

SEQ ID NO: 519394 - protein, 11 aa, Influenza virus
AMISRARIDAR

SEQ ID NO: 519395 - protein, 11 aa, Influenza virus
AMKHTSQYICS

SEQ ID NO: 519396 - protein, 11 aa, Influenza virus
AMKHTSQYLCT

SEQ ID NO: 519397 - protein, 11 aa, Influenza virus
AMLCLGHHAVP

SEQ ID NO: 519398 - protein, 11 aa, Influenza virus
AMLNASCAAMD

SEQ ID NO: 519399 - protein, 11 aa, Influenza virus
AMMDQVREGRN

SEQ ID NO: 519400 - protein, 11 aa, Influenza virus
AMMDQVRESRN

SEQ ID NO: 519401 - protein, 11 aa, Influenza virus
AMMSRARIDAR

SEQ ID NO: 519402 - protein, 11 aa, Influenza virus
AMQNRIQIDPV

SEQ ID NO: 519403 - protein, 11 aa, Influenza virus
AMTEIWSYNAE

SEQ ID NO: 519404 - protein, 11 aa, Influenza virus
AMTEVWSYNAE

SEQ ID NO: 519405 - protein, 11 aa, Influenza virus
AMTHTSQYICS

SEQ ID NO: 519406 - protein, 11 aa, Influenza virus
AMVDQVRESRN

SEQ ID NO: 519407 - protein, 11 aa, Influenza virus
AMVSRARIDAR

SEQ ID NO: 519408 - protein, 11 aa, Influenza virus
ANCYPGATVNE

SEQ ID NO: 519409 - protein, 11 aa, Influenza virus
ANDLGNGCFEF

SEQ ID NO: 519410 - protein, 11 aa, Influenza virus
ANELGNGCFEF

SEQ ID NO: 519411 - protein, 11 aa, Influenza virus
ANFSMELPSFG

SEQ ID NO: 519412 - protein, 11 aa, Influenza virus
ANGTIHDRSPF

SEQ ID NO: 519413 - protein, 11 aa, Influenza virus
ANGTIHDRSPY

SEQ ID NO: 519414 - protein, 11 aa, Influenza virus
ANGTIHDRSQF

SEQ ID NO: 519415 - protein, 11 aa, Influenza virus
ANGTINDRSPF

SEQ ID NO: 519416 - protein, 11 aa, Influenza virus
ANGTKVNTLTE

SEQ ID NO: 519417 - protein, 11 aa, Influenza virus
ANGTMHDRSPF

SEQ ID NO: 519418 - protein, 11 aa, Influenza virus
ANGWVSTDKDS

SEQ ID NO: 519419 - protein, 11 aa, Influenza virus
ANGWVSTDKNS

SEQ ID NO: 519420 - protein, 11 aa, Influenza virus
ANGWVSTDKSS

SEQ ID NO: 519421 - protein, 11 aa, Influenza virus
ANINFMPYISF

SEQ ID NO: 519422 - protein, 11 aa, Influenza virus
ANKLYVNKNPY

SEQ ID NO: 519423 - protein, 11 aa, Influenza virus
ANKQASYKIFK

SEQ ID NO: 519424 - protein, 11 aa, Influenza virus
ANLCRFLETRT

SEQ ID NO: 519425 - protein, 11 aa, Influenza virus
ANLGLNIGLHL

SEQ ID NO: 519426 - protein, 11 aa, Influenza virus
ANLGLNVGLHL

SEQ ID NO: 519427 - protein, 11 aa, Influenza virus
ANNADHRIYWI

SEQ ID NO: 519428 - protein, 11 aa, Influenza virus
ANNADHRVYWI

SEQ ID NO: 519429 - protein, 11 aa, Influenza virus
ANNDWSGYSGS

SEQ ID NO: 519430 - protein, 11 aa, Influenza virus
ANNGKFEFIAE

SEQ ID NO: 519431 - protein, 11 aa, Influenza virus
ANNGKFEFIVE

SEQ ID NO: 519432 - protein, 11 aa, Influenza virus
ANNGKLEFIAE

SEQ ID NO: 519433 - protein, 11 aa, Influenza virus
ANNGRFEFIAE

SEQ ID NO: 519434 - protein, 11 aa, Influenza virus
ANNQASYKIFK

SEQ ID NO: 519435 - protein, 11 aa, Influenza virus
ANNQASYRIFK

SEQ ID NO: 519436 - protein, 11 aa, Influenza virus
ANNSKKQIDTI

SEQ ID NO: 519437 - protein, 11 aa, Influenza virus
ANNSPEQVDTI

SEQ ID NO: 519438 - protein, 11 aa, Influenza virus
ANNSTDTVDTI

SEQ ID NO: 519439 - protein, 11 aa, Influenza virus
ANNSTDTVDTV

SEQ ID NO: 519440 - protein, 11 aa, Influenza virus
ANNSTEHVDTI

SEQ ID NO: 519441 - protein, 11 aa, Influenza virus
ANNSTEQVDTI

SEQ ID NO: 519442 - protein, 11 aa, Influenza virus
ANNSTERVDTI

SEQ ID NO: 519443 - protein, 11 aa, Influenza virus
ANNSTKQIDTI

SEQ ID NO: 519444 - protein, 11 aa, Influenza virus
ANNSTKQVDTI

SEQ ID NO: 519445 - protein, 11 aa, Influenza virus
ANNSTTKVDTI

SEQ ID NO: 519446 - protein, 11 aa, Influenza virus
ANNSTTQIDTI

SEQ ID NO: 519447 - protein, 11 aa, Influenza virus
ANNSTTQVDTI

SEQ ID NO: 519448 - protein, 11 aa, Influenza virus
ANNSTTQVDTL

SEQ ID NO: 519449 - protein, 11 aa, Influenza virus
ANNSTTQVNTI

SEQ ID NO: 519450 - protein, 11 aa, Influenza virus
ANNSTVQVDTI

SEQ ID NO: 519451 - protein, 11 aa, Influenza virus
ANQRLNPMHQL

SEQ ID NO: 519452 - protein, 11 aa, Influenza virus
ANQRLNTMHQL

SEQ ID NO: 519453 - protein, 11 aa, Influenza virus
ANQVFPQLNQT

SEQ ID NO: 519454 - protein, 11 aa, Influenza virus
ANRPIIEIDMN

SEQ ID NO: 519455 - protein, 11 aa, Influenza virus
ANRPIIEIDMS

SEQ ID NO: 519456 - protein, 11 aa, Influenza virus
ANRPIIEIDMT

SEQ ID NO: 519457 - protein, 11 aa, Influenza virus
ANRPVIEIDMN

SEQ ID NO: 519458 - protein, 11 aa, Influenza virus
ANRPVIEIDMS

SEQ ID NO: 519459 - protein, 11 aa, Influenza virus
ANSADHRIYWI

SEQ ID NO: 519460 - protein, 11 aa, Influenza virus
ANSADHRVYWI

SEQ ID NO: 519461 - protein, 11 aa, Influenza virus
ANSEMNKLYER

SEQ ID NO: 519462 - protein, 11 aa, Influenza virus
ANSQASYKIFK

SEQ ID NO: 519463 - protein, 11 aa, Influenza virus
ANTLSSVNTNT

SEQ ID NO: 519464 - protein, 11 aa, Influenza virus
ANTLSSVTTNT

SEQ ID NO: 519465 - protein, 11 aa, Influenza virus
ANTLTSVTTNT

SEQ ID NO: 519466 - protein, 11 aa, Influenza virus
ANVKNLHDQIK

SEQ ID NO: 519467 - protein, 11 aa, Influenza virus
ANVKNLHEQVK

SEQ ID NO: 519468 - protein, 11 aa, Influenza virus
ANVKNLHEQVR

SEQ ID NO: 519469 - protein, 11 aa, Influenza virus
ANVLIGQGDIV

SEQ ID NO: 519470 - protein, 11 aa, Influenza virus
ANVLIGQGDVV

SEQ ID NO: 519471 - protein, 11 aa, Influenza virus
ANVRNLHDQIK

SEQ ID NO: 519472 - protein, 11 aa, Influenza virus
ANVRNLHDQIR

SEQ ID NO: 519473 - protein, 11 aa, Influenza virus
ANVRNLHDQVK

SEQ ID NO: 519474 - protein, 11 aa, Influenza virus
ANVRNLHDQVR

SEQ ID NO: 519475 - protein, 11 aa, Influenza virus
ANVRNLHDRIR

SEQ ID NO: 519476 - protein, 11 aa, Influenza virus
ANVRNLHDRTR

SEQ ID NO: 519477 - protein, 11 aa, Influenza virus
ANVRNLHDRVK

SEQ ID NO: 519478 - protein, 11 aa, Influenza virus
ANVRNLHDRVR

SEQ ID NO: 519479 - protein, 11 aa, Influenza virus
ANVRNLHEQIK

SEQ ID NO: 519480 - protein, 11 aa, Influenza virus
ANVRNLHEQVR

SEQ ID NO: 519481 - protein, 11 aa, Influenza virus
ANVRNLHERIR

SEQ ID NO: 519482 - protein, 11 aa, Influenza virus
ANVVRKMMTNS

SEQ ID NO: 519483 - protein, 11 aa, Influenza virus
ANVVRKMMTSS

SEQ ID NO: 519484 - protein, 11 aa, Influenza virus
APDRATFLRSN

SEQ ID NO: 519485 - protein, 11 aa, Influenza virus
APDYHYEECSC

SEQ ID NO: 519486 - protein, 11 aa, Influenza virus
APEFGYLLKGE

SEQ ID NO: 519487 - protein, 11 aa, Influenza virus
APEFGYLLRGE

SEQ ID NO: 519488 - protein, 11 aa, Influenza virus
APEGMCYPGFV

SEQ ID NO: 519489 - protein, 11 aa, Influenza virus
APEGMCYPGSI

SEQ ID NO: 519490 - protein, 11 aa, Influenza virus
APEGMCYPGSV

SEQ ID NO: 519491 - protein, 11 aa, Influenza virus
APEYGFKISKR

SEQ ID NO: 519492 - protein, 11 aa, Influenza virus
APEYGFRISKR

SEQ ID NO: 519493 - protein, 11 aa, Influenza virus
APEYGHLITGK

SEQ ID NO: 519494 - protein, 11 aa, Influenza virus
APEYGHLTTGK

SEQ ID NO: 519495 - protein, 11 aa, Influenza virus
APEYGHLVTGK

SEQ ID NO: 519496 - protein, 11 aa, Influenza virus
APEYGYLITGK

SEQ ID NO: 519497 - protein, 11 aa, Influenza virus
APFAKDNSIRL

SEQ ID NO: 519498 - protein, 11 aa, Influenza virus
APFDDRLRRDQ

SEQ ID NO: 519499 - protein, 11 aa, Influenza virus
APFIDRLRRDQ

SEQ ID NO: 519500 - protein, 11 aa, Influenza virus
APFISCSYLEC

SEQ ID NO: 519501 - protein, 11 aa, Influenza virus
APFLDRIRRDQ

SEQ ID NO: 519502 - protein, 11 aa, Influenza virus
APFLDRLRRDQ

SEQ ID NO: 519503 - protein, 11 aa, Influenza virus
APFLDRVRRDQ

SEQ ID NO: 519504 - protein, 11 aa, Influenza virus
APFSEDNSIRL

SEQ ID NO: 519505 - protein, 11 aa, Influenza virus
APFSKDNGIRI

SEQ ID NO: 519506 - protein, 11 aa, Influenza virus
APFSKDNSIQL

SEQ ID NO: 519507 - protein, 11 aa, Influenza virus
APFSKDNSIRL

SEQ ID NO: 519508 - protein, 11 aa, Influenza virus
APFSKDNSVRL

SEQ ID NO: 519509 - protein, 11 aa, Influenza virus
APGFHFEECSC

SEQ ID NO: 519510 - protein, 11 aa, Influenza virus
APGIKGFGFLN

SEQ ID NO: 519511 - protein, 11 aa, Influenza virus
APGTKGFGFLN

SEQ ID NO: 519512 - protein, 11 aa, Influenza virus
APGVKGFGFLD

SEQ ID NO: 519513 - protein, 11 aa, Influenza virus
APGVKGFGFLN

SEQ ID NO: 519514 - protein, 11 aa, Influenza virus
APGWSWDDGAI

SEQ ID NO: 519515 - protein, 11 aa, Influenza virus
APHGLCYPGEL

SEQ ID NO: 519516 - protein, 11 aa, Influenza virus
APHRLCYPGEL

SEQ ID NO: 519517 - protein, 11 aa, Influenza virus
APIEHIASIRR

SEQ ID NO: 519518 - protein, 11 aa, Influenza virus
APIEHIASMRR

SEQ ID NO: 519519 - protein, 11 aa, Influenza virus
APIEHVASMRR

SEQ ID NO: 519520 - protein, 11 aa, Influenza virus
APIEYIASMRR

SEQ ID NO: 519521 - protein, 11 aa, Influenza virus
APIEYVASMRR

SEQ ID NO: 519522 - protein, 11 aa, Influenza virus
APILGNYKEIC

SEQ ID NO: 519523 - protein, 11 aa, Influenza virus
APIMFSNKMAK

SEQ ID NO: 519524 - protein, 11 aa, Influenza virus
APIMFSNKMAR

SEQ ID NO: 519525 - protein, 11 aa, Influenza virus
APIMFSNKVAR

SEQ ID NO: 519526 - protein, 11 aa, Influenza virus
APISLGDCSFA

SEQ ID NO: 519527 - protein, 11 aa, Influenza virus
APISLGGCSFA

SEQ ID NO: 519528 - protein, 11 aa, Influenza virus
APKYGYIIEEY

SEQ ID NO: 519529 - protein, 11 aa, Influenza virus
APLELRDCKIE

SEQ ID NO: 519530 - protein, 11 aa, Influenza virus
APLELRDCKVE

SEQ ID NO: 519531 - protein, 11 aa, Influenza virus
APLMMAYMLER

SEQ ID NO: 519532 - protein, 11 aa, Influenza virus
APLMVAYMLER

SEQ ID NO: 519533 - protein, 11 aa, Influenza virus
APLSKDNGIRI

SEQ ID NO: 519534 - protein, 11 aa, Influenza virus
APLVLDDCSLE

SEQ ID NO: 519535 - protein, 11 aa, Influenza virus
APNFHYEECSC

SEQ ID NO: 519536 - protein, 11 aa, Influenza virus
APNFYYEECSC

SEQ ID NO: 519537 - protein, 11 aa, Influenza virus
APNSHYEECSC

SEQ ID NO: 519538 - protein, 11 aa, Influenza virus
APNYHYEECSC

SEQ ID NO: 519539 - protein, 11 aa, Influenza virus
APNYYYEECSC

SEQ ID NO: 519540 - protein, 11 aa, Influenza virus
APQLNPIDGPL

SEQ ID NO: 519541 - protein, 11 aa, Influenza virus
APRGHYKISKS

SEQ ID NO: 519542 - protein, 11 aa, Influenza virus
APRYGYIIEEY

SEQ ID NO: 519543 - protein, 11 aa, Influenza virus
APRYGYIIEKY

SEQ ID NO: 519544 - protein, 11 aa, Influenza virus
APSGIEYNGKS

SEQ ID NO: 519545 - protein, 11 aa, Influenza virus
APSGVEYNGKS

SEQ ID NO: 519546 - protein, 11 aa, Influenza virus
APSPSNSRFES

SEQ ID NO: 519547 - protein, 11 aa, Influenza virus
APSPYNSKFES

SEQ ID NO: 519548 - protein, 11 aa, Influenza virus
APSPYNSRFES

SEQ ID NO: 519549 - protein, 11 aa, Influenza virus
APVLGNYKEIC

SEQ ID NO: 519550 - protein, 11 aa, Influenza virus
APVLGNYKEMC

SEQ ID NO: 519551 - protein, 11 aa, Influenza virus
APVLGNYREIC

SEQ ID NO: 519552 - protein, 11 aa, Influenza virus
APVLGNYREVC

SEQ ID NO: 519553 - protein, 11 aa, Influenza virus
AQAFYKILKIK

SEQ ID NO: 519554 - protein, 11 aa, Influenza virus
AQAFYKILKIR

SEQ ID NO: 519555 - protein, 11 aa, Influenza virus
AQDILEKTHNG

SEQ ID NO: 519556 - protein, 11 aa, Influenza virus
AQDILERTHNG

SEQ ID NO: 519557 - protein, 11 aa, Influenza virus
AQDNAIRFGES

SEQ ID NO: 519558 - protein, 11 aa, Influenza virus
AQDVIMEVVFP

SEQ ID NO: 519559 - protein, 11 aa, Influenza virus
AQEIGNGCFEF

SEQ ID NO: 519560 - protein, 11 aa, Influenza virus
AQGALLGTKHS

SEQ ID NO: 519561 - protein, 11 aa, Influenza virus
AQGALLGTNHS

SEQ ID NO: 519562 - protein, 11 aa, Influenza virus
AQGALLGTRHS

SEQ ID NO: 519563 - protein, 11 aa, Influenza virus
AQGALVGTKHS

SEQ ID NO: 519564 - protein, 11 aa, Influenza virus
AQGEGIAADYK

SEQ ID NO: 519565 - protein, 11 aa, Influenza virus
AQGEGTAADYK

SEQ ID NO: 519566 - protein, 11 aa, Influenza virus
AQGIGQAADYK

SEQ ID NO: 519567 - protein, 11 aa, Influenza virus
AQGQGTAADYK

SEQ ID NO: 519568 - protein, 11 aa, Influenza virus
AQGSGYAADLK

SEQ ID NO: 519569 - protein, 11 aa, Influenza virus
AQGSYNNTSGE

SEQ ID NO: 519570 - protein, 11 aa, Influenza virus
AQGTGQAADYE

SEQ ID NO: 519571 - protein, 11 aa, Influenza virus
AQGTGQAADYK

SEQ ID NO: 519572 - protein, 11 aa, Influenza virus
AQGVLLGTKHS

SEQ ID NO: 519573 - protein, 11 aa, Influenza virus
AQHIEECSCYG

SEQ ID NO: 519574 - protein, 11 aa, Influenza virus
AQHIEECSCYP

SEQ ID NO: 519575 - protein, 11 aa, Influenza virus
AQHVEECSCYP

SEQ ID NO: 519576 - protein, 11 aa, Influenza virus
AQIDESCEGEC

SEQ ID NO: 519577 - protein, 11 aa, Influenza virus
AQKAMMDQVRE

SEQ ID NO: 519578 - protein, 11 aa, Influenza virus
AQKLEDVFAGK

SEQ ID NO: 519579 - protein, 11 aa, Influenza virus
AQLLVLLENEK

SEQ ID NO: 519580 - protein, 11 aa, Influenza virus
AQLLVWLENEK

SEQ ID NO: 519581 - protein, 11 aa, Influenza virus
AQMALQLFIKD

SEQ ID NO: 519582 - protein, 11 aa, Influenza virus
AQNAISITFPY

SEQ ID NO: 519583 - protein, 11 aa, Influenza virus
AQNAISTTFPY

SEQ ID NO: 519584 - protein, 11 aa, Influenza virus
AQRAMMDQVRE

SEQ ID NO: 519585 - protein, 11 aa, Influenza virus
AQRAMVDQVRE

SEQ ID NO: 519586 - protein, 11 aa, Influenza virus
AQRLEDVFAGK

SEQ ID NO: 519587 - protein, 11 aa, Influenza virus
AQRLEGVFAGK

SEQ ID NO: 519588 - protein, 11 aa, Influenza virus
AQRLENVFAGK

SEQ ID NO: 519589 - protein, 11 aa, Influenza virus
AQRLESVFAGK

SEQ ID NO: 519590 - protein, 11 aa, Influenza virus
AQSFYRSINWL

SEQ ID NO: 519591 - protein, 11 aa, Influenza virus
AQSLSISVGSS

SEQ ID NO: 519592 - protein, 11 aa, Influenza virus
AQTDCVLEAMA

SEQ ID NO: 519593 - protein, 11 aa, Influenza virus
AQYREEALLNR

SEQ ID NO: 519594 - protein, 11 aa, Influenza virus
ARCICEKLEQS

SEQ ID NO: 519595 - protein, 11 aa, Influenza virus
ARDEGNGCFTF

SEQ ID NO: 519596 - protein, 11 aa, Influenza virus
AREIGNGCFEF

SEQ ID NO: 519597 - protein, 11 aa, Influenza virus
ARELGNGCFEF

SEQ ID NO: 519598 - protein, 11 aa, Influenza virus
ARFEAVAWSAT

SEQ ID NO: 519599 - protein, 11 aa, Influenza virus
ARFESVAWSAT

SEQ ID NO: 519600 - protein, 11 aa, Influenza virus
ARGDKICLGHH

SEQ ID NO: 519601 - protein, 11 aa, Influenza virus
ARGEKANVLIG

SEQ ID NO: 519602 - protein, 11 aa, Influenza virus
ARGLFGAIAGF

SEQ ID NO: 519603 - protein, 11 aa, Influenza virus
ARGSYNNTSGE

SEQ ID NO: 519604 - protein, 11 aa, Influenza virus
ARHIEECSCYG

SEQ ID NO: 519605 - protein, 11 aa, Influenza virus
ARHIEEWSCYG

SEQ ID NO: 519606 - protein, 11 aa, Influenza virus
ARHVEECSCYG

SEQ ID NO: 519607 - protein, 11 aa, Influenza virus
ARIDARIDFES

SEQ ID NO: 519608 - protein, 11 aa, Influenza virus
ARIDARVDFES

SEQ ID NO: 519609 - protein, 11 aa, Influenza virus
ARIDARVDSES

SEQ ID NO: 519610 - protein, 11 aa, Influenza virus
ARIGEGQRSWM

SEQ ID NO: 519611 - protein, 11 aa, Influenza virus
ARIKTRLFTIR

SEQ ID NO: 519612 - protein, 11 aa, Influenza virus
ARLGKGYMFES

SEQ ID NO: 519613 - protein, 11 aa, Influenza virus
ARLGRGYMFES

SEQ ID NO: 519614 - protein, 11 aa, Influenza virus
ARLLVLLENDK

SEQ ID NO: 519615 - protein, 11 aa, Influenza virus
ARLLVLLENEK

SEQ ID NO: 519616 - protein, 11 aa, Influenza virus
ARLYIWGVHHP

SEQ ID NO: 519617 - protein, 11 aa, Influenza virus
ARNICEKLEQS

SEQ ID NO: 519618 - protein, 11 aa, Influenza virus
ARNILRTQDSE

SEQ ID NO: 519619 - protein, 11 aa, Influenza virus
ARNILRTQESE

SEQ ID NO: 519620 - protein, 11 aa, Influenza virus
ARNIVRRAAVS

SEQ ID NO: 519621 - protein, 11 aa, Influenza virus
ARNIVRRAIVS

SEQ ID NO: 519622 - protein, 11 aa, Influenza virus
ARNIVRRATVS

SEQ ID NO: 519623 - protein, 11 aa, Influenza virus
ARPKVNGQAGR

SEQ ID NO: 519624 - protein, 11 aa, Influenza virus
ARPLVNGQSGR

SEQ ID NO: 519625 - protein, 11 aa, Influenza virus
ARPQVNGQRGR

SEQ ID NO: 519626 - protein, 11 aa, Influenza virus
ARPQVNGQSGR

SEQ ID NO: 519627 - protein, 11 aa, Influenza virus
ARQEKNPALRM

SEQ ID NO: 519628 - protein, 11 aa, Influenza virus
ARRICEKLEQS

SEQ ID NO: 519629 - protein, 11 aa, Influenza virus
ARRIDFHWLFL

SEQ ID NO: 519630 - protein, 11 aa, Influenza virus
ARRIDFHWLLL

SEQ ID NO: 519631 - protein, 11 aa, Influenza virus
ARRIDFNWLLL

SEQ ID NO: 519632 - protein, 11 aa, Influenza virus
ARSALILRGAV

SEQ ID NO: 519633 - protein, 11 aa, Influenza virus
ARSALILRGSI

SEQ ID NO: 519634 - protein, 11 aa, Influenza virus
ARSALILRGSV

SEQ ID NO: 519635 - protein, 11 aa, Influenza virus
ARSICEKLEQS

SEQ ID NO: 519636 - protein, 11 aa, Influenza virus
ARSIVRRATVS

SEQ ID NO: 519637 - protein, 11 aa, Influenza virus
ARVWWTSNSIV

SEQ ID NO: 519638 - protein, 11 aa, Influenza virus
ASACHDGASWL

SEQ ID NO: 519639 - protein, 11 aa, Influenza virus
ASACHDGISWL

SEQ ID NO: 519640 - protein, 11 aa, Influenza virus
ASACHDGSSWL

SEQ ID NO: 519641 - protein, 11 aa, Influenza virus
ASACHDGTNWL

SEQ ID NO: 519642 - protein, 11 aa, Influenza virus
ASACHDGTSWL

SEQ ID NO: 519643 - protein, 11 aa, Influenza virus
ASALILRGSVA

SEQ ID NO: 519644 - protein, 11 aa, Influenza virus
ASCAAMDDFQL

SEQ ID NO: 519645 - protein, 11 aa, Influenza virus
ASCAAMDEFQL

SEQ ID NO: 519646 - protein, 11 aa, Influenza virus
ASCAAMEDFQL

SEQ ID NO: 519647 - protein, 11 aa, Influenza virus
ASCMGLIYNRM

SEQ ID NO: 519648 - protein, 11 aa, Influenza virus
ASCVMLLAIAM

SEQ ID NO: 519649 - protein, 11 aa, Influenza virus
ASDILKRMSKM

SEQ ID NO: 519650 - protein, 11 aa, Influenza virus
ASDILTRMSKM

SEQ ID NO: 519651 - protein, 11 aa, Influenza virus
ASGDIWITREP

SEQ ID NO: 519652 - protein, 11 aa, Influenza virus
ASGDIWVTREP

SEQ ID NO: 519653 - protein, 11 aa, Influenza virus
ASGDVWVTREP

SEQ ID NO: 519654 - protein, 11 aa, Influenza virus
ASGKADTRILF

SEQ ID NO: 519655 - protein, 11 aa, Influenza virus
ASGRADTKILF

SEQ ID NO: 519656 - protein, 11 aa, Influenza virus
ASGRADTRILF

SEQ ID NO: 519657 - protein, 11 aa, Influenza virus
ASGSSISFCGV

SEQ ID NO: 519658 - protein, 11 aa, Influenza virus
ASICTHLEVCF

SEQ ID NO: 519659 - protein, 11 aa, Influenza virus
ASIRNNTYDHN

SEQ ID NO: 519660 - protein, 11 aa, Influenza virus
ASIRNNTYDHS

SEQ ID NO: 519661 - protein, 11 aa, Influenza virus
ASIRNNTYDHT

SEQ ID NO: 519662 - protein, 11 aa, Influenza virus
ASIRNSTYDHS

SEQ ID NO: 519663 - protein, 11 aa, Influenza virus
ASKEPEVHEGE

SEQ ID NO: 519664 - protein, 11 aa, Influenza virus
ASKNPYTLVST

SEQ ID NO: 519665 - protein, 11 aa, Influenza virus
ASLCLAILIAG

SEQ ID NO: 519666 - protein, 11 aa, Influenza virus
ASLCLAILVAG

SEQ ID NO: 519667 - protein, 11 aa, Influenza virus
ASLCLAVLIAG

SEQ ID NO: 519668 - protein, 11 aa, Influenza virus
ASLLEMCHGTQ

SEQ ID NO: 519669 - protein, 11 aa, Influenza virus
ASLLEMCHSTQ

SEQ ID NO: 519670 - protein, 11 aa, Influenza virus
ASLLEMCHSTR

SEQ ID NO: 519671 - protein, 11 aa, Influenza virus
ASLRLAVGLRN

SEQ ID NO: 519672 - protein, 11 aa, Influenza virus
ASLSPGMMMGM

SEQ ID NO: 519673 - protein, 11 aa, Influenza virus
ASNINIREWSY

SEQ ID NO: 519674 - protein, 11 aa, Influenza virus
ASNQASYKIFK

SEQ ID NO: 519675 - protein, 11 aa, Influenza virus
ASNSIVTFCGL

SEQ ID NO: 519676 - protein, 11 aa, Influenza virus
ASNSLIALCGS

SEQ ID NO: 519677 - protein, 11 aa, Influenza virus
ASPQLEGFSAE

SEQ ID NO: 519678 - protein, 11 aa, Influenza virus
ASPSCLVVRKS

SEQ ID NO: 519679 - protein, 11 aa, Influenza virus
ASQGTKRPYEQ

SEQ ID NO: 519680 - protein, 11 aa, Influenza virus
ASQGTKRSHEQ

SEQ ID NO: 519681 - protein, 11 aa, Influenza virus
ASQGTKRSYEQ

SEQ ID NO: 519682 - protein, 11 aa, Influenza virus
ASQYGPSHSIH

SEQ ID NO: 519683 - protein, 11 aa, Influenza virus
ASRSGFEVLLI

SEQ ID NO: 519684 - protein, 11 aa, Influenza virus
ASRSGYEILKV

SEQ ID NO: 519685 - protein, 11 aa, Influenza virus
ASRSGYEMLKV

SEQ ID NO: 519686 - protein, 11 aa, Influenza virus
ASRSGYEVLRV

SEQ ID NO: 519687 - protein, 11 aa, Influenza virus
ASSGIAIALGI

SEQ ID NO: 519688 - protein, 11 aa, Influenza virus
ASSGIAIVLGI

SEQ ID NO: 519689 - protein, 11 aa, Influenza virus
ASSGSLEFIAE

SEQ ID NO: 519690 - protein, 11 aa, Influenza virus
ASSIVLVGLIL

SEQ ID NO: 519691 - protein, 11 aa, Influenza virus
ASSIVMVGLIL

SEQ ID NO: 519692 - protein, 11 aa, Influenza virus
ASSKSRARIKT

SEQ ID NO: 519693 - protein, 11 aa, Influenza virus
ASSLILAAIIM

SEQ ID NO: 519694 - protein, 11 aa, Influenza virus
ASSLILAALIM

SEQ ID NO: 519695 - protein, 11 aa, Influenza virus
ASSLVLAAIIM

SEQ ID NO: 519696 - protein, 11 aa, Influenza virus
ASSLVLAALIM

SEQ ID NO: 519697 - protein, 11 aa, Influenza virus
ASSLVLAALNM

SEQ ID NO: 519698 - protein, 11 aa, Influenza virus
ASSLVLIVSLG

SEQ ID NO: 519699 - protein, 11 aa, Influenza virus
ASSLVLLFMII

SEQ ID NO: 519700 - protein, 11 aa, Influenza virus
ASSLVLLLMII

SEQ ID NO: 519701 - protein, 11 aa, Influenza virus
ASSLVLLVSLG

SEQ ID NO: 519702 - protein, 11 aa, Influenza virus
ASSLVLVVSLG

SEQ ID NO: 519703 - protein, 11 aa, Influenza virus
ASSQLEGFSAE

SEQ ID NO: 519704 - protein, 11 aa, Influenza virus
ASSSVLLVSLG

SEQ ID NO: 519705 - protein, 11 aa, Influenza virus
ASSTVLVGLIL

SEQ ID NO: 519706 - protein, 11 aa, Influenza virus
ASSTVMVGLIL

SEQ ID NO: 519707 - protein, 11 aa, Influenza virus
ASSVVLVGLIL

SEQ ID NO: 519708 - protein, 11 aa, Influenza virus
ASSVVLVGPIL

SEQ ID NO: 519709 - protein, 11 aa, Influenza virus
ASTGAQSFYRS

SEQ ID NO: 519710 - protein, 11 aa, Influenza virus
ASTGGQAFYRS

SEQ ID NO: 519711 - protein, 11 aa, Influenza virus
ASTGGQSFYRS

SEQ ID NO: 519712 - protein, 11 aa, Influenza virus
ASTLVLLVSLG

SEQ ID NO: 519713 - protein, 11 aa, Influenza virus
ASTNAHDRICI

SEQ ID NO: 519714 - protein, 11 aa, Influenza virus
ASTNAYDRICI

SEQ ID NO: 519715 - protein, 11 aa, Influenza virus
ASTQKAIDEIT

SEQ ID NO: 519716 - protein, 11 aa, Influenza virus
ASTQKAINEIT

SEQ ID NO: 519717 - protein, 11 aa, Influenza virus
ASTTAKAMEQM

SEQ ID NO: 519718 - protein, 11 aa, Influenza virus
ASTTAKAMEQV

SEQ ID NO: 519719 - protein, 11 aa, Influenza virus
ASVPASRYLID

SEQ ID NO: 519720 - protein, 11 aa, Influenza virus
ASVPASRYLTD

SEQ ID NO: 519721 - protein, 11 aa, Influenza virus
ASWAGNILRTQ

SEQ ID NO: 519722 - protein, 11 aa, Influenza virus
ASYKRIRLFDY

SEQ ID NO: 519723 - protein, 11 aa, Influenza virus
ASYKRVRLFDY

SEQ ID NO: 519724 - protein, 11 aa, Influenza virus
ATACHDGKEWL

SEQ ID NO: 519725 - protein, 11 aa, Influenza virus
ATACHDGKEWM

SEQ ID NO: 519726 - protein, 11 aa, Influenza virus
ATACHDGKGWL

SEQ ID NO: 519727 - protein, 11 aa, Influenza virus
ATACHDGKKWI

SEQ ID NO: 519728 - protein, 11 aa, Influenza virus
ATACHDGKKWL

SEQ ID NO: 519729 - protein, 11 aa, Influenza virus
ATACHDGKKWM

SEQ ID NO: 519730 - protein, 11 aa, Influenza virus
ATACHDGKKWT

SEQ ID NO: 519731 - protein, 11 aa, Influenza virus
ATACHDGRKWM

SEQ ID NO: 519732 - protein, 11 aa, Influenza virus
ATACSDGPGWL

SEQ ID NO: 519733 - protein, 11 aa, Influenza virus
ATACSDGSGWL

SEQ ID NO: 519734 - protein, 11 aa, Influenza virus
ATALANTIEIF

SEQ ID NO: 519735 - protein, 11 aa, Influenza virus
ATALANTIEVF

SEQ ID NO: 519736 - protein, 11 aa, Influenza virus
ATAQMALQLFI

SEQ ID NO: 519737 - protein, 11 aa, Influenza virus
ATATVYYDRRL

SEQ ID NO: 519738 - protein, 11 aa, Influenza virus
ATATVYYERRL

SEQ ID NO: 519739 - protein, 11 aa, Influenza virus
ATATVYYNGRL

SEQ ID NO: 519740 - protein, 11 aa, Influenza virus
ATATVYYNKRL

SEQ ID NO: 519741 - protein, 11 aa, Influenza virus
ATATVYYNRRL

SEQ ID NO: 519742 - protein, 11 aa, Influenza virus
ATAVAVLKYNG

SEQ ID NO: 519743 - protein, 11 aa, Influenza virus
ATAVVVLKYNG

SEQ ID NO: 519744 - protein, 11 aa, Influenza virus
ATCEQIADAQH

SEQ ID NO: 519745 - protein, 11 aa, Influenza virus
ATCEQIADSHH

SEQ ID NO: 519746 - protein, 11 aa, Influenza virus
ATCEQIADSQH

SEQ ID NO: 519747 - protein, 11 aa, Influenza virus
ATCVCRDNWQG

SEQ ID NO: 519748 - protein, 11 aa, Influenza virus
ATETVEITGID

SEQ ID NO: 519749 - protein, 11 aa, Influenza virus
ATETVEITGIN

SEQ ID NO: 519750 - protein, 11 aa, Influenza virus
ATFLRSNAPSG

SEQ ID NO: 519751 - protein, 11 aa, Influenza virus
ATGFHFEECSC

SEQ ID NO: 519752 - protein, 11 aa, Influenza virus
ATGFHLEECSC

SEQ ID NO: 519753 - protein, 11 aa, Influenza virus
ATGLRNIPQIE

SEQ ID NO: 519754 - protein, 11 aa, Influenza virus
ATGLRNIPSIQ

SEQ ID NO: 519755 - protein, 11 aa, Influenza virus
ATGLRNIPSVQ

SEQ ID NO: 519756 - protein, 11 aa, Influenza virus
ATGLRNVPQIE

SEQ ID NO: 519757 - protein, 11 aa, Influenza virus
ATGLRNVPQME

SEQ ID NO: 519758 - protein, 11 aa, Influenza virus
ATGLRNVPSIQ

SEQ ID NO: 519759 - protein, 11 aa, Influenza virus
ATGMKNVPEIP

SEQ ID NO: 519760 - protein, 11 aa, Influenza virus
ATGMKNVPETP

SEQ ID NO: 519761 - protein, 11 aa, Influenza virus
ATGMRNIPEKP

SEQ ID NO: 519762 - protein, 11 aa, Influenza virus
ATGMRNIPEKQ

SEQ ID NO: 519763 - protein, 11 aa, Influenza virus
ATGMRNIPENP

SEQ ID NO: 519764 - protein, 11 aa, Influenza virus
ATGMRNIPERQ

SEQ ID NO: 519765 - protein, 11 aa, Influenza virus
ATGMRNIPGKQ

SEQ ID NO: 519766 - protein, 11 aa, Influenza virus
ATGMRNVPEKP

SEQ ID NO: 519767 - protein, 11 aa, Influenza virus
ATGMRNVPEKQ

SEQ ID NO: 519768 - protein, 11 aa, Influenza virus
ATGMRNVPENP

SEQ ID NO: 519769 - protein, 11 aa, Influenza virus
ATGMRNVPERQ

SEQ ID NO: 519770 - protein, 11 aa, Influenza virus
ATGMRNVPETQ

SEQ ID NO: 519771 - protein, 11 aa, Influenza virus
ATGPADTRIYY

SEQ ID NO: 519772 - protein, 11 aa, Influenza virus
ATGPADTRVYY

SEQ ID NO: 519773 - protein, 11 aa, Influenza virus
ATGPAETRIYY

SEQ ID NO: 519774 - protein, 11 aa, Influenza virus
ATGPAETRVYY

SEQ ID NO: 519775 - protein, 11 aa, Influenza virus
ATGPRNVPQIE

SEQ ID NO: 519776 - protein, 11 aa, Influenza virus
ATGRVTVSTRS

SEQ ID NO: 519777 - protein, 11 aa, Influenza virus
ATGYHFEECSC

SEQ ID NO: 519778 - protein, 11 aa, Influenza virus
ATIDQITGKLN

SEQ ID NO: 519779 - protein, 11 aa, Influenza virus
ATIGECPKYVK

SEQ ID NO: 519780 - protein, 11 aa, Influenza virus
ATINEEALRQK

SEQ ID NO: 519781 - protein, 11 aa, Influenza virus
ATIWTSGSSIS

SEQ ID NO: 519782 - protein, 11 aa, Influenza virus
ATKLYVNKNPY

SEQ ID NO: 519783 - protein, 11 aa, Influenza virus
ATKMEAILVVL

SEQ ID NO: 519784 - protein, 11 aa, Influenza virus
ATKMKAIIVVL

SEQ ID NO: 519785 - protein, 11 aa, Influenza virus
ATKMKAILVVL

SEQ ID NO: 519786 - protein, 11 aa, Influenza virus
ATLCLGHHAVA

SEQ ID NO: 519787 - protein, 11 aa, Influenza virus
ATLCLGHHAVP

SEQ ID NO: 519788 - protein, 11 aa, Influenza virus
ATLCLGHHAVQ

SEQ ID NO: 519789 - protein, 11 aa, Influenza virus
ATLCLGHHAVS

SEQ ID NO: 519790 - protein, 11 aa, Influenza virus
ATNGNYGPINV

SEQ ID NO: 519791 - protein, 11 aa, Influenza virus
ATNINIREWSY

SEQ ID NO: 519792 - protein, 11 aa, Influenza virus
ATNLYVNKNPY

SEQ ID NO: 519793 - protein, 11 aa, Influenza virus
ATPGMQIRGFV

SEQ ID NO: 519794 - protein, 11 aa, Influenza virus
ATQGTKRSYEQ

SEQ ID NO: 519795 - protein, 11 aa, Influenza virus
ATREGKHIVER

SEQ ID NO: 519796 - protein, 11 aa, Influenza virus
ATRGVQIASNE

SEQ ID NO: 519797 - protein, 11 aa, Influenza virus
ATRLYVNKNPY

SEQ ID NO: 519798 - protein, 11 aa, Influenza virus
ATSACKRTVSS

SEQ ID NO: 519799 - protein, 11 aa, Influenza virus
ATTHSWIPKRN

SEQ ID NO: 519800 - protein, 11 aa, Influenza virus
ATTHSWTPKRN

SEQ ID NO: 519801 - protein, 11 aa, Influenza virus
ATTHSWVPILN

SEQ ID NO: 519802 - protein, 11 aa, Influenza virus
ATTHSWVPKRN

SEQ ID NO: 519803 - protein, 11 aa, Influenza virus
ATTITLHFKQN

SEQ ID NO: 519804 - protein, 11 aa, Influenza virus
ATTNPLIKHEN

SEQ ID NO: 519805 - protein, 11 aa, Influenza virus
ATTNPLIRHEN

SEQ ID NO: 519806 - protein, 11 aa, Influenza virus
ATTVTLHFKQH

SEQ ID NO: 519807 - protein, 11 aa, Influenza virus
ATTVTLHFKQN

SEQ ID NO: 519808 - protein, 11 aa, Influenza virus
ATVAGSLSLAI

SEQ ID NO: 519809 - protein, 11 aa, Influenza virus
ATVNEEALRQK

SEQ ID NO: 519810 - protein, 11 aa, Influenza virus
ATVNEGALRQK

SEQ ID NO: 519811 - protein, 11 aa, Influenza virus
ATVSADPLASL

SEQ ID NO: 519812 - protein, 11 aa, Influenza virus
ATVSADPLLSL

SEQ ID NO: 519813 - protein, 11 aa, Influenza virus
ATVSADPLVSL

SEQ ID NO: 519814 - protein, 11 aa, Influenza virus
ATVYYDRRLTT

SEQ ID NO: 519815 - protein, 11 aa, Influenza virus
ATVYYERRLTT

SEQ ID NO: 519816 - protein, 11 aa, Influenza virus
ATVYYNGRLTT

SEQ ID NO: 519817 - protein, 11 aa, Influenza virus
ATVYYNKRLTT

SEQ ID NO: 519818 - protein, 11 aa, Influenza virus
ATVYYNRRLTT

SEQ ID NO: 519819 - protein, 11 aa, Influenza virus
ATYQRTRALVR

SEQ ID NO: 519820 - protein, 11 aa, Influenza virus
AVAKDNAIRFG

SEQ ID NO: 519821 - protein, 11 aa, Influenza virus
AVANGTKVNTL

SEQ ID NO: 519822 - protein, 11 aa, Influenza virus
AVATTHSWIPK

SEQ ID NO: 519823 - protein, 11 aa, Influenza virus
AVATTHSWTPK

SEQ ID NO: 519824 - protein, 11 aa, Influenza virus
AVATTHSWVPI

SEQ ID NO: 519825 - protein, 11 aa, Influenza virus
AVATTHSWVPK

SEQ ID NO: 519826 - protein, 11 aa, Influenza virus
AVAVIKYNGII

SEQ ID NO: 519827 - protein, 11 aa, Influenza virus
AVAVLKYKGII

SEQ ID NO: 519828 - protein, 11 aa, Influenza virus
AVAVLKYNDII

SEQ ID NO: 519829 - protein, 11 aa, Influenza virus
AVAVLKYNGII

SEQ ID NO: 519830 - protein, 11 aa, Influenza virus
AVAVLKYNGVI

SEQ ID NO: 519831 - protein, 11 aa, Influenza virus
AVAWSATACHD

SEQ ID NO: 519832 - protein, 11 aa, Influenza virus
AVDEGNGCFEL

SEQ ID NO: 519833 - protein, 11 aa, Influenza virus
AVDGTIAGFIE

SEQ ID NO: 519834 - protein, 11 aa, Influenza virus
AVDLGSCGILG

SEQ ID NO: 519835 - protein, 11 aa, Influenza virus
AVDQITGKLNR

SEQ ID NO: 519836 - protein, 11 aa, Influenza virus
AVDTCYPFDVP

SEQ ID NO: 519837 - protein, 11 aa, Influenza virus
AVDTGDGCFEI

SEQ ID NO: 519838 - protein, 11 aa, Influenza virus
AVDTGNGCFDI

SEQ ID NO: 519839 - protein, 11 aa, Influenza virus
AVEECLINDPW

SEQ ID NO: 519840 - protein, 11 aa, Influenza virus
AVENGTSVKTL

SEQ ID NO: 519841 - protein, 11 aa, Influenza virus
AVENQHTIDLT

SEQ ID NO: 519842 - protein, 11 aa, Influenza virus
AVENQHTIDST

SEQ ID NO: 519843 - protein, 11 aa, Influenza virus
AVFCGTSGTYG

SEQ ID NO: 519844 - protein, 11 aa, Influenza virus
AVGGSGTDNYG

SEQ ID NO: 519845 - protein, 11 aa, Influenza virus
AVGGSGTNNYG

SEQ ID NO: 519846 - protein, 11 aa, Influenza virus
AVGKCPKYVKQ

SEQ ID NO: 519847 - protein, 11 aa, Influenza virus
AVGKCPRYVKQ

SEQ ID NO: 519848 - protein, 11 aa, Influenza virus
AVGLRNTPSID

SEQ ID NO: 519849 - protein, 11 aa, Influenza virus
AVGLRNTPSIE

SEQ ID NO: 519850 - protein, 11 aa, Influenza virus
AVGLRNTPSVE

SEQ ID NO: 519851 - protein, 11 aa, Influenza virus
AVGRCPRYVKQ

SEQ ID NO: 519852 - protein, 11 aa, Influenza virus
AVGRSGTNNYG

SEQ ID NO: 519853 - protein, 11 aa, Influenza virus
AVIHYGGIPTD

SEQ ID NO: 519854 - protein, 11 aa, Influenza virus
AVIHYGGMPTD

SEQ ID NO: 519855 - protein, 11 aa, Influenza virus
AVIHYGGVPTD

SEQ ID NO: 519856 - protein, 11 aa, Influenza virus
AVIKNNMINND

SEQ ID NO: 519857 - protein, 11 aa, Influenza virus
AVIKYNGIITD

SEQ ID NO: 519858 - protein, 11 aa, Influenza virus
AVIYGNPKCDI

SEQ ID NO: 519859 - protein, 11 aa, Influenza virus
AVIYGNPKCDT

SEQ ID NO: 519860 - protein, 11 aa, Influenza virus
AVIYGNPKCDV

SEQ ID NO: 519861 - protein, 11 aa, Influenza virus
AVKLYKKLKRE

SEQ ID NO: 519862 - protein, 11 aa, Influenza virus
AVKLYRKLKRE

SEQ ID NO: 519863 - protein, 11 aa, Influenza virus
AVKQNGKSGAC

SEQ ID NO: 519864 - protein, 11 aa, Influenza virus
AVLIAGGLILG

SEQ ID NO: 519865 - protein, 11 aa, Influenza virus
AVLKPGQTVKI

SEQ ID NO: 519866 - protein, 11 aa, Influenza virus
AVLKYKGIITG

SEQ ID NO: 519867 - protein, 11 aa, Influenza virus
AVLKYNDIITD

SEQ ID NO: 519868 - protein, 11 aa, Influenza virus
AVLKYNGIITD

SEQ ID NO: 519869 - protein, 11 aa, Influenza virus
AVLKYNGIITE

SEQ ID NO: 519870 - protein, 11 aa, Influenza virus
AVLKYNGIITG

SEQ ID NO: 519871 - protein, 11 aa, Influenza virus
AVLKYNGVITD

SEQ ID NO: 519872 - protein, 11 aa, Influenza virus
AVLRGFLIIGK

SEQ ID NO: 519873 - protein, 11 aa, Influenza virus
AVLRGFLILGK

SEQ ID NO: 519874 - protein, 11 aa, Influenza virus
AVLRGFLILGR

SEQ ID NO: 519875 - protein, 11 aa, Influenza virus
AVNQITGKLNR

SEQ ID NO: 519876 - protein, 11 aa, Influenza virus
AVNSSKPFQNA

SEQ ID NO: 519877 - protein, 11 aa, Influenza virus
AVNSSMPFHNI

SEQ ID NO: 519878 - protein, 11 aa, Influenza virus
AVNSWHILSKD

SEQ ID NO: 519879 - protein, 11 aa, Influenza virus
AVNTTLSTIAL

SEQ ID NO: 519880 - protein, 11 aa, Influenza virus
AVPNGTIVKTI

SEQ ID NO: 519881 - protein, 11 aa, Influenza virus
AVPNGTIVRTI

SEQ ID NO: 519882 - protein, 11 aa, Influenza virus
AVPNGTKVNTL

SEQ ID NO: 519883 - protein, 11 aa, Influenza virus
AVPNGTLVKTI

SEQ ID NO: 519884 - protein, 11 aa, Influenza virus
AVPNGTMVKTI

SEQ ID NO: 519885 - protein, 11 aa, Influenza virus
AVPNGTVVKTI

SEQ ID NO: 519886 - protein, 11 aa, Influenza virus
AVRFGESEQII

SEQ ID NO: 519887 - protein, 11 aa, Influenza virus
AVRGDLNFVNR

SEQ ID NO: 519888 - protein, 11 aa, Influenza virus
AVSFWMCSNGS

SEQ ID NO: 519889 - protein, 11 aa, Influenza virus
AVSNGTKINTL

SEQ ID NO: 519890 - protein, 11 aa, Influenza virus
AVSNGTKVNTL

SEQ ID NO: 519891 - protein, 11 aa, Influenza virus
AVTDGPAANNA

SEQ ID NO: 519892 - protein, 11 aa, Influenza virus
AVTDGPAANSA

SEQ ID NO: 519893 - protein, 11 aa, Influenza virus
AVTDGPADNKA

SEQ ID NO: 519894 - protein, 11 aa, Influenza virus
AVTDIWSYNAK

SEQ ID NO: 519895 - protein, 11 aa, Influenza virus
AVTDIWSYNAR

SEQ ID NO: 519896 - protein, 11 aa, Influenza virus
AVTDVWSYNAK

SEQ ID NO: 519897 - protein, 11 aa, Influenza virus
AVVMTDGSASG

SEQ ID NO: 519898 - protein, 11 aa, Influenza virus
AWLHICVTGDD

SEQ ID NO: 519899 - protein, 11 aa, Influenza virus
AWLHVCITGDD

SEQ ID NO: 519900 - protein, 11 aa, Influenza virus
AWLHVCVTGDD

SEQ ID NO: 519901 - protein, 11 aa, Influenza virus
AWLHVCVTGHD

SEQ ID NO: 519902 - protein, 11 aa, Influenza virus
AWLHVCVTGYE

SEQ ID NO: 519903 - protein, 11 aa, Influenza virus
AWSASACHDGI

SEQ ID NO: 519904 - protein, 11 aa, Influenza virus
AWSASACHDGL

SEQ ID NO: 519905 - protein, 11 aa, Influenza virus
AWSASACHDGM

SEQ ID NO: 519906 - protein, 11 aa, Influenza virus
AWSASACHDGS

SEQ ID NO: 519907 - protein, 11 aa, Influenza virus
AWSASACHDGT

SEQ ID NO: 519908 - protein, 11 aa, Influenza virus
AWSASACHDGV

SEQ ID NO: 519909 - protein, 11 aa, Influenza virus
AWSATACHDGK

SEQ ID NO: 519910 - protein, 11 aa, Influenza virus
AWSATACHDGR

SEQ ID NO: 519911 - protein, 11 aa, Influenza virus
AWSATACSDGP

SEQ ID NO: 519912 - protein, 11 aa, Influenza virus
AWSATACSDGS

SEQ ID NO: 519913 - protein, 11 aa, Influenza virus
AWSRSSCHDGK

SEQ ID NO: 519914 - protein, 11 aa, Influenza virus
AWSSASCHDGR

SEQ ID NO: 519915 - protein, 11 aa, Influenza virus
AWSSSSCFDGK

SEQ ID NO: 519916 - protein, 11 aa, Influenza virus
AWSSSSCFDGR

SEQ ID NO: 519917 - protein, 11 aa, Influenza virus
AWSSSSCHDGK

SEQ ID NO: 519918 - protein, 11 aa, Influenza virus
AWSSSSCHDGN

SEQ ID NO: 519919 - protein, 11 aa, Influenza virus
AWSSSSCHDGR

SEQ ID NO: 519920 - protein, 11 aa, Influenza virus
AWSSSSCYDGK

SEQ ID NO: 519921 - protein, 11 aa, Influenza virus
AWSSTSCFDGK

SEQ ID NO: 519922 - protein, 11 aa, Influenza virus
AWSYIVERPSA

SEQ ID NO: 519923 - protein, 11 aa, Influenza virus
AYAVIHYGGIP

SEQ ID NO: 519924 - protein, 11 aa, Influenza virus
AYAVIHYGGMP

SEQ ID NO: 519925 - protein, 11 aa, Influenza virus
AYAVIHYGGVP

SEQ ID NO: 519926 - protein, 11 aa, Influenza virus
AYCNTDLGAPL

SEQ ID NO: 519927 - protein, 11 aa, Influenza virus
AYCNTDLGSPL

SEQ ID NO: 519928 - protein, 11 aa, Influenza virus
AYCNTDLGTPL

SEQ ID NO: 519929 - protein, 11 aa, Influenza virus
AYCYPGATVNE

SEQ ID NO: 519930 - protein, 11 aa, Influenza virus
AYCYPGSTVNE

SEQ ID NO: 519931 - protein, 11 aa, Influenza virus
AYCYPGTTVNE

SEQ ID NO: 519932 - protein, 11 aa, Influenza virus
AYDKICIGYQT

SEQ ID NO: 519933 - protein, 11 aa, Influenza virus
AYDRICIGYQS

SEQ ID NO: 519934 - protein, 11 aa, Influenza virus
AYERMCNILKG

SEQ ID NO: 519935 - protein, 11 aa, Influenza virus
AYKILTIYSTV

SEQ ID NO: 519936 - protein, 11 aa, Influenza virus
AYMLERELVRK

SEQ ID NO: 519937 - protein, 11 aa, Influenza virus
AYNAELIVLLE

SEQ ID NO: 519938 - protein, 11 aa, Influenza virus
AYNAELLVLIE

SEQ ID NO: 519939 - protein, 11 aa, Influenza virus
AYNAELLVLLE

SEQ ID NO: 519940 - protein, 11 aa, Influenza virus
AYNAELLVLLG

SEQ ID NO: 519941 - protein, 11 aa, Influenza virus
AYNNTTGRDVL

SEQ ID NO: 519942 - protein, 11 aa, Influenza virus
AYQILAIYATV

SEQ ID NO: 519943 - protein, 11 aa, Influenza virus
AYQKQMTRGLF

SEQ ID NO: 519944 - protein, 11 aa, Influenza virus
AYQKRMTRGLF

SEQ ID NO: 519945 - protein, 11 aa, Influenza virus
AYRKRMTRGLF

SEQ ID NO: 519946 - protein, 11 aa, Influenza virus
AYSQITNGTTG

SEQ ID NO: 519947 - protein, 11 aa, Influenza virus
AYTKILYFHKG

SEQ ID NO: 519948 - protein, 11 aa, Influenza virus
AYTKIMYFHKG

SEQ ID NO: 519949 - protein, 11 aa, Influenza virus
AYTKVLYFHKG

SEQ ID NO: 519950 - protein, 11 aa, Influenza virus
AYTKVMYFHKG

SEQ ID NO: 519951 - protein, 11 aa, Influenza virus
AYWWDGLQSSD

SEQ ID NO: 519952 - protein, 11 aa, Influenza virus
CAAMDDFQLIP

SEQ ID NO: 519953 - protein, 11 aa, Influenza virus
CAAMDDYQLIP

SEQ ID NO: 519954 - protein, 11 aa, Influenza virus
CAAMDEFQLIP

SEQ ID NO: 519955 - protein, 11 aa, Influenza virus
CAAMEDFQLIP

SEQ ID NO: 519956 - protein, 11 aa, Influenza virus
CAAWSSSSCFD

SEQ ID NO: 519957 - protein, 11 aa, Influenza virus
CAAWSSSSCHD

SEQ ID NO: 519958 - protein, 11 aa, Influenza virus
CAGIPSDTPRG

SEQ ID NO: 519959 - protein, 11 aa, Influenza virus
CAGIPTDTPRG

SEQ ID NO: 519960 - protein, 11 aa, Influenza virus
CAGIPTDTPRI

SEQ ID NO: 519961 - protein, 11 aa, Influenza virus
CAGIPTDTPRV

SEQ ID NO: 519962 - protein, 11 aa, Influenza virus
CAGLPSDTPRG

SEQ ID NO: 519963 - protein, 11 aa, Influenza virus
CASNINIREWS

SEQ ID NO: 519964 - protein, 11 aa, Influenza virus
CATCEQIADAQ

SEQ ID NO: 519965 - protein, 11 aa, Influenza virus
CATCEQIADSH

SEQ ID NO: 519966 - protein, 11 aa, Influenza virus
CATCEQIADSQ

SEQ ID NO: 519967 - protein, 11 aa, Influenza virus
CATNINIREWS

SEQ ID NO: 519968 - protein, 11 aa, Influenza virus
CAVATTHSWVP

SEQ ID NO: 519969 - protein, 11 aa, Influenza virus
CAVNSWHILSK

SEQ ID NO: 519970 - protein, 11 aa, Influenza virus
CAVVMTDGNAS

SEQ ID NO: 519971 - protein, 11 aa, Influenza virus
CAVVMTDGSAS

SEQ ID NO: 519972 - protein, 11 aa, Influenza virus
CCNLFEKFFPS

SEQ ID NO: 519973 - protein, 11 aa, Influenza virus
CCSLFEKFFPS

SEQ ID NO: 519974 - protein, 11 aa, Influenza virus
CCTLFEKFFPS

SEQ ID NO: 519975 - protein, 11 aa, Influenza virus
CDAPFDDRLRR

SEQ ID NO: 519976 - protein, 11 aa, Influenza virus
CDDDCMASIRN

SEQ ID NO: 519977 - protein, 11 aa, Influenza virus
CDDHCMESIRN

SEQ ID NO: 519978 - protein, 11 aa, Influenza virus
CDDLIGKNSWS

SEQ ID NO: 519979 - protein, 11 aa, Influenza virus
CDDLIGKTSWS

SEQ ID NO: 519980 - protein, 11 aa, Influenza virus
CDDQCMESIRN

SEQ ID NO: 519981 - protein, 11 aa, Influenza virus
CDELIGKTSWS

SEQ ID NO: 519982 - protein, 11 aa, Influenza virus
CDHSDNADKIC

SEQ ID NO: 519983 - protein, 11 aa, Influenza virus
CDIINGALGSP

SEQ ID NO: 519984 - protein, 11 aa, Influenza virus
CDIVNAALGSP

SEQ ID NO: 519985 - protein, 11 aa, Influenza virus
CDIVNGALGSP

SEQ ID NO: 519986 - protein, 11 aa, Influenza virus
CDIVNSALGSP

SEQ ID NO: 519987 - protein, 11 aa, Influenza virus
CDLHLEFKADL

SEQ ID NO: 519988 - protein, 11 aa, Influenza virus
CDLHLTGIWDT

SEQ ID NO: 519989 - protein, 11 aa, Influenza virus
CDLHLTGMWDT

SEQ ID NO: 519990 - protein, 11 aa, Influenza virus
CDLHLTGTWDT

SEQ ID NO: 519991 - protein, 11 aa, Influenza virus
CDLINGALGSP

SEQ ID NO: 519992 - protein, 11 aa, Influenza virus
CDLYLNGREWS

SEQ ID NO: 519993 - protein, 11 aa, Influenza virus
CDLYLSGREWS

SEQ ID NO: 519994 - protein, 11 aa, Influenza virus
CDLYLTGTWDT

SEQ ID NO: 519995 - protein, 11 aa, Influenza virus
CDNECMETIKN

SEQ ID NO: 519996 - protein, 11 aa, Influenza virus
CDNKCIESIRN

SEQ ID NO: 519997 - protein, 11 aa, Influenza virus
CDNKCMETIKN

SEQ ID NO: 519998 - protein, 11 aa, Influenza virus
CDNLIGKTSWS

SEQ ID NO: 519999 - protein, 11 aa, Influenza virus
CDNNCIESIRN

SEQ ID NO: 520000 - protein, 11 aa, Influenza virus
CDNQCMESIRN

SEQ ID NO: 520001 - protein, 11 aa, Influenza virus
CDNSCIESIRN

SEQ ID NO: 520002 - protein, 11 aa, Influenza virus
CDNTCIESIRN

SEQ ID NO: 520003 - protein, 11 aa, Influenza virus
CDPDECRFYAL

SEQ ID NO: 520004 - protein, 11 aa, Influenza virus
CDPDGCRFYAL

SEQ ID NO: 520005 - protein, 11 aa, Influenza virus
CDPHLTGTWDT

SEQ ID NO: 520006 - protein, 11 aa, Influenza virus
CDPLGCKMYAL

SEQ ID NO: 520007 - protein, 11 aa, Influenza virus
CDPLGCKTYAL

SEQ ID NO: 520008 - protein, 11 aa, Influenza virus
CDPLGCRMYAL

SEQ ID NO: 520009 - protein, 11 aa, Influenza virus
CDPNECRFYAL

SEQ ID NO: 520010 - protein, 11 aa, Influenza virus
CDPSGCKMYAL

SEQ ID NO: 520011 - protein, 11 aa, Influenza virus
CDPTGCKMYAL

SEQ ID NO: 520012 - protein, 11 aa, Influenza virus
CDPYLNGREWS

SEQ ID NO: 520013 - protein, 11 aa, Influenza virus
CDRLQDTTWDV

SEQ ID NO: 520014 - protein, 11 aa, Influenza virus
CDSHLKFKADL

SEQ ID NO: 520015 - protein, 11 aa, Influenza virus
CDTKCQTPLGA

SEQ ID NO: 520016 - protein, 11 aa, Influenza virus
CDYLIGKTSWS

SEQ ID NO: 520017 - protein, 11 aa, Influenza virus
CEGECFYSGGT

SEQ ID NO: 520018 - protein, 11 aa, Influenza virus
CEKLEQSGLPV

SEQ ID NO: 520019 - protein, 11 aa, Influenza virus
CEPDECRFYAL

SEQ ID NO: 520020 - protein, 11 aa, Influenza virus
CEQIADAQHRS

SEQ ID NO: 520021 - protein, 11 aa, Influenza virus
CEQIADSHHRS

SEQ ID NO: 520022 - protein, 11 aa, Influenza virus
CEQIADSQHKS

SEQ ID NO: 520023 - protein, 11 aa, Influenza virus
CEQIADSQHRS

SEQ ID NO: 520024 - protein, 11 aa, Influenza virus
CESKCFWKGGS

SEQ ID NO: 520025 - protein, 11 aa, Influenza virus
CESKCFWKGGT

SEQ ID NO: 520026 - protein, 11 aa, Influenza virus
CESKCFWRGGS

SEQ ID NO: 520027 - protein, 11 aa, Influenza virus
CETKCQSPLGA

SEQ ID NO: 520028 - protein, 11 aa, Influenza virus
CETKCQTPLGA

SEQ ID NO: 520029 - protein, 11 aa, Influenza virus
CETQCQTPLGA

SEQ ID NO: 520030 - protein, 11 aa, Influenza virus
CETRCQTPLGA

SEQ ID NO: 520031 - protein, 11 aa, Influenza virus
CEVNSWHIFSK

SEQ ID NO: 520032 - protein, 11 aa, Influenza virus
CEVNSWHILSK

SEQ ID NO: 520033 - protein, 11 aa, Influenza virus
CEVSSWHILSK

SEQ ID NO: 520034 - protein, 11 aa, Influenza virus
CFDGKEWLHVC

SEQ ID NO: 520035 - protein, 11 aa, Influenza virus
CFDGKEWMHIC

SEQ ID NO: 520036 - protein, 11 aa, Influenza virus
CFDGKEWMHVC

SEQ ID NO: 520037 - protein, 11 aa, Influenza virus
CFDGKEWMHVS

SEQ ID NO: 520038 - protein, 11 aa, Influenza virus
CFDGREWMHVC

SEQ ID NO: 520039 - protein, 11 aa, Influenza virus
CFDILHKCDNE

SEQ ID NO: 520040 - protein, 11 aa, Influenza virus
CFDILHKCDNK

SEQ ID NO: 520041 - protein, 11 aa, Influenza virus
CFDILHKCNNE

SEQ ID NO: 520042 - protein, 11 aa, Influenza virus
CFEFWHKCDDE

SEQ ID NO: 520043 - protein, 11 aa, Influenza virus
CFEFWHKCDND

SEQ ID NO: 520044 - protein, 11 aa, Influenza virus
CFEFWHKCDNE

SEQ ID NO: 520045 - protein, 11 aa, Influenza virus
CFEFWHKCNNE

SEQ ID NO: 520046 - protein, 11 aa, Influenza virus
CFEFYHKCDDE

SEQ ID NO: 520047 - protein, 11 aa, Influenza virus
CFEFYHKCDNE

SEQ ID NO: 520048 - protein, 11 aa, Influenza virus
CFEFYHKCNDE

SEQ ID NO: 520049 - protein, 11 aa, Influenza virus
CFEIFHKCDDD

SEQ ID NO: 520050 - protein, 11 aa, Influenza virus
CFEIFHKCDDH

SEQ ID NO: 520051 - protein, 11 aa, Influenza virus
CFEIFHKCDDN

SEQ ID NO: 520052 - protein, 11 aa, Influenza virus
CFEIFHKCDDQ

SEQ ID NO: 520053 - protein, 11 aa, Influenza virus
CFEIFHKCDNQ

SEQ ID NO: 520054 - protein, 11 aa, Influenza virus
CFEIFHQCDND

SEQ ID NO: 520055 - protein, 11 aa, Influenza virus
CFEIFHQCDNN

SEQ ID NO: 520056 - protein, 11 aa, Influenza virus
CFEIFHRCDDQ

SEQ ID NO: 520057 - protein, 11 aa, Influenza virus
CFELFHKCDDD

SEQ ID NO: 520058 - protein, 11 aa, Influenza virus
CFELLHKCNDS

SEQ ID NO: 520059 - protein, 11 aa, Influenza virus
CFELLHKCNNS

SEQ ID NO: 520060 - protein, 11 aa, Influenza virus
CFELLHKCNNT

SEQ ID NO: 520061 - protein, 11 aa, Influenza virus
CFLWHVRKRFA

SEQ ID NO: 520062 - protein, 11 aa, Influenza virus
CFMYSDFHFID

SEQ ID NO: 520063 - protein, 11 aa, Influenza virus
CFMYSDFHFIN

SEQ ID NO: 520064 - protein, 11 aa, Influenza virus
CFNFFHKCNDS

SEQ ID NO: 520065 - protein, 11 aa, Influenza virus
CFNGSLQCRIC

SEQ ID NO: 520066 - protein, 11 aa, Influenza virus
CFNLLHKCNDS

SEQ ID NO: 520067 - protein, 11 aa, Influenza virus
CFNPCFYVELI

SEQ ID NO: 520068 - protein, 11 aa, Influenza virus
CFNPMIAELAE

SEQ ID NO: 520069 - protein, 11 aa, Influenza virus
CFNPMIIELAE

SEQ ID NO: 520070 - protein, 11 aa, Influenza virus
CFNPMIVELAE

SEQ ID NO: 520071 - protein, 11 aa, Influenza virus
CFNPMTVELAE

SEQ ID NO: 520072 - protein, 11 aa, Influenza virus
CFNPMVVELAE

SEQ ID NO: 520073 - protein, 11 aa, Influenza virus
CFPGELDNNGE

SEQ ID NO: 520074 - protein, 11 aa, Influenza virus
CFPGEVDNNGE

SEQ ID NO: 520075 - protein, 11 aa, Influenza virus
CFQPCFYIELI

SEQ ID NO: 520076 - protein, 11 aa, Influenza virus
CFQPCFYVELI

SEQ ID NO: 520077 - protein, 11 aa, Influenza virus
CFQPCFYVELT

SEQ ID NO: 520078 - protein, 11 aa, Influenza virus
CFQRSKFLLMD

SEQ ID NO: 520079 - protein, 11 aa, Influenza virus
CFQSCFYVELI

SEQ ID NO: 520080 - protein, 11 aa, Influenza virus
CFSILHKCNDS

SEQ ID NO: 520081 - protein, 11 aa, Influenza virus
CFSLLHKCNDS

SEQ ID NO: 520082 - protein, 11 aa, Influenza virus
CFVFVALILGF

SEQ ID NO: 520083 - protein, 11 aa, Influenza virus
CFWIELIRGRP

SEQ ID NO: 520084 - protein, 11 aa, Influenza virus
CFWKGGSIKTK

SEQ ID NO: 520085 - protein, 11 aa, Influenza virus
CFWKGGSINTK

SEQ ID NO: 520086 - protein, 11 aa, Influenza virus
CFWLEMIRGKP

SEQ ID NO: 520087 - protein, 11 aa, Influenza virus
CFWLEMIRGRP

SEQ ID NO: 520088 - protein, 11 aa, Influenza virus
CFWMCSNGSLQ

SEQ ID NO: 520089 - protein, 11 aa, Influenza virus
CFWRGGSINTK

SEQ ID NO: 520090 - protein, 11 aa, Influenza virus
CFWRGGSINTR

SEQ ID NO: 520091 - protein, 11 aa, Influenza virus
CFWVELIRGQP

SEQ ID NO: 520092 - protein, 11 aa, Influenza virus
CFWVELIRGRP

SEQ ID NO: 520093 - protein, 11 aa, Influenza virus
CFWVELVRGLP

SEQ ID NO: 520094 - protein, 11 aa, Influenza virus
CFWVELVRGRP

SEQ ID NO: 520095 - protein, 11 aa, Influenza virus
CFWVEMIRGEP

SEQ ID NO: 520096 - protein, 11 aa, Influenza virus
CFWVEMIRGKP

SEQ ID NO: 520097 - protein, 11 aa, Influenza virus
CFWVEMIRGQP

SEQ ID NO: 520098 - protein, 11 aa, Influenza virus
CFWVEMIRGRP

SEQ ID NO: 520099 - protein, 11 aa, Influenza virus
CFWVMTDGPAN

SEQ ID NO: 520100 - protein, 11 aa, Influenza virus
CFYIELIRGKP

SEQ ID NO: 520101 - protein, 11 aa, Influenza virus
CFYIELIRGRP

SEQ ID NO: 520102 - protein, 11 aa, Influenza virus
CFYLELIRGRP

SEQ ID NO: 520103 - protein, 11 aa, Influenza virus
CFYSGGTINSP

SEQ ID NO: 520104 - protein, 11 aa, Influenza virus
CFYVELIRGKP

SEQ ID NO: 520105 - protein, 11 aa, Influenza virus
CFYVELIRGMP

SEQ ID NO: 520106 - protein, 11 aa, Influenza virus
CFYVELIRGRE

SEQ ID NO: 520107 - protein, 11 aa, Influenza virus
CFYVELIRGRK

SEQ ID NO: 520108 - protein, 11 aa, Influenza virus
CFYVELIRGRL

SEQ ID NO: 520109 - protein, 11 aa, Influenza virus
CFYVELIRGRN

SEQ ID NO: 520110 - protein, 11 aa, Influenza virus
CFYVELIRGRP

SEQ ID NO: 520111 - protein, 11 aa, Influenza virus
CFYVELIRGRQ

SEQ ID NO: 520112 - protein, 11 aa, Influenza virus
CFYVELIRGRR

SEQ ID NO: 520113 - protein, 11 aa, Influenza virus
CFYVELIRGRS

SEQ ID NO: 520114 - protein, 11 aa, Influenza virus
CFYVELTRGRP

SEQ ID NO: 520115 - protein, 11 aa, Influenza virus
CFYVELVRGRP

SEQ ID NO: 520116 - protein, 11 aa, Influenza virus
CGCRDNWQGAN

SEQ ID NO: 520117 - protein, 11 aa, Influenza virus
CGILGILTGPP

SEQ ID NO: 520118 - protein, 11 aa, Influenza virus
CGILGTIIGPP

SEQ ID NO: 520119 - protein, 11 aa, Influenza virus
CGLDNEPGSGH

SEQ ID NO: 520120 - protein, 11 aa, Influenza virus
CGLDNEPGSGN

SEQ ID NO: 520121 - protein, 11 aa, Influenza virus
CGLLGIITGPP

SEQ ID NO: 520122 - protein, 11 aa, Influenza virus
CGLLGILIGPP

SEQ ID NO: 520123 - protein, 11 aa, Influenza virus
CGLLGTITGPP

SEQ ID NO: 520124 - protein, 11 aa, Influenza virus
CGLLGTLIGPP

SEQ ID NO: 520125 - protein, 11 aa, Influenza virus
CGLLGTLTGPP

SEQ ID NO: 520126 - protein, 11 aa, Influenza virus
CGLLGTVTGPP

SEQ ID NO: 520127 - protein, 11 aa, Influenza virus
CGLNNEPGSGN

SEQ ID NO: 520128 - protein, 11 aa, Influenza virus
CGMIDGWYGFH

SEQ ID NO: 520129 - protein, 11 aa, Influenza virus
CGNGSCRCTIC

SEQ ID NO: 520130 - protein, 11 aa, Influenza virus
CGNNCIESIRN

SEQ ID NO: 520131 - protein, 11 aa, Influenza virus
CGPAECRTFFL

SEQ ID NO: 520132 - protein, 11 aa, Influenza virus
CGPSECRTFFL

SEQ ID NO: 520133 - protein, 11 aa, Influenza virus
CGPTECRTFFL

SEQ ID NO: 520134 - protein, 11 aa, Influenza virus
CGSKEQLGSWS

SEQ ID NO: 520135 - protein, 11 aa, Influenza virus
CGSKERLGSWS

SEQ ID NO: 520136 - protein, 11 aa, Influenza virus
CGSKKRLGSWS

SEQ ID NO: 520137 - protein, 11 aa, Influenza virus
CGSPFPVGSGS

SEQ ID NO: 520138 - protein, 11 aa, Influenza virus
CGSPISVGSGS

SEQ ID NO: 520139 - protein, 11 aa, Influenza virus
CGSPVPVGSGS

SEQ ID NO: 520140 - protein, 11 aa, Influenza virus
CGSPVSVGSGS

SEQ ID NO: 520141 - protein, 11 aa, Influenza virus
CGSRERLGSWS

SEQ ID NO: 520142 - protein, 11 aa, Influenza virus
CGTSGTYGAGS

SEQ ID NO: 520143 - protein, 11 aa, Influenza virus
CGTSGTYGSGS

SEQ ID NO: 520144 - protein, 11 aa, Influenza virus
CGTSGTYGTGS

SEQ ID NO: 520145 - protein, 11 aa, Influenza virus
CGTSGTYGTGT

SEQ ID NO: 520146 - protein, 11 aa, Influenza virus
CGVSGEVPGWS

SEQ ID NO: 520147 - protein, 11 aa, Influenza virus
CGVSSEAPGWS

SEQ ID NO: 520148 - protein, 11 aa, Influenza virus
CGVSSEVPEWS

SEQ ID NO: 520149 - protein, 11 aa, Influenza virus
CGVSSEVPGWS

SEQ ID NO: 520150 - protein, 11 aa, Influenza virus
CHDGIARMTIC

SEQ ID NO: 520151 - protein, 11 aa, Influenza virus
CHDGIGRMTIC

SEQ ID NO: 520152 - protein, 11 aa, Influenza virus
CHDGKAWLHIC

SEQ ID NO: 520153 - protein, 11 aa, Influenza virus
CHDGKAWLHVC

SEQ ID NO: 520154 - protein, 11 aa, Influenza virus
CHDGKSWLHVC

SEQ ID NO: 520155 - protein, 11 aa, Influenza virus
CHDGNAWLHVC

SEQ ID NO: 520156 - protein, 11 aa, Influenza virus
CHDGRAWLHIC

SEQ ID NO: 520157 - protein, 11 aa, Influenza virus
CHDGRAWLHVC

SEQ ID NO: 520158 - protein, 11 aa, Influenza virus
CHDGVGRMTIC

SEQ ID NO: 520159 - protein, 11 aa, Influenza virus
CHDGVNRMTIC

SEQ ID NO: 520160 - protein, 11 aa, Influenza virus
CHDGVSRMTIC

SEQ ID NO: 520161 - protein, 11 aa, Influenza virus
CHITGFAPFSK

SEQ ID NO: 520162 - protein, 11 aa, Influenza virus
CHNGICPVAFT

SEQ ID NO: 520163 - protein, 11 aa, Influenza virus
CHNGICPVVFT

SEQ ID NO: 520164 - protein, 11 aa, Influenza virus
CHNGTCAVVMT

SEQ ID NO: 520165 - protein, 11 aa, Influenza virus
CHNGTCVVIMT

SEQ ID NO: 520166 - protein, 11 aa, Influenza virus
CHNGTCVVVMT

SEQ ID NO: 520167 - protein, 11 aa, Influenza virus
CHNGVCPVVFT

SEQ ID NO: 520168 - protein, 11 aa, Influenza virus
CHQFALGQGTT

SEQ ID NO: 520169 - protein, 11 aa, Influenza virus
CHQRSKFLLMD

SEQ ID NO: 520170 - protein, 11 aa, Influenza virus
CHSAAFEDLRI

SEQ ID NO: 520171 - protein, 11 aa, Influenza virus
CHSAAFEDLRL

SEQ ID NO: 520172 - protein, 11 aa, Influenza virus
CHSAAFEDLRV

SEQ ID NO: 520173 - protein, 11 aa, Influenza virus
CHSGICPVVFT

SEQ ID NO: 520174 - protein, 11 aa, Influenza virus
CHTKCQTYAGA

SEQ ID NO: 520175 - protein, 11 aa, Influenza virus
CHTKCQTYTGA

SEQ ID NO: 520176 - protein, 11 aa, Influenza virus
CIASSIVLVGL

SEQ ID NO: 520177 - protein, 11 aa, Influenza virus
CIASSIVMVGL

SEQ ID NO: 520178 - protein, 11 aa, Influenza virus
CIASSLILAAI

SEQ ID NO: 520179 - protein, 11 aa, Influenza virus
CIASSLILAAL

SEQ ID NO: 520180 - protein, 11 aa, Influenza virus
CIASSLVLAAI

SEQ ID NO: 520181 - protein, 11 aa, Influenza virus
CIASSLVLAAL

SEQ ID NO: 520182 - protein, 11 aa, Influenza virus
CIASSTVLVGL

SEQ ID NO: 520183 - protein, 11 aa, Influenza virus
CIASSTVMVGL

SEQ ID NO: 520184 - protein, 11 aa, Influenza virus
CIASSVVLVGL

SEQ ID NO: 520185 - protein, 11 aa, Influenza virus
CIASSVVLVGP

SEQ ID NO: 520186 - protein, 11 aa, Influenza virus
CIAWSRSSCHD

SEQ ID NO: 520187 - protein, 11 aa, Influenza virus
CIAWSSASCHD

SEQ ID NO: 520188 - protein, 11 aa, Influenza virus
CIAWSSSSCFD

SEQ ID NO: 520189 - protein, 11 aa, Influenza virus
CIAWSSSSCHD

SEQ ID NO: 520190 - protein, 11 aa, Influenza virus
CIAWSSSSCYD

SEQ ID NO: 520191 - protein, 11 aa, Influenza virus
CICEKLEQSGL

SEQ ID NO: 520192 - protein, 11 aa, Influenza virus
CICINGTCTVV

SEQ ID NO: 520193 - protein, 11 aa, Influenza virus
CICRDNWKGAN

SEQ ID NO: 520194 - protein, 11 aa, Influenza virus
CICRDNWKGSN

SEQ ID NO: 520195 - protein, 11 aa, Influenza virus
CICRDNWQGAN

SEQ ID NO: 520196 - protein, 11 aa, Influenza virus
CICRDNWRGAN

SEQ ID NO: 520197 - protein, 11 aa, Influenza virus
CICRDNWTGTN

SEQ ID NO: 520198 - protein, 11 aa, Influenza virus
CIDFRDMRKNT

SEQ ID NO: 520199 - protein, 11 aa, Influenza virus
CIDGTCTVVMT

SEQ ID NO: 520200 - protein, 11 aa, Influenza virus
CIEGKLSQMPK

SEQ ID NO: 520201 - protein, 11 aa, Influenza virus
CIEGKLSQMSK

SEQ ID NO: 520202 - protein, 11 aa, Influenza virus
CIEKIRNGTYD

SEQ ID NO: 520203 - protein, 11 aa, Influenza virus
CIEKVRNGTYD

SEQ ID NO: 520204 - protein, 11 aa, Influenza virus
CIERVRNGTYD

SEQ ID NO: 520205 - protein, 11 aa, Influenza virus
CIESIRNGTYD

SEQ ID NO: 520206 - protein, 11 aa, Influenza virus
CIESIRNGTYN

SEQ ID NO: 520207 - protein, 11 aa, Influenza virus
CIESKLSQMSK

SEQ ID NO: 520208 - protein, 11 aa, Influenza virus
CIGHHANNSTE

SEQ ID NO: 520209 - protein, 11 aa, Influenza virus
CIGWSSTSCHD

SEQ ID NO: 520210 - protein, 11 aa, Influenza virus
CIGYHANKSTK

SEQ ID NO: 520211 - protein, 11 aa, Influenza virus
CIGYHANNSKK

SEQ ID NO: 520212 - protein, 11 aa, Influenza virus
CIGYHANNSTD

SEQ ID NO: 520213 - protein, 11 aa, Influenza virus
CIGYHANNSTE

SEQ ID NO: 520214 - protein, 11 aa, Influenza virus
CIGYHANNSTK

SEQ ID NO: 520215 - protein, 11 aa, Influenza virus
CIGYHANNSTT

SEQ ID NO: 520216 - protein, 11 aa, Influenza virus
CIGYHANNSTV

SEQ ID NO: 520217 - protein, 11 aa, Influenza virus
CIGYHSNNSTE

SEQ ID NO: 520218 - protein, 11 aa, Influenza virus
CIGYHSNNSTK

SEQ ID NO: 520219 - protein, 11 aa, Influenza virus
CIGYLSNNATD

SEQ ID NO: 520220 - protein, 11 aa, Influenza virus
CIGYLSNNSSD

SEQ ID NO: 520221 - protein, 11 aa, Influenza virus
CIGYLSNNSTD

SEQ ID NO: 520222 - protein, 11 aa, Influenza virus
CIGYLSNNSTE

SEQ ID NO: 520223 - protein, 11 aa, Influenza virus
CIGYLSTNSSE

SEQ ID NO: 520224 - protein, 11 aa, Influenza virus
CIGYMSNNSTE

SEQ ID NO: 520225 - protein, 11 aa, Influenza virus
CIGYQSNNSTD

SEQ ID NO: 520226 - protein, 11 aa, Influenza virus
CIGYQSNNSTN

SEQ ID NO: 520227 - protein, 11 aa, Influenza virus
CIGYQTNNSTD

SEQ ID NO: 520228 - protein, 11 aa, Influenza virus
CIGYQTNNSTE

SEQ ID NO: 520229 - protein, 11 aa, Influenza virus
CIKNGNMQCTI

SEQ ID NO: 520230 - protein, 11 aa, Influenza virus
CIKNGNMRCTI

SEQ ID NO: 520231 - protein, 11 aa, Influenza virus
CIKNGNVRCTI

SEQ ID NO: 520232 - protein, 11 aa, Influenza virus
CIKPCFWVELI

SEQ ID NO: 520233 - protein, 11 aa, Influenza virus
CILDQNFRNIR

SEQ ID NO: 520234 - protein, 11 aa, Influenza virus
CINGICTVVMT

SEQ ID NO: 520235 - protein, 11 aa, Influenza virus
CINGSCAVVMT

SEQ ID NO: 520236 - protein, 11 aa, Influenza virus
CINGSCIVVMT

SEQ ID NO: 520237 - protein, 11 aa, Influenza virus
CINGSCTVVMT

SEQ ID NO: 520238 - protein, 11 aa, Influenza virus
CINGTCAVVMT

SEQ ID NO: 520239 - protein, 11 aa, Influenza virus
CINGTCTVIMT

SEQ ID NO: 520240 - protein, 11 aa, Influenza virus
CINGTCTVVMT

SEQ ID NO: 520241 - protein, 11 aa, Influenza virus
CINRCFYVELI

SEQ ID NO: 520242 - protein, 11 aa, Influenza virus
CINRCFYVELV

SEQ ID NO: 520243 - protein, 11 aa, Influenza virus
CIQGNNDNATA

SEQ ID NO: 520244 - protein, 11 aa, Influenza virus
CIRFVNSDCSK

SEQ ID NO: 520245 - protein, 11 aa, Influenza virus
CIRPCFWVELI

SEQ ID NO: 520246 - protein, 11 aa, Influenza virus
CIRPCFWVELV

SEQ ID NO: 520247 - protein, 11 aa, Influenza virus
CISATGMALSV

SEQ ID NO: 520248 - protein, 11 aa, Influenza virus
CISATGMILSV

SEQ ID NO: 520249 - protein, 11 aa, Influenza virus
CISATGMTLSV

SEQ ID NO: 520250 - protein, 11 aa, Influenza virus
CISATGVTLSV

SEQ ID NO: 520251 - protein, 11 aa, Influenza virus
CISGPNNNASA

SEQ ID NO: 520252 - protein, 11 aa, Influenza virus
CISGTCAVVMT

SEQ ID NO: 520253 - protein, 11 aa, Influenza virus
CISTTGMTLSV

SEQ ID NO: 520254 - protein, 11 aa, Influenza virus
CITGDDKNATA

SEQ ID NO: 520255 - protein, 11 aa, Influenza virus
CITGDDRNATA

SEQ ID NO: 520256 - protein, 11 aa, Influenza virus
CITPNGSIPND

SEQ ID NO: 520257 - protein, 11 aa, Influenza virus
CITPNGSIPNE

SEQ ID NO: 520258 - protein, 11 aa, Influenza virus
CITPNGSIPNG

SEQ ID NO: 520259 - protein, 11 aa, Influenza virus
CITPNGSIPNN

SEQ ID NO: 520260 - protein, 11 aa, Influenza virus
CITPNGSISND

SEQ ID NO: 520261 - protein, 11 aa, Influenza virus
CIVAVTDGPAA

SEQ ID NO: 520262 - protein, 11 aa, Influenza virus
CIVPCFWLEMI

SEQ ID NO: 520263 - protein, 11 aa, Influenza virus
CIVVMTDGSAS

SEQ ID NO: 520264 - protein, 11 aa, Influenza virus
CKAAIGLRISS

SEQ ID NO: 520265 - protein, 11 aa, Influenza virus
CKAALGLRISS

SEQ ID NO: 520266 - protein, 11 aa, Influenza virus
CKAAMGLKISS

SEQ ID NO: 520267 - protein, 11 aa, Influenza virus
CKAAMGLRISS

SEQ ID NO: 520268 - protein, 11 aa, Influenza virus
CKAAMGMRISS

SEQ ID NO: 520269 - protein, 11 aa, Influenza virus
CKIEAVIYGNP

SEQ ID NO: 520270 - protein, 11 aa, Influenza virus
CKINSWHIFGK

SEQ ID NO: 520271 - protein, 11 aa, Influenza virus
CKITGFAPFSK

SEQ ID NO: 520272 - protein, 11 aa, Influenza virus
CKIVTTVGWSW

SEQ ID NO: 520273 - protein, 11 aa, Influenza virus
CKLLGINMSKK

SEQ ID NO: 520274 - protein, 11 aa, Influenza virus
CKLNGIPPLEL

SEQ ID NO: 520275 - protein, 11 aa, Influenza virus
CKLVGINMSKK

SEQ ID NO: 520276 - protein, 11 aa, Influenza virus
CKLVGINMSKR

SEQ ID NO: 520277 - protein, 11 aa, Influenza virus
CKMYALHQGTT

SEQ ID NO: 520278 - protein, 11 aa, Influenza virus
CKPYIGKCPKY

SEQ ID NO: 520279 - protein, 11 aa, Influenza virus
CKRTVSSFYSE

SEQ ID NO: 520280 - protein, 11 aa, Influenza virus
CKSKCFWRGGS

SEQ ID NO: 520281 - protein, 11 aa, Influenza virus
CKTFFLTQGAL

SEQ ID NO: 520282 - protein, 11 aa, Influenza virus
CKTKCQTYAGA

SEQ ID NO: 520283 - protein, 11 aa, Influenza virus
CKTKEGRRKTN

SEQ ID NO: 520284 - protein, 11 aa, Influenza virus
CKVEAVIYGNP

SEQ ID NO: 520285 - protein, 11 aa, Influenza virus
CKVEGWVVVAK

SEQ ID NO: 520286 - protein, 11 aa, Influenza virus
CLAILIAGGLI

SEQ ID NO: 520287 - protein, 11 aa, Influenza virus
CLAILVAGGLI

SEQ ID NO: 520288 - protein, 11 aa, Influenza virus
CLAVLIAGGLI

SEQ ID NO: 520289 - protein, 11 aa, Influenza virus
CLGHHAVANGT

SEQ ID NO: 520290 - protein, 11 aa, Influenza virus
CLGHHAVENGT

SEQ ID NO: 520291 - protein, 11 aa, Influenza virus
CLGHHAVPNGT

SEQ ID NO: 520292 - protein, 11 aa, Influenza virus
CLGHHAVQNGT

SEQ ID NO: 520293 - protein, 11 aa, Influenza virus
CLGHHAVSNGT

SEQ ID NO: 520294 - protein, 11 aa, Influenza virus
CLGHHAVTNGT

SEQ ID NO: 520295 - protein, 11 aa, Influenza virus
CLINDPWVLLN

SEQ ID NO: 520296 - protein, 11 aa, Influenza virus
CLKNGNMRCTI

SEQ ID NO: 520297 - protein, 11 aa, Influenza virus
CLLQSLQQIES

SEQ ID NO: 520298 - protein, 11 aa, Influenza virus
CLRGGRNSFFS

SEQ ID NO: 520299 - protein, 11 aa, Influenza virus
CLRNGNMRCTI

SEQ ID NO: 520300 - protein, 11 aa, Influenza virus
CLTDKGSIQSD

SEQ ID NO: 520301 - protein, 11 aa, Influenza virus
CLVPCFWLEMI

SEQ ID NO: 520302 - protein, 11 aa, Influenza virus
CLVPCFWVEMI

SEQ ID NO: 520303 - protein, 11 aa, Influenza virus
CLYASPQLEGF

SEQ ID NO: 520304 - protein, 11 aa, Influenza virus
CMANIRNNTYD

SEQ ID NO: 520305 - protein, 11 aa, Influenza virus
CMASIRNNSYD

SEQ ID NO: 520306 - protein, 11 aa, Influenza virus
CMASIRNNTYD

SEQ ID NO: 520307 - protein, 11 aa, Influenza virus
CMASIRNNTYN

SEQ ID NO: 520308 - protein, 11 aa, Influenza virus
CMASIRNSTYD

SEQ ID NO: 520309 - protein, 11 aa, Influenza virus
CMAWSSSSCHD

SEQ ID NO: 520310 - protein, 11 aa, Influenza virus
CMDTIRNGTYN

SEQ ID NO: 520311 - protein, 11 aa, Influenza virus
CMEAIRNGTYN

SEQ ID NO: 520312 - protein, 11 aa, Influenza virus
CMERIRNNTYD

SEQ ID NO: 520313 - protein, 11 aa, Influenza virus
CMESIKNGTYD

SEQ ID NO: 520314 - protein, 11 aa, Influenza virus
CMESIRNNTYD

SEQ ID NO: 520315 - protein, 11 aa, Influenza virus
CMESIRNNTYN

SEQ ID NO: 520316 - protein, 11 aa, Influenza virus
CMESVKNGTYD

SEQ ID NO: 520317 - protein, 11 aa, Influenza virus
CMESVKNGTYN

SEQ ID NO: 520318 - protein, 11 aa, Influenza virus
CMESVRNGTYD

SEQ ID NO: 520319 - protein, 11 aa, Influenza virus
CMETIKNGTYD

SEQ ID NO: 520320 - protein, 11 aa, Influenza virus
CMETIKNGTYN

SEQ ID NO: 520321 - protein, 11 aa, Influenza virus
CMETIRNGTYD

SEQ ID NO: 520322 - protein, 11 aa, Influenza virus
CMETIRNGTYN

SEQ ID NO: 520323 - protein, 11 aa, Influenza virus
CMGLIYNRMGA

SEQ ID NO: 520324 - protein, 11 aa, Influenza virus
CMGLIYNRMGT

SEQ ID NO: 520325 - protein, 11 aa, Influenza virus
CMGSIRNNTYD

SEQ ID NO: 520326 - protein, 11 aa, Influenza virus
CMIKAIRGDLN

SEQ ID NO: 520327 - protein, 11 aa, Influenza virus
CMIKAVRGDLN

SEQ ID NO: 520328 - protein, 11 aa, Influenza virus
CMMKAVRGDLN

SEQ ID NO: 520329 - protein, 11 aa, Influenza virus
CMRPCFWVELI

SEQ ID NO: 520330 - protein, 11 aa, Influenza virus
CMRPCFWVELV

SEQ ID NO: 520331 - protein, 11 aa, Influenza virus
CMSGPNDNASA

SEQ ID NO: 520332 - protein, 11 aa, Influenza virus
CMSGPNNNASA

SEQ ID NO: 520333 - protein, 11 aa, Influenza virus
CMVKAVRGDLN

SEQ ID NO: 520334 - protein, 11 aa, Influenza virus
CNALTGGQSFY

SEQ ID NO: 520335 - protein, 11 aa, Influenza virus
CNASTGAQSFY

SEQ ID NO: 520336 - protein, 11 aa, Influenza virus
CNASTGGQAFY

SEQ ID NO: 520337 - protein, 11 aa, Influenza virus
CNASTGGQSFY

SEQ ID NO: 520338 - protein, 11 aa, Influenza virus
CNDPYPGNNBN

SEQ ID NO: 520339 - protein, 11 aa, Influenza virus
CNDPYPGNNNG

SEQ ID NO: 520340 - protein, 11 aa, Influenza virus
CNDPYPGNNNK

SEQ ID NO: 520341 - protein, 11 aa, Influenza virus
CNDPYPGNNNN

SEQ ID NO: 520342 - protein, 11 aa, Influenza virus
CNDSCMDTIRN

SEQ ID NO: 520343 - protein, 11 aa, Influenza virus
CNDSCMEAIRN

SEQ ID NO: 520344 - protein, 11 aa, Influenza virus
CNDSCMETIRN

SEQ ID NO: 520345 - protein, 11 aa, Influenza virus
CNEPYPGNNNN

SEQ ID NO: 520346 - protein, 11 aa, Influenza virus
CNFEGWIVGNP

SEQ ID NO: 520347 - protein, 11 aa, Influenza virus
CNILKGKFQTA

SEQ ID NO: 520348 - protein, 11 aa, Influenza virus
CNLFEKFFPSS

SEQ ID NO: 520349 - protein, 11 aa, Influenza virus
CNNECMETIKN

SEQ ID NO: 520350 - protein, 11 aa, Influenza virus
CNNGSCRCTIC

SEQ ID NO: 520351 - protein, 11 aa, Influenza virus
CNNPITGSPEA

SEQ ID NO: 520352 - protein, 11 aa, Influenza virus
CNNPITGSPGA

SEQ ID NO: 520353 - protein, 11 aa, Influenza virus
CNNSCMETIRN

SEQ ID NO: 520354 - protein, 11 aa, Influenza virus
CNNTCMETIRN

SEQ ID NO: 520355 - protein, 11 aa, Influenza virus
CNQFALGQGTT

SEQ ID NO: 520356 - protein, 11 aa, Influenza virus
CNSAAFEDLRV

SEQ ID NO: 520357 - protein, 11 aa, Influenza virus
CNSNAITRSGQ

SEQ ID NO: 520358 - protein, 11 aa, Influenza virus
CNTDLGAPLEL

SEQ ID NO: 520359 - protein, 11 aa, Influenza virus
CNTDLGSPLEL

SEQ ID NO: 520360 - protein, 11 aa, Influenza virus
CNTDLGTPLEL

SEQ ID NO: 520361 - protein, 11 aa, Influenza virus
CNTKCQTSLGG

SEQ ID NO: 520362 - protein, 11 aa, Influenza virus
CNTKCQTSMGG

SEQ ID NO: 520363 - protein, 11 aa, Influenza virus
CNTKCQTSVGG

SEQ ID NO: 520364 - protein, 11 aa, Influenza virus
CNTKCQTYAGA

SEQ ID NO: 520365 - protein, 11 aa, Influenza virus
CNTRCQTSVGG

SEQ ID NO: 520366 - protein, 11 aa, Influenza virus
CNVEGWVVIAK

SEQ ID NO: 520367 - protein, 11 aa, Influenza virus
CPFKGFFPFHK

SEQ ID NO: 520368 - protein, 11 aa, Influenza virus
CPFQGFFPFHK

SEQ ID NO: 520369 - protein, 11 aa, Influenza virus
CPFRGFFPFHK

SEQ ID NO: 520370 - protein, 11 aa, Influenza virus
CPIGEAPSPYN

SEQ ID NO: 520371 - protein, 11 aa, Influenza virus
CPIGEVPSPYN

SEQ ID NO: 520372 - protein, 11 aa, Influenza virus
CPIGVAPSPSN

SEQ ID NO: 520373 - protein, 11 aa, Influenza virus
CPIGVVPSPSN

SEQ ID NO: 520374 - protein, 11 aa, Influenza virus
CPIKGWAPLSK

SEQ ID NO: 520375 - protein, 11 aa, Influenza virus
CPIRGWAPLSK

SEQ ID NO: 520376 - protein, 11 aa, Influenza virus
CPKYIKQGSLK

SEQ ID NO: 520377 - protein, 11 aa, Influenza virus
CPKYIKSDQLK

SEQ ID NO: 520378 - protein, 11 aa, Influenza virus
CPKYIKSGQLK

SEQ ID NO: 520379 - protein, 11 aa, Influenza virus
CPKYIPSGSLK

SEQ ID NO: 520380 - protein, 11 aa, Influenza virus
CPKYIPSNSLK

SEQ ID NO: 520381 - protein, 11 aa, Influenza virus
CPKYIPSRSLK

SEQ ID NO: 520382 - protein, 11 aa, Influenza virus
CPKYISSGSLK

SEQ ID NO: 520383 - protein, 11 aa, Influenza virus
CPKYMNVKSLK

SEQ ID NO: 520384 - protein, 11 aa, Influenza virus
CPKYVKQGSLK

SEQ ID NO: 520385 - protein, 11 aa, Influenza virus
CPKYVKQGSLM

SEQ ID NO: 520386 - protein, 11 aa, Influenza virus
CPKYVKQGSLR

SEQ ID NO: 520387 - protein, 11 aa, Influenza virus
CPKYVKSDRLV

SEQ ID NO: 520388 - protein, 11 aa, Influenza virus
CPKYVKSEKLV

SEQ ID NO: 520389 - protein, 11 aa, Influenza virus
CPKYVKSERLV

SEQ ID NO: 520390 - protein, 11 aa, Influenza virus
CPKYVKSKRLV

SEQ ID NO: 520391 - protein, 11 aa, Influenza virus
CPKYVNIKSLK

SEQ ID NO: 520392 - protein, 11 aa, Influenza virus
CPKYVNVKSLK

SEQ ID NO: 520393 - protein, 11 aa, Influenza virus
CPKYVNVRSLK

SEQ ID NO: 520394 - protein, 11 aa, Influenza virus
CPKYVRSEKLV

SEQ ID NO: 520395 - protein, 11 aa, Influenza virus
CPLGEAPSPYN

SEQ ID NO: 520396 - protein, 11 aa, Influenza virus
CPMGVAPSPSN

SEQ ID NO: 520397 - protein, 11 aa, Influenza virus
CPRYIPSGSLK

SEQ ID NO: 520398 - protein, 11 aa, Influenza virus
CPRYVKQGSLK

SEQ ID NO: 520399 - protein, 11 aa, Influenza virus
CPRYVKQSSLP

SEQ ID NO: 520400 - protein, 11 aa, Influenza virus
CPSPLKLVDGQ

SEQ ID NO: 520401 - protein, 11 aa, Influenza virus
CPVGEAPSPYN

SEQ ID NO: 520402 - protein, 11 aa, Influenza virus
CPVGVAPSPSN

SEQ ID NO: 520403 - protein, 11 aa, Influenza virus
CPVIMTDGPAN

SEQ ID NO: 520404 - protein, 11 aa, Influenza virus
CPVKGWAPLSK

SEQ ID NO: 520405 - protein, 11 aa, Influenza virus
CPVVFTDGSAT

SEQ ID NO: 520406 - protein, 11 aa, Influenza virus
CPVVMTDGPAD

SEQ ID NO: 520407 - protein, 11 aa, Influenza virus
CPVVMTDGPAN

SEQ ID NO: 520408 - protein, 11 aa, Influenza virus
CPVVMTDGPAS

SEQ ID NO: 520409 - protein, 11 aa, Influenza virus
CQDEFCYTLIT

SEQ ID NO: 520410 - protein, 11 aa, Influenza virus
CQDEFCYTLMT

SEQ ID NO: 520411 - protein, 11 aa, Influenza virus
CQDEFCYTLVT

SEQ ID NO: 520412 - protein, 11 aa, Influenza virus
CQITGFAPFSK

SEQ ID NO: 520413 - protein, 11 aa, Influenza virus
CQKGNIKCNIC

SEQ ID NO: 520414 - protein, 11 aa, Influenza virus
CQKGNIRCDIC

SEQ ID NO: 520415 - protein, 11 aa, Influenza virus
CQKGNIRCNIC

SEQ ID NO: 520416 - protein, 11 aa, Influenza virus
CQLNEGIMNTS

SEQ ID NO: 520417 - protein, 11 aa, Influenza virus
CQLNEGVINTS

SEQ ID NO: 520418 - protein, 11 aa, Influenza virus
CQLNEGVMNTS

SEQ ID NO: 520419 - protein, 11 aa, Influenza virus
CQMEKIVLLFA

SEQ ID NO: 520420 - protein, 11 aa, Influenza virus
CQNGNIRCQIC

SEQ ID NO: 520421 - protein, 11 aa, Influenza virus
CQNGNIRCTFC

SEQ ID NO: 520422 - protein, 11 aa, Influenza virus
CQNGNLRCQIC

SEQ ID NO: 520423 - protein, 11 aa, Influenza virus
CQNGNVRCQIC

SEQ ID NO: 520424 - protein, 11 aa, Influenza virus
CQNGNVRCTFC

SEQ ID NO: 520425 - protein, 11 aa, Influenza virus
CQNGVCPVVFT

SEQ ID NO: 520426 - protein, 11 aa, Influenza virus
CQRGNIRCNIC

SEQ ID NO: 520427 - protein, 11 aa, Influenza virus
CQSPLGAINTT

SEQ ID NO: 520428 - protein, 11 aa, Influenza virus
CQTPLGAINTT

SEQ ID NO: 520429 - protein, 11 aa, Influenza virus
CQTPLGALNTT

SEQ ID NO: 520430 - protein, 11 aa, Influenza virus
CQTSVGGIDTN

SEQ ID NO: 520431 - protein, 11 aa, Influenza virus
CQTSVGGINTN

SEQ ID NO: 520432 - protein, 11 aa, Influenza virus
CQTYAGAINSS

SEQ ID NO: 520433 - protein, 11 aa, Influenza virus
CQTYAGAVNSS

SEQ ID NO: 520434 - protein, 11 aa, Influenza virus
CQTYTGAINSS

SEQ ID NO: 520435 - protein, 11 aa, Influenza virus
CQVECVCRDNW

SEQ ID NO: 520436 - protein, 11 aa, Influenza virus
CRALLAKSVFN

SEQ ID NO: 520437 - protein, 11 aa, Influenza virus
CRATEYIMKGV

SEQ ID NO: 520438 - protein, 11 aa, Influenza virus
CRATEYMMKGV

SEQ ID NO: 520439 - protein, 11 aa, Influenza virus
CRDNWHASNRP

SEQ ID NO: 520440 - protein, 11 aa, Influenza virus
CRDNWHGSNRP

SEQ ID NO: 520441 - protein, 11 aa, Influenza virus
CRDNWKGANRP

SEQ ID NO: 520442 - protein, 11 aa, Influenza virus
CRDNWKGSNRP

SEQ ID NO: 520443 - protein, 11 aa, Influenza virus
CRDNWMGSNRP

SEQ ID NO: 520444 - protein, 11 aa, Influenza virus
CRDNWNGMNRP

SEQ ID NO: 520445 - protein, 11 aa, Influenza virus
CRDNWQGANRP

SEQ ID NO: 520446 - protein, 11 aa, Influenza virus
CRDNWQGSNRP

SEQ ID NO: 520447 - protein, 11 aa, Influenza virus
CRDNWRGANRP

SEQ ID NO: 520448 - protein, 11 aa, Influenza virus
CRDNWRGSNRP

SEQ ID NO: 520449 - protein, 11 aa, Influenza virus
CRDNWTGTNRP

SEQ ID NO: 520450 - protein, 11 aa, Influenza virus
CRETRGLFGAI

SEQ ID NO: 520451 - protein, 11 aa, Influenza virus
CRFEGWIVGNP

SEQ ID NO: 520452 - protein, 11 aa, Influenza virus
CRFYALSQGTT

SEQ ID NO: 520453 - protein, 11 aa, Influenza virus
CRICIDFRDMR

SEQ ID NO: 520454 - protein, 11 aa, Influenza virus
CRICILDQNFR

SEQ ID NO: 520455 - protein, 11 aa, Influenza virus
CRIIQNEDIPI

SEQ ID NO: 520456 - protein, 11 aa, Influenza virus
CRKTRGLFGAI

SEQ ID NO: 520457 - protein, 11 aa, Influenza virus
CRLRGIPPLEL

SEQ ID NO: 520458 - protein, 11 aa, Influenza virus
CRLSGIPPLEL

SEQ ID NO: 520459 - protein, 11 aa, Influenza virus
CRMFALSQGTT

SEQ ID NO: 520460 - protein, 11 aa, Influenza virus
CRMYALHQGTT

SEQ ID NO: 520461 - protein, 11 aa, Influenza virus
CRTFFLTHGAL

SEQ ID NO: 520462 - protein, 11 aa, Influenza virus
CRTFFLTHGSL

SEQ ID NO: 520463 - protein, 11 aa, Influenza virus
CRTFFLTQGAL

SEQ ID NO: 520464 - protein, 11 aa, Influenza virus
CRTFFLTQGSL

SEQ ID NO: 520465 - protein, 11 aa, Influenza virus
CRTKEGRRKTN

SEQ ID NO: 520466 - protein, 11 aa, Influenza virus
CRTKEGRRRTN

SEQ ID NO: 520467 - protein, 11 aa, Influenza virus
CRTLLAKSVFN

SEQ ID NO: 520468 - protein, 11 aa, Influenza virus
CRTREGRRKTN

SEQ ID NO: 520469 - protein, 11 aa, Influenza virus
CSALFVYSLRK

SEQ ID NO: 520470 - protein, 11 aa, Influenza virus
CSASTGGQSFY

SEQ ID NO: 520471 - protein, 11 aa, Influenza virus
CSCYMDIDVYC

SEQ ID NO: 520472 - protein, 11 aa, Influenza virus
CSCYPNDGKVE

SEQ ID NO: 520473 - protein, 11 aa, Influenza virus
CSCYPNEGKVE

SEQ ID NO: 520474 - protein, 11 aa, Influenza virus
CSCYPNLGIVE

SEQ ID NO: 520475 - protein, 11 aa, Influenza virus
CSCYPNLGKVE

SEQ ID NO: 520476 - protein, 11 aa, Influenza virus
CSCYPNLGQVE

SEQ ID NO: 520477 - protein, 11 aa, Influenza virus
CSCYPNMGKVE

SEQ ID NO: 520478 - protein, 11 aa, Influenza virus
CSCYPNNGKVE

SEQ ID NO: 520479 - protein, 11 aa, Influenza virus
CSCYPNSGKVE

SEQ ID NO: 520480 - protein, 11 aa, Influenza virus
CSCYPQYPNVR

SEQ ID NO: 520481 - protein, 11 aa, Influenza virus
CSCYPRYPDVR

SEQ ID NO: 520482 - protein, 11 aa, Influenza virus
CSCYPRYPGVR

SEQ ID NO: 520483 - protein, 11 aa, Influenza virus
CSCYPRYPNVR

SEQ ID NO: 520484 - protein, 11 aa, Influenza virus
CSCYSRYPNVR

SEQ ID NO: 520485 - protein, 11 aa, Influenza virus
CSCYVDIDIYC

SEQ ID NO: 520486 - protein, 11 aa, Influenza virus
CSCYVDIDVYC

SEQ ID NO: 520487 - protein, 11 aa, Influenza virus
CSCYVDTDVYC

SEQ ID NO: 520488 - protein, 11 aa, Influenza virus
CSCYVDVDVYC

SEQ ID NO: 520489 - protein, 11 aa, Influenza virus
CSDGPGWLTIG

SEQ ID NO: 520490 - protein, 11 aa, Influenza virus
CSDGPGWLTLG

SEQ ID NO: 520491 - protein, 11 aa, Influenza virus
CSDGSGWLTLG

SEQ ID NO: 520492 - protein, 11 aa, Influenza virus
CSFAGWILGNP

SEQ ID NO: 520493 - protein, 11 aa, Influenza virus
CSFEGWIGGNP

SEQ ID NO: 520494 - protein, 11 aa, Influenza virus
CSFEGWIVGNP

SEQ ID NO: 520495 - protein, 11 aa, Influenza virus
CSFTGWILGNP

SEQ ID NO: 520496 - protein, 11 aa, Influenza virus
CSGFFGDNPRP

SEQ ID NO: 520497 - protein, 11 aa, Influenza virus
CSGIFGDNPRP

SEQ ID NO: 520498 - protein, 11 aa, Influenza virus
CSGIFGDSPRP

SEQ ID NO: 520499 - protein, 11 aa, Influenza virus
CSGLVGDTPRD

SEQ ID NO: 520500 - protein, 11 aa, Influenza virus
CSGLVGDTPRE

SEQ ID NO: 520501 - protein, 11 aa, Influenza virus
CSGLVGDTPRG

SEQ ID NO: 520502 - protein, 11 aa, Influenza virus
CSGLVGDTPRK

SEQ ID NO: 520503 - protein, 11 aa, Influenza virus
CSGLVGDTPRN

SEQ ID NO: 520504 - protein, 11 aa, Influenza virus
CSGLVGDTPRS

SEQ ID NO: 520505 - protein, 11 aa, Influenza virus
CSGLVGDTPRT

SEQ ID NO: 520506 - protein, 11 aa, Influenza virus
CSGVFGDNPRP

SEQ ID NO: 520507 - protein, 11 aa, Influenza virus
CSGVFGDNPRS

SEQ ID NO: 520508 - protein, 11 aa, Influenza virus
CSGVFGDSPRP

SEQ ID NO: 520509 - protein, 11 aa, Influenza virus
CSGVFGDTPRP

SEQ ID NO: 520510 - protein, 11 aa, Influenza virus
CSGVLGDNPRP

SEQ ID NO: 520511 - protein, 11 aa, Influenza virus
CSHLECRTFFL

SEQ ID NO: 520512 - protein, 11 aa, Influenza virus
CSHMECRTFFL

SEQ ID NO: 520513 - protein, 11 aa, Influenza virus
CSHSECRTFFL

SEQ ID NO: 520514 - protein, 11 aa, Influenza virus
CSIAGWLLGNP

SEQ ID NO: 520515 - protein, 11 aa, Influenza virus
CSIDECRTFFL

SEQ ID NO: 520516 - protein, 11 aa, Influenza virus
CSIDGKAPISL

SEQ ID NO: 520517 - protein, 11 aa, Influenza virus
CSIHECRTFFL

SEQ ID NO: 520518 - protein, 11 aa, Influenza virus
CSINECRTFFL

SEQ ID NO: 520519 - protein, 11 aa, Influenza virus
CSINGKAPISL

SEQ ID NO: 520520 - protein, 11 aa, Influenza virus
CSINGKEPISL

SEQ ID NO: 520521 - protein, 11 aa, Influenza virus
CSINGKQPISL

SEQ ID NO: 520522 - protein, 11 aa, Influenza virus
CSINGRAPISL

SEQ ID NO: 520523 - protein, 11 aa, Influenza virus
CSISECRTFFL

SEQ ID NO: 520524 - protein, 11 aa, Influenza virus
CSIWFSHYNQM

SEQ ID NO: 520525 - protein, 11 aa, Influenza virus
CSIWFSHYNQV

SEQ ID NO: 520526 - protein, 11 aa, Influenza virus
CSKFHSDTPRP

SEQ ID NO: 520527 - protein, 11 aa, Influenza virus
CSKILTDTSRP

SEQ ID NO: 520528 - protein, 11 aa, Influenza virus
CSKTLTDTSRP

SEQ ID NO: 520529 - protein, 11 aa, Influenza virus
CSKVLTDTSRP

SEQ ID NO: 520530 - protein, 11 aa, Influenza virus
CSKYHWNLALD

SEQ ID NO: 520531 - protein, 11 aa, Influenza virus
CSLEGIILGNP

SEQ ID NO: 520532 - protein, 11 aa, Influenza virus
CSLEGLILGNP

SEQ ID NO: 520533 - protein, 11 aa, Influenza virus
CSLEGLILSNP

SEQ ID NO: 520534 - protein, 11 aa, Influenza virus
CSLEGLVLGNP

SEQ ID NO: 520535 - protein, 11 aa, Influenza virus
CSLFEKFFPSS

SEQ ID NO: 520536 - protein, 11 aa, Influenza virus
CSLKGLILGNP

SEQ ID NO: 520537 - protein, 11 aa, Influenza virus
CSLMQGSTLPR

SEQ ID NO: 520538 - protein, 11 aa, Influenza virus
CSLNGISPIHL

SEQ ID NO: 520539 - protein, 11 aa, Influenza virus
CSLNGISPVHL

SEQ ID NO: 520540 - protein, 11 aa, Influenza virus
CSLNGVSPIHL

SEQ ID NO: 520541 - protein, 11 aa, Influenza virus
CSLNGVSPVHL

SEQ ID NO: 520542 - protein, 11 aa, Influenza virus
CSNDTINYYNE

SEQ ID NO: 520543 - protein, 11 aa, Influenza virus
CSNGNCRFNVC

SEQ ID NO: 520544 - protein, 11 aa, Influenza virus
CSNGSCRCTIC

SEQ ID NO: 520545 - protein, 11 aa, Influenza virus
CSNGSCRFNVC

SEQ ID NO: 520546 - protein, 11 aa, Influenza virus
CSNGSLQCKIC

SEQ ID NO: 520547 - protein, 11 aa, Influenza virus
CSNGSLQCRIA

SEQ ID NO: 520548 - protein, 11 aa, Influenza virus
CSNGSLQCRIC

SEQ ID NO: 520549 - protein, 11 aa, Influenza virus
CSNGSLQCRVC

SEQ ID NO: 520550 - protein, 11 aa, Influenza virus
CSNGSLQCTIC

SEQ ID NO: 520551 - protein, 11 aa, Influenza virus
CSNGSLRCRIC

SEQ ID NO: 520552 - protein, 11 aa, Influenza virus
CSNNTTNYYNE

SEQ ID NO: 520553 - protein, 11 aa, Influenza virus
CSNPITGSPGA

SEQ ID NO: 520554 - protein, 11 aa, Influenza virus
CSNPITGSPSA

SEQ ID NO: 520555 - protein, 11 aa, Influenza virus
CSPLSRCRETR

SEQ ID NO: 520556 - protein, 11 aa, Influenza virus
CSPLSRCRKTR

SEQ ID NO: 520557 - protein, 11 aa, Influenza virus
CSPSECRTFFL

SEQ ID NO: 520558 - protein, 11 aa, Influenza virus
CSPVLTDNPRP

SEQ ID NO: 520559 - protein, 11 aa, Influenza virus
CSQLECRTFFL

SEQ ID NO: 520560 - protein, 11 aa, Influenza virus
CSQRSKFLLMD

SEQ ID NO: 520561 - protein, 11 aa, Influenza virus
CSRILTDTSRP

SEQ ID NO: 520562 - protein, 11 aa, Influenza virus
CSRVLTDTSRP

SEQ ID NO: 520563 - protein, 11 aa, Influenza virus
CSSGNCRFNVC

SEQ ID NO: 520564 - protein, 11 aa, Influenza virus
CSSGNCRFSVC

SEQ ID NO: 520565 - protein, 11 aa, Influenza virus
CSSTEFLGQWD

SEQ ID NO: 520566 - protein, 11 aa, Influenza virus
CSSTEFLGQWN

SEQ ID NO: 520567 - protein, 11 aa, Influenza virus
CSVAGWLLGNP

SEQ ID NO: 520568 - protein, 11 aa, Influenza virus
CSVEGWVVIAK

SEQ ID NO: 520569 - protein, 11 aa, Influenza virus
CSVEYASKTRI

SEQ ID NO: 520570 - protein, 11 aa, Influenza virus
CSVSECRTFFL

SEQ ID NO: 520571 - protein, 11 aa, Influenza virus
CSWSLQCRICI

SEQ ID NO: 520572 - protein, 11 aa, Influenza virus
CSYLECRTFFL

SEQ ID NO: 520573 - protein, 11 aa, Influenza virus
CTCRDNWKGSN

SEQ ID NO: 520574 - protein, 11 aa, Influenza virus
CTCRDNWQGSN

SEQ ID NO: 520575 - protein, 11 aa, Influenza virus
CTGCFEIFHKC

SEQ ID NO: 520576 - protein, 11 aa, Influenza virus
CTGILTDTSRP

SEQ ID NO: 520577 - protein, 11 aa, Influenza virus
CTGNLIAPRGY

SEQ ID NO: 520578 - protein, 11 aa, Influenza virus
CTGVLTDTSRP

SEQ ID NO: 520579 - protein, 11 aa, Influenza virus
CTHLEICFMYS

SEQ ID NO: 520580 - protein, 11 aa, Influenza virus
CTHLEVCFMYS

SEQ ID NO: 520581 - protein, 11 aa, Influenza virus
CTHMEVCFMYS

SEQ ID NO: 520582 - protein, 11 aa, Influenza virus
CTINSWHIFGK

SEQ ID NO: 520583 - protein, 11 aa, Influenza virus
CTINSWHIYGK

SEQ ID NO: 520584 - protein, 11 aa, Influenza virus
CTIPCFWVEMI

SEQ ID NO: 520585 - protein, 11 aa, Influenza virus
CTISLVKTTLF

SEQ ID NO: 520586 - protein, 11 aa, Influenza virus
CTKGKKAVDLG

SEQ ID NO: 520587 - protein, 11 aa, Influenza virus
CTLFEKFFPSS

SEQ ID NO: 520588 - protein, 11 aa, Influenza virus
CTLIDALLGDP

SEQ ID NO: 520589 - protein, 11 aa, Influenza virus
CTLIDAMLGDP

SEQ ID NO: 520590 - protein, 11 aa, Influenza virus
CTLMDALLGDP

SEQ ID NO: 520591 - protein, 11 aa, Influenza virus
CTLVDALLGDP

SEQ ID NO: 520592 - protein, 11 aa, Influenza virus
CTSPCLTDKGS

SEQ ID NO: 520593 - protein, 11 aa, Influenza virus
CTVIMTDGSAS

SEQ ID NO: 520594 - protein, 11 aa, Influenza virus
CTVPCFWVEMI

SEQ ID NO: 520595 - protein, 11 aa, Influenza virus
CTVVLTDGSAS

SEQ ID NO: 520596 - protein, 11 aa, Influenza virus
CTVVMTDGNAS

SEQ ID NO: 520597 - protein, 11 aa, Influenza virus
CTVVMTDGSAS

SEQ ID NO: 520598 - protein, 11 aa, Influenza virus
CTVVMTDGSAT

SEQ ID NO: 520599 - protein, 11 aa, Influenza virus
CTVVMTDGSVS

SEQ ID NO: 520600 - protein, 11 aa, Influenza virus
CVASSLVLAAI

SEQ ID NO: 520601 - protein, 11 aa, Influenza virus
CVAWSSSSCFD

SEQ ID NO: 520602 - protein, 11 aa, Influenza virus
CVAWSSSSCHD

SEQ ID NO: 520603 - protein, 11 aa, Influenza virus
CVAWSSTSCFD

SEQ ID NO: 520604 - protein, 11 aa, Influenza virus
CVCHKGICPVV

SEQ ID NO: 520605 - protein, 11 aa, Influenza virus
CVCHKGVCPVV

SEQ ID NO: 520606 - protein, 11 aa, Influenza virus
CVCHNGICPVA

SEQ ID NO: 520607 - protein, 11 aa, Influenza virus
CVCHNGICPVV

SEQ ID NO: 520608 - protein, 11 aa, Influenza virus
CVCHNGTCAVV

SEQ ID NO: 520609 - protein, 11 aa, Influenza virus
CVCHNGTCPVV

SEQ ID NO: 520610 - protein, 11 aa, Influenza virus
CVCHNGTCVVI

SEQ ID NO: 520611 - protein, 11 aa, Influenza virus
CVCHNGTCVVV

SEQ ID NO: 520612 - protein, 11 aa, Influenza virus
CVCHNGVCPVV

SEQ ID NO: 520613 - protein, 11 aa, Influenza virus
CVCHSGICPVV

SEQ ID NO: 520614 - protein, 11 aa, Influenza virus
CVCINGICTVV

SEQ ID NO: 520615 - protein, 11 aa, Influenza virus
CVCINGSCAVV

SEQ ID NO: 520616 - protein, 11 aa, Influenza virus
CVCINGSCIVV

SEQ ID NO: 520617 - protein, 11 aa, Influenza virus
CVCINGSCTVV

SEQ ID NO: 520618 - protein, 11 aa, Influenza virus
CVCINGTCAVV

SEQ ID NO: 520619 - protein, 11 aa, Influenza virus
CVCINGTCTVI

SEQ ID NO: 520620 - protein, 11 aa, Influenza virus
CVCINGTCTVV

SEQ ID NO: 520621 - protein, 11 aa, Influenza virus
CVCISGTCAVV

SEQ ID NO: 520622 - protein, 11 aa, Influenza virus
CVCQDEFCYTL

SEQ ID NO: 520623 - protein, 11 aa, Influenza virus
CVCQNGVCPVV

SEQ ID NO: 520624 - protein, 11 aa, Influenza virus
CVCRDNWHASN

SEQ ID NO: 520625 - protein, 11 aa, Influenza virus
CVCRDNWHGSN

SEQ ID NO: 520626 - protein, 11 aa, Influenza virus
CVCRDNWKGAN

SEQ ID NO: 520627 - protein, 11 aa, Influenza virus
CVCRDNWKGSN

SEQ ID NO: 520628 - protein, 11 aa, Influenza virus
CVCRDNWMGSN

SEQ ID NO: 520629 - protein, 11 aa, Influenza virus
CVCRDNWNGMN

SEQ ID NO: 520630 - protein, 11 aa, Influenza virus
CVCRDNWQGAN

SEQ ID NO: 520631 - protein, 11 aa, Influenza virus
CVCRDNWRGSN

SEQ ID NO: 520632 - protein, 11 aa, Influenza virus
CVCRDNWTGTN

SEQ ID NO: 520633 - protein, 11 aa, Influenza virus
CVGWSSTSCHD

SEQ ID NO: 520634 - protein, 11 aa, Influenza virus
CVGWSSTTCHD

SEQ ID NO: 520635 - protein, 11 aa, Influenza virus
CVGYHANNSTD

SEQ ID NO: 520636 - protein, 11 aa, Influenza virus
CVGYHANNSTE

SEQ ID NO: 520637 - protein, 11 aa, Influenza virus
CVGYHANNSTK

SEQ ID NO: 520638 - protein, 11 aa, Influenza virus
CVGYHSNNSTE

SEQ ID NO: 520639 - protein, 11 aa, Influenza virus
CVGYLSTNSSD

SEQ ID NO: 520640 - protein, 11 aa, Influenza virus
CVGYLSTNSSE

SEQ ID NO: 520641 - protein, 11 aa, Influenza virus
CVGYLSTNSTE

SEQ ID NO: 520642 - protein, 11 aa, Influenza virus
CVILLNPFVSH

SEQ ID NO: 520643 - protein, 11 aa, Influenza virus
CVKNGNHAVHY

SEQ ID NO: 520644 - protein, 11 aa, Influenza virus
CVKNGNLRCTI

SEQ ID NO: 520645 - protein, 11 aa, Influenza virus
CVKNGNMQCTI

SEQ ID NO: 520646 - protein, 11 aa, Influenza virus
CVKNGNMRCTI

SEQ ID NO: 520647 - protein, 11 aa, Influenza virus
CVKNGNMRCTS

SEQ ID NO: 520648 - protein, 11 aa, Influenza virus
CVLEAMAFLED

SEQ ID NO: 520649 - protein, 11 aa, Influenza virus
CVLEAMAFLEE

SEQ ID NO: 520650 - protein, 11 aa, Influenza virus
CVLEAMAFLEK

SEQ ID NO: 520651 - protein, 11 aa, Influenza virus
CVLEAMAFLEN

SEQ ID NO: 520652 - protein, 11 aa, Influenza virus
CVLEAMALLEE

SEQ ID NO: 520653 - protein, 11 aa, Influenza virus
CVLLNDKHSNN

SEQ ID NO: 520654 - protein, 11 aa, Influenza virus
CVMLLAIAMGL

SEQ ID NO: 520655 - protein, 11 aa, Influenza virus
CVNRCFYVELI

SEQ ID NO: 520656 - protein, 11 aa, Influenza virus
CVQGNNDNATA

SEQ ID NO: 520657 - protein, 11 aa, Influenza virus
CVQGNNKNATA

SEQ ID NO: 520658 - protein, 11 aa, Influenza virus
CVQGNNNNATA

SEQ ID NO: 520659 - protein, 11 aa, Influenza virus
CVSGPNNNASA

SEQ ID NO: 520660 - protein, 11 aa, Influenza virus
CVSLLQSAILS

SEQ ID NO: 520661 - protein, 11 aa, Influenza virus
CVTGDDKNATA

SEQ ID NO: 520662 - protein, 11 aa, Influenza virus
CVTGDDRNATA

SEQ ID NO: 520663 - protein, 11 aa, Influenza virus
CVTGYEKNATA

SEQ ID NO: 520664 - protein, 11 aa, Influenza virus
CVVAVTDGPAA

SEQ ID NO: 520665 - protein, 11 aa, Influenza virus
CVVIMTDGPAN

SEQ ID NO: 520666 - protein, 11 aa, Influenza virus
CVVIMTDGPAS

SEQ ID NO: 520667 - protein, 11 aa, Influenza virus
CVVIMTDGSAS

SEQ ID NO: 520668 - protein, 11 aa, Influenza virus
CVVSVTDGPAA

SEQ ID NO: 520669 - protein, 11 aa, Influenza virus
CVVTVTDGPAA

SEQ ID NO: 520670 - protein, 11 aa, Influenza virus
CVVVMTDGSAS

SEQ ID NO: 520671 - protein, 11 aa, Influenza virus
CWEQLYTPGGE

SEQ ID NO: 520672 - protein, 11 aa, Influenza virus
CWEQMYNPGGE

SEQ ID NO: 520673 - protein, 11 aa, Influenza virus
CWEQMYTPGGE

SEQ ID NO: 520674 - protein, 11 aa, Influenza virus
CWEQMYTPGGG

SEQ ID NO: 520675 - protein, 11 aa, Influenza virus
CWEQMYTPGGK

SEQ ID NO: 520676 - protein, 11 aa, Influenza virus
CWSFALAQGAL

SEQ ID NO: 520677 - protein, 11 aa, Influenza virus
CWSFALAQGTL

SEQ ID NO: 520678 - protein, 11 aa, Influenza virus
CWSFALAQGVL

SEQ ID NO: 520679 - protein, 11 aa, Influenza virus
CWSWPDGALLP

SEQ ID NO: 520680 - protein, 11 aa, Influenza virus
CYDGKAWLHIC

SEQ ID NO: 520681 - protein, 11 aa, Influenza virus
CYDGKAWLHVC

SEQ ID NO: 520682 - protein, 11 aa, Influenza virus
CYNPCFYVELI

SEQ ID NO: 520683 - protein, 11 aa, Influenza virus
CYPFDVPDYQS

SEQ ID NO: 520684 - protein, 11 aa, Influenza virus
CYPFDVPEYQS

SEQ ID NO: 520685 - protein, 11 aa, Influenza virus
CYPFDVPGYQS

SEQ ID NO: 520686 - protein, 11 aa, Influenza virus
CYPFDVPNYQS

SEQ ID NO: 520687 - protein, 11 aa, Influenza virus
CYPGATINEEA

SEQ ID NO: 520688 - protein, 11 aa, Influenza virus
CYPGATVNEEA

SEQ ID NO: 520689 - protein, 11 aa, Influenza virus
CYPGATVNEGA

SEQ ID NO: 520690 - protein, 11 aa, Influenza virus
CYPGELDNNGE

SEQ ID NO: 520691 - protein, 11 aa, Influenza virus
CYPGELNNNGE

SEQ ID NO: 520692 - protein, 11 aa, Influenza virus
CYPGEVDNNGE

SEQ ID NO: 520693 - protein, 11 aa, Influenza virus
CYPGFVENLEE

SEQ ID NO: 520694 - protein, 11 aa, Influenza virus
CYPGKFTNEEA

SEQ ID NO: 520695 - protein, 11 aa, Influenza virus
CYPGNFNDYEE

SEQ ID NO: 520696 - protein, 11 aa, Influenza virus
CYPGRFTNEEA

SEQ ID NO: 520697 - protein, 11 aa, Influenza virus
CYPGSFNDYEE

SEQ ID NO: 520698 - protein, 11 aa, Influenza virus
CYPGSFNNYEE

SEQ ID NO: 520699 - protein, 11 aa, Influenza virus
CYPGSIENLEE

SEQ ID NO: 520700 - protein, 11 aa, Influenza virus
CYPGSIENQEE

SEQ ID NO: 520701 - protein, 11 aa, Influenza virus
CYPGSIKNQEE

SEQ ID NO: 520702 - protein, 11 aa, Influenza virus
CYPGSLNDYEE

SEQ ID NO: 520703 - protein, 11 aa, Influenza virus
CYPGSTVNEEA

SEQ ID NO: 520704 - protein, 11 aa, Influenza virus
CYPGSVENLEE

SEQ ID NO: 520705 - protein, 11 aa, Influenza virus
CYPGSVENQEE

SEQ ID NO: 520706 - protein, 11 aa, Influenza virus
CYPGTTVNEEA

SEQ ID NO: 520707 - protein, 11 aa, Influenza virus
CYPNDGKVECV

SEQ ID NO: 520708 - protein, 11 aa, Influenza virus
CYPNEGKVECI

SEQ ID NO: 520709 - protein, 11 aa, Influenza virus
CYPNEGKVECV

SEQ ID NO: 520710 - protein, 11 aa, Influenza virus
CYPNLGIVECV

SEQ ID NO: 520711 - protein, 11 aa, Influenza virus
CYPNLGKVECV

SEQ ID NO: 520712 - protein, 11 aa, Influenza virus
CYPNLGQVECV

SEQ ID NO: 520713 - protein, 11 aa, Influenza virus
CYPNMGKVECV

SEQ ID NO: 520714 - protein, 11 aa, Influenza virus
CYPNNGKVECI

SEQ ID NO: 520715 - protein, 11 aa, Influenza virus
CYPNSGKVECV

SEQ ID NO: 520716 - protein, 11 aa, Influenza virus
CYPQYPNVRCV

SEQ ID NO: 520717 - protein, 11 aa, Influenza virus
CYPRYPDVRCV

SEQ ID NO: 520718 - protein, 11 aa, Influenza virus
CYPRYPNVRCV

SEQ ID NO: 520719 - protein, 11 aa, Influenza virus
CYQFALGHGTT

SEQ ID NO: 520720 - protein, 11 aa, Influenza virus
CYQFALGQGAT

SEQ ID NO: 520721 - protein, 11 aa, Influenza virus
CYQFALGQGTT

SEQ ID NO: 520722 - protein, 11 aa, Influenza virus
CYQRSKFLLMD

SEQ ID NO: 520723 - protein, 11 aa, Influenza virus
CYRACFYVELI

SEQ ID NO: 520724 - protein, 11 aa, Influenza virus
CYTKCQTYAGA

SEQ ID NO: 520725 - protein, 11 aa, Influenza virus
CYTLITDGPSD

SEQ ID NO: 520726 - protein, 11 aa, Influenza virus
CYTLITDGPSN

SEQ ID NO: 520727 - protein, 11 aa, Influenza virus
CYTLMTDGPSD

SEQ ID NO: 520728 - protein, 11 aa, Influenza virus
CYTLVTDGPSD

SEQ ID NO: 520729 - protein, 11 aa, Influenza virus
CYWVMTDGPAN

SEQ ID NO: 520730 - protein, 11 aa, Influenza virus
CYWVMTDGPAS

SEQ ID NO: 520731 - protein, 11 aa, Influenza virus
DAERGKLKRRA

SEQ ID NO: 520732 - protein, 11 aa, Influenza virus
DAGDGCFEILH

SEQ ID NO: 520733 - protein, 11 aa, Influenza virus
DAGNGCFDILH

SEQ ID NO: 520734 - protein, 11 aa, Influenza virus
DAHILVTREPY

SEQ ID NO: 520735 - protein, 11 aa, Influenza virus
DAHVLVTREPY

SEQ ID NO: 520736 - protein, 11 aa, Influenza virus
DAIEECLINDP

SEQ ID NO: 520737 - protein, 11 aa, Influenza virus
DAINNRFQIQG

SEQ ID NO: 520738 - protein, 11 aa, Influenza virus
DAMTEIWSYNA

SEQ ID NO: 520739 - protein, 11 aa, Influenza virus
DAMTEVWSYNA

SEQ ID NO: 520740 - protein, 11 aa, Influenza virus
DANGWVSTDKD

SEQ ID NO: 520741 - protein, 11 aa, Influenza virus
DANGWVSTDKN

SEQ ID NO: 520742 - protein, 11 aa, Influenza virus
DANGWVTADKD

SEQ ID NO: 520743 - protein, 11 aa, Influenza virus
DANVKNLHDQI

SEQ ID NO: 520744 - protein, 11 aa, Influenza virus
DANVKNLHEQV

SEQ ID NO: 520745 - protein, 11 aa, Influenza virus
DANVRNLHDQI

SEQ ID NO: 520746 - protein, 11 aa, Influenza virus
DANVRNLHDQV

SEQ ID NO: 520747 - protein, 11 aa, Influenza virus
DANVRNLHDRI

SEQ ID NO: 520748 - protein, 11 aa, Influenza virus
DANVRNLHDRT

SEQ ID NO: 520749 - protein, 11 aa, Influenza virus
DANVRNLHDRV

SEQ ID NO: 520750 - protein, 11 aa, Influenza virus
DANVRNLHEQI

SEQ ID NO: 520751 - protein, 11 aa, Influenza virus
DANVRNLHEQV

SEQ ID NO: 520752 - protein, 11 aa, Influenza virus
DANVRNLHERI

SEQ ID NO: 520753 - protein, 11 aa, Influenza virus
DAPFDDRLRRD

SEQ ID NO: 520754 - protein, 11 aa, Influenza virus
DAPFIDRLRRD

SEQ ID NO: 520755 - protein, 11 aa, Influenza virus
DAPFLDRIRRD

SEQ ID NO: 520756 - protein, 11 aa, Influenza virus
DAPFLDRLRRD

SEQ ID NO: 520757 - protein, 11 aa, Influenza virus
DAQAFYKILKI

SEQ ID NO: 520758 - protein, 11 aa, Influenza virus
DAQAFYKLLKI

SEQ ID NO: 520759 - protein, 11 aa, Influenza virus
DAQIDESCEGE

SEQ ID NO: 520760 - protein, 11 aa, Influenza virus
DATAVAVIKYN

SEQ ID NO: 520761 - protein, 11 aa, Influenza virus
DATAVAVLKYN

SEQ ID NO: 520762 - protein, 11 aa, Influenza virus
DATLCLGHHAV

SEQ ID NO: 520763 - protein, 11 aa, Influenza virus
DATYQRTRALV

SEQ ID NO: 520764 - protein, 11 aa, Influenza virus
DAVATTHSWIP

SEQ ID NO: 520765 - protein, 11 aa, Influenza virus
DAVATTHSWTP

SEQ ID NO: 520766 - protein, 11 aa, Influenza virus
DAVATTHSWVP

SEQ ID NO: 520767 - protein, 11 aa, Influenza virus
DAVTDIWSYNA

SEQ ID NO: 520768 - protein, 11 aa, Influenza virus
DAVTDVWSYNA

SEQ ID NO: 520769 - protein, 11 aa, Influenza virus
DAYAVIHYGGI

SEQ ID NO: 520770 - protein, 11 aa, Influenza virus
DAYAVIHYGGM

SEQ ID NO: 520771 - protein, 11 aa, Influenza virus
DAYAVIHYGGV

SEQ ID NO: 520772 - protein, 11 aa, Influenza virus
DCDLINGALGS

SEQ ID NO: 520773 - protein, 11 aa, Influenza virus
DCDNPITGSPG

SEQ ID NO: 520774 - protein, 11 aa, Influenza virus
DCETKCQTPLG

SEQ ID NO: 520775 - protein, 11 aa, Influenza virus
DCFLWHVRKRF

SEQ ID NO: 520776 - protein, 11 aa, Influenza virus
DCFQPCFYVEL

SEQ ID NO: 520777 - protein, 11 aa, Influenza virus
DCIKPCFWVEL

SEQ ID NO: 520778 - protein, 11 aa, Influenza virus
DCIRPCFWVEL

SEQ ID NO: 520779 - protein, 11 aa, Influenza virus
DCKIEAVIYGN

SEQ ID NO: 520780 - protein, 11 aa, Influenza virus
DCKVEAVIYGN

SEQ ID NO: 520781 - protein, 11 aa, Influenza virus
DCMASIRNNTY

SEQ ID NO: 520782 - protein, 11 aa, Influenza virus
DCMESIRNNTY

SEQ ID NO: 520783 - protein, 11 aa, Influenza virus
DCMRPCFWVEL

SEQ ID NO: 520784 - protein, 11 aa, Influenza virus
DCNFEGWIVGN

SEQ ID NO: 520785 - protein, 11 aa, Influenza virus
DCNNPITGSPG

SEQ ID NO: 520786 - protein, 11 aa, Influenza virus
DCPKYIKQGSL

SEQ ID NO: 520787 - protein, 11 aa, Influenza virus
DCPKYIKSGQL

SEQ ID NO: 520788 - protein, 11 aa, Influenza virus
DCPKYMNVKSL

SEQ ID NO: 520789 - protein, 11 aa, Influenza virus
DCPKYVKQGSL

SEQ ID NO: 520790 - protein, 11 aa, Influenza virus
DCPKYVNIKSL

SEQ ID NO: 520791 - protein, 11 aa, Influenza virus
DCPKYVNVKSL

SEQ ID NO: 520792 - protein, 11 aa, Influenza virus
DCPKYVNVRSL

SEQ ID NO: 520793 - protein, 11 aa, Influenza virus
DCPRYVKQGSL

SEQ ID NO: 520794 - protein, 11 aa, Influenza virus
DCRFEGWIVGN

SEQ ID NO: 520795 - protein, 11 aa, Influenza virus
DCRTFFLTQGS

SEQ ID NO: 520796 - protein, 11 aa, Influenza virus
DCSFAGWILGN

SEQ ID NO: 520797 - protein, 11 aa, Influenza virus
DCSFAGWLLGN

SEQ ID NO: 520798 - protein, 11 aa, Influenza virus
DCSFEGWIGGN

SEQ ID NO: 520799 - protein, 11 aa, Influenza virus
DCSFEGWIVGN

SEQ ID NO: 520800 - protein, 11 aa, Influenza virus
DCSFTGWILGN

SEQ ID NO: 520801 - protein, 11 aa, Influenza virus
DCSIAGWLLGN

SEQ ID NO: 520802 - protein, 11 aa, Influenza virus
DCSITGWLLGN

SEQ ID NO: 520803 - protein, 11 aa, Influenza virus
DCSLEGIILGN

SEQ ID NO: 520804 - protein, 11 aa, Influenza virus
DCSLEGLILGN

SEQ ID NO: 520805 - protein, 11 aa, Influenza virus
DCSLEGLILSN

SEQ ID NO: 520806 - protein, 11 aa, Influenza virus
DCSLEGLVLGN

SEQ ID NO: 520807 - protein, 11 aa, Influenza virus
DCSLKGLILGN

SEQ ID NO: 520808 - protein, 11 aa, Influenza virus
DCSNPITGSPC

SEQ ID NO: 520809 - protein, 11 aa, Influenza virus
DCSNPITGSPG

SEQ ID NO: 520810 - protein, 11 aa, Influenza virus
DCSNPITGSPS

SEQ ID NO: 520811 - protein, 11 aa, Influenza virus
DCSVAGWLLGN

SEQ ID NO: 520812 - protein, 11 aa, Influenza virus
DCSVSGWLLGN

SEQ ID NO: 520813 - protein, 11 aa, Influenza virus
DCTGCFEIFHK

SEQ ID NO: 520814 - protein, 11 aa, Influenza virus
DCVLEAMAFLE

SEQ ID NO: 520815 - protein, 11 aa, Influenza virus
DCVLEAMALLE

SEQ ID NO: 520816 - protein, 11 aa, Influenza virus
DCWSFALAQGA

SEQ ID NO: 520817 - protein, 11 aa, Influenza virus
DCYRACFYVEL

SEQ ID NO: 520818 - protein, 11 aa, Influenza virus
DCYWVMTDGPA

SEQ ID NO: 520819 - protein, 11 aa, Influenza virus
DDAVTDIWSYN

SEQ ID NO: 520820 - protein, 11 aa, Influenza virus
DDAVTDVWSYN

SEQ ID NO: 520821 - protein, 11 aa, Influenza virus
DDAYAVIHYGG

SEQ ID NO: 520822 - protein, 11 aa, Influenza virus
DDCMASIRNNT

SEQ ID NO: 520823 - protein, 11 aa, Influenza virus
DDCSLEGIILG

SEQ ID NO: 520824 - protein, 11 aa, Influenza virus
DDCSLEGLILG

SEQ ID NO: 520825 - protein, 11 aa, Influenza virus
DDCSLEGLILS

SEQ ID NO: 520826 - protein, 11 aa, Influenza virus
DDCSLEGLVLG

SEQ ID NO: 520827 - protein, 11 aa, Influenza virus
DDCSLKGLILG

SEQ ID NO: 520828 - protein, 11 aa, Influenza virus
DDDAYAVIHYG

SEQ ID NO: 520829 - protein, 11 aa, Influenza virus
DDDCMASIRNN

SEQ ID NO: 520830 - protein, 11 aa, Influenza virus
DDENATASFIY

SEQ ID NO: 520831 - protein, 11 aa, Influenza virus
DDFQLIPMISK

SEQ ID NO: 520832 - protein, 11 aa, Influenza virus
DDFQLIPMISN

SEQ ID NO: 520833 - protein, 11 aa, Influenza virus
DDGAILPFDID

SEQ ID NO: 520834 - protein, 11 aa, Influenza virus
DDGAILPFGID

SEQ ID NO: 520835 - protein, 11 aa, Influenza virus
DDGAILPLTSI

SEQ ID NO: 520836 - protein, 11 aa, Influenza virus
DDGAVAVLKYN

SEQ ID NO: 520837 - protein, 11 aa, Influenza virus
DDGFIDIWTYN

SEQ ID NO: 520838 - protein, 11 aa, Influenza virus
DDGFIDVWTYN

SEQ ID NO: 520839 - protein, 11 aa, Influenza virus
DDGFLDIWTYN

SEQ ID NO: 520840 - protein, 11 aa, Influenza virus
DDGFLDVWTYN

SEQ ID NO: 520841 - protein, 11 aa, Influenza virus
DDGLLDVWTYN

SEQ ID NO: 520842 - protein, 11 aa, Influenza virus
DDHCMESIRNN

SEQ ID NO: 520843 - protein, 11 aa, Influenza virus
DDHFVSIELEG

SEQ ID NO: 520844 - protein, 11 aa, Influenza virus
DDIDQSLIIAA

SEQ ID NO: 520845 - protein, 11 aa, Influenza virus
DDKNATASFIY

SEQ ID NO: 520846 - protein, 11 aa, Influenza virus
DDLIEKTSWSY

SEQ ID NO: 520847 - protein, 11 aa, Influenza virus
DDLIGKTSWSY

SEQ ID NO: 520848 - protein, 11 aa, Influenza virus
DDNGWVSTDKD

SEQ ID NO: 520849 - protein, 11 aa, Influenza virus
DDNVYKALSIY

SEQ ID NO: 520850 - protein, 11 aa, Influenza virus
DDPNWSGYSGS

SEQ ID NO: 520851 - protein, 11 aa, Influenza virus
DDQCMESIRNN

SEQ ID NO: 520852 - protein, 11 aa, Influenza virus
DDQIEDLWAYN

SEQ ID NO: 520853 - protein, 11 aa, Influenza virus
DDQIEELWAYN

SEQ ID NO: 520854 - protein, 11 aa, Influenza virus
DDQIEGLWAYN

SEQ ID NO: 520855 - protein, 11 aa, Influenza virus
DDQIENLWAYN

SEQ ID NO: 520856 - protein, 11 aa, Influenza virus
DDQIIDIWAYN

SEQ ID NO: 520857 - protein, 11 aa, Influenza virus
DDQITDIWAYN

SEQ ID NO: 520858 - protein, 11 aa, Influenza virus
DDQVTDIWAYN

SEQ ID NO: 520859 - protein, 11 aa, Influenza virus
DDRNATASFIY

SEQ ID NO: 520860 - protein, 11 aa, Influenza virus
DDRNATASFVY

SEQ ID NO: 520861 - protein, 11 aa, Influenza virus
DDRNATASLIY

SEQ ID NO: 520862 - protein, 11 aa, Influenza virus
DDSVYKALSIY

SEQ ID NO: 520863 - protein, 11 aa, Influenza virus
DDVDQSLIIAA

SEQ ID NO: 520864 - protein, 11 aa, Influenza virus
DDVDQSLVIAA

SEQ ID NO: 520865 - protein, 11 aa, Influenza virus
DDVSWASNSIV

SEQ ID NO: 520866 - protein, 11 aa, Influenza virus
DDVSWTSNSIV

SEQ ID NO: 520867 - protein, 11 aa, Influenza virus
DDVSWTSNSLV

SEQ ID NO: 520868 - protein, 11 aa, Influenza virus
DDVWLGRTVSI

SEQ ID NO: 520869 - protein, 11 aa, Influenza virus
DDVWLGRTVST

SEQ ID NO: 520870 - protein, 11 aa, Influenza virus
DDVWMGRTISK

SEQ ID NO: 520871 - protein, 11 aa, Influenza virus
DDVWMGRTISM

SEQ ID NO: 520872 - protein, 11 aa, Influenza virus
DDVWMGRTISR

SEQ ID NO: 520873 - protein, 11 aa, Influenza virus
DDWSGYSGSFI

SEQ ID NO: 520874 - protein, 11 aa, Influenza virus
DDYQLIPMISK

SEQ ID NO: 520875 - protein, 11 aa, Influenza virus
DEAINNRIKIN

SEQ ID NO: 520876 - protein, 11 aa, Influenza virus
DEALKMTIASD

SEQ ID NO: 520877 - protein, 11 aa, Influenza virus
DECIEKVRNGT

SEQ ID NO: 520878 - protein, 11 aa, Influenza virus
DECRFYALSQG

SEQ ID NO: 520879 - protein, 11 aa, Influenza virus
DECRTFFLTQG

SEQ ID NO: 520880 - protein, 11 aa, Influenza virus
DEEGTGIAADK

SEQ ID NO: 520881 - protein, 11 aa, Influenza virus
DEESRARIKTR

SEQ ID NO: 520882 - protein, 11 aa, Influenza virus
DEFCYTLITDG

SEQ ID NO: 520883 - protein, 11 aa, Influenza virus
DEFCYTLMTDG

SEQ ID NO: 520884 - protein, 11 aa, Influenza virus
DEFCYTLVTDG

SEQ ID NO: 520885 - protein, 11 aa, Influenza virus
DEFQLIPMISK

SEQ ID NO: 520886 - protein, 11 aa, Influenza virus
DEGDGCFNFFH

SEQ ID NO: 520887 - protein, 11 aa, Influenza virus
DEGDGCFNLLH

SEQ ID NO: 520888 - protein, 11 aa, Influenza virus
DEGDGCFSILH

SEQ ID NO: 520889 - protein, 11 aa, Influenza virus
DEGDGCFSLLH

SEQ ID NO: 520890 - protein, 11 aa, Influenza virus
DEGLPQSGRIV

SEQ ID NO: 520891 - protein, 11 aa, Influenza virus
DEGNGCFELLH

SEQ ID NO: 520892 - protein, 11 aa, Influenza virus
DEGNGCFTFYH

SEQ ID NO: 520893 - protein, 11 aa, Influenza virus
DEHDANVRNLH

SEQ ID NO: 520894 - protein, 11 aa, Influenza virus
DEHDSNVENLF

SEQ ID NO: 520895 - protein, 11 aa, Influenza virus
DEHDSNVKNLF

SEQ ID NO: 520896 - protein, 11 aa, Influenza virus
DEICIGYLSNN

SEQ ID NO: 520897 - protein, 11 aa, Influenza virus
DEICIGYMSNN

SEQ ID NO: 520898 - protein, 11 aa, Influenza virus
DEIGEDIAPIE

SEQ ID NO: 520899 - protein, 11 aa, Influenza virus
DEIGEDLAPIE

SEQ ID NO: 520900 - protein, 11 aa, Influenza virus
DEIGEDVAPIE

SEQ ID NO: 520901 - protein, 11 aa, Influenza virus
DEITTKINNII

SEQ ID NO: 520902 - protein, 11 aa, Influenza virus
DELCPSPLKLV

SEQ ID NO: 520903 - protein, 11 aa, Influenza virus
DELIGKTSWSY

SEQ ID NO: 520904 - protein, 11 aa, Influenza virus
DEQMYQKCCNL

SEQ ID NO: 520905 - protein, 11 aa, Influenza virus
DEQMYQKCCSL

SEQ ID NO: 520906 - protein, 11 aa, Influenza virus
DEQMYQKCCTL

SEQ ID NO: 520907 - protein, 11 aa, Influenza virus
DEQMYQRCCNL

SEQ ID NO: 520908 - protein, 11 aa, Influenza virus
DEQNKLYGAGN

SEQ ID NO: 520909 - protein, 11 aa, Influenza virus
DEQNKLYGTGN

SEQ ID NO: 520910 - protein, 11 aa, Influenza virus
DERGLFGAIAG

SEQ ID NO: 520911 - protein, 11 aa, Influenza virus
DERGNPGVKGW

SEQ ID NO: 520912 - protein, 11 aa, Influenza virus
DERMYQKCCNL

SEQ ID NO: 520913 - protein, 11 aa, Influenza virus
DERRNKYLEEH

SEQ ID NO: 520914 - protein, 11 aa, Influenza virus
DERRNRYLEEH

SEQ ID NO: 520915 - protein, 11 aa, Influenza virus
DESCEGECFYS

SEQ ID NO: 520916 - protein, 11 aa, Influenza virus
DEVDQSLIIAA

SEQ ID NO: 520917 - protein, 11 aa, Influenza virus
DEVKRRLSANA

SEQ ID NO: 520918 - protein, 11 aa, Influenza virus
DEVKRRLSTNA

SEQ ID NO: 520919 - protein, 11 aa, Influenza virus
DEVRRRLSANA

SEQ ID NO: 520920 - protein, 11 aa, Influenza virus
DEVRRRLSTNA

SEQ ID NO: 520921 - protein, 11 aa, Influenza virus
DEVRRRLSVNA

SEQ ID NO: 520922 - protein, 11 aa, Influenza virus
DEVSWTSNSIV

SEQ ID NO: 520923 - protein, 11 aa, Influenza virus
DEVWWTSNSIV

SEQ ID NO: 520924 - protein, 11 aa, Influenza virus
DEYKNTGDSDI

SEQ ID NO: 520925 - protein, 11 aa, Influenza virus
DEYKNTRDSDI

SEQ ID NO: 520926 - protein, 11 aa, Influenza virus
DEYKNTRDSNI

SEQ ID NO: 520927 - protein, 11 aa, Influenza virus
DFEKEGYSLVG

SEQ ID NO: 520928 - protein, 11 aa, Influenza virus
DFEREGYSLVG

SEQ ID NO: 520929 - protein, 11 aa, Influenza virus
DFHDSNVKNLY

SEQ ID NO: 520930 - protein, 11 aa, Influenza virus
DFHDSNVKSLY

SEQ ID NO: 520931 - protein, 11 aa, Influenza virus
DFHDSNVRNLY

SEQ ID NO: 520932 - protein, 11 aa, Influenza virus
DFHWMLLDPGD

SEQ ID NO: 520933 - protein, 11 aa, Influenza virus
DFICVGWSSTS

SEQ ID NO: 520934 - protein, 11 aa, Influenza virus
DFICVGWSSTT

SEQ ID NO: 520935 - protein, 11 aa, Influenza virus
DFIKWNVTYTG

SEQ ID NO: 520936 - protein, 11 aa, Influenza virus
DFKSTQAAINQ

SEQ ID NO: 520937 - protein, 11 aa, Influenza virus
DFLCVGWSSTS

SEQ ID NO: 520938 - protein, 11 aa, Influenza virus
DFMCVGWSSTT

SEQ ID NO: 520939 - protein, 11 aa, Influenza virus
DFQLIPMISKC

SEQ ID NO: 520940 - protein, 11 aa, Influenza virus
DFQLIPMISKS

SEQ ID NO: 520941 - protein, 11 aa, Influenza virus
DFQLIPMISNC

SEQ ID NO: 520942 - protein, 11 aa, Influenza virus
DFSKWNVTYTG

SEQ ID NO: 520943 - protein, 11 aa, Influenza virus
DFTKWNVTHTG

SEQ ID NO: 520944 - protein, 11 aa, Influenza virus
DFTKWNVTYTG

SEQ ID NO: 520945 - protein, 11 aa, Influenza virus
DGADIKSHAYI

SEQ ID NO: 520946 - protein, 11 aa, Influenza virus
DGADINLHAYI

SEQ ID NO: 520947 - protein, 11 aa, Influenza virus
DGADINLMPIY

SEQ ID NO: 520948 - protein, 11 aa, Influenza virus
DGAILPFDIDK

SEQ ID NO: 520949 - protein, 11 aa, Influenza virus
DGAILPFGIDK

SEQ ID NO: 520950 - protein, 11 aa, Influenza virus
DGALLPFDIDK

SEQ ID NO: 520951 - protein, 11 aa, Influenza virus
DGALLPFDIDR

SEQ ID NO: 520952 - protein, 11 aa, Influenza virus
DGATSACKRTV

SEQ ID NO: 520953 - protein, 11 aa, Influenza virus
DGAVAVLKYNG

SEQ ID NO: 520954 - protein, 11 aa, Influenza virus
DGCFEILHKCD

SEQ ID NO: 520955 - protein, 11 aa, Influenza virus
DGCFEILHKCN

SEQ ID NO: 520956 - protein, 11 aa, Influenza virus
DGCFEILHRCD

SEQ ID NO: 520957 - protein, 11 aa, Influenza virus
DGCFEILHRCN

SEQ ID NO: 520958 - protein, 11 aa, Influenza virus
DGCFNFFHKCN

SEQ ID NO: 520959 - protein, 11 aa, Influenza virus
DGCFNLLHKCN

SEQ ID NO: 520960 - protein, 11 aa, Influenza virus
DGCFSILHKCN

SEQ ID NO: 520961 - protein, 11 aa, Influenza virus
DGCFSLLHKCN

SEQ ID NO: 520962 - protein, 11 aa, Influenza virus
DGCRFYALSQG

SEQ ID NO: 520963 - protein, 11 aa, Influenza virus
DGDIIFLWGIH

SEQ ID NO: 520964 - protein, 11 aa, Influenza virus
DGDIWVTREPY

SEQ ID NO: 520965 - protein, 11 aa, Influenza virus
DGFIDIWTYNA

SEQ ID NO: 520966 - protein, 11 aa, Influenza virus
DGFIDVWTYNA

SEQ ID NO: 520967 - protein, 11 aa, Influenza virus
DGFLDIWTYNA

SEQ ID NO: 520968 - protein, 11 aa, Influenza virus
DGFLDVWTYNA

SEQ ID NO: 520969 - protein, 11 aa, Influenza virus
DGFLDVWTYNT

SEQ ID NO: 520970 - protein, 11 aa, Influenza virus
DGFLGVWTYNA

SEQ ID NO: 520971 - protein, 11 aa, Influenza virus
DGFLNVWTYNA

SEQ ID NO: 520972 - protein, 11 aa, Influenza virus
DGFMDVWTYNA

SEQ ID NO: 520973 - protein, 11 aa, Influenza virus
DGFRDVWTYNA

SEQ ID NO: 520974 - protein, 11 aa, Influenza virus
DGGHIEECSCY

SEQ ID NO: 520975 - protein, 11 aa, Influenza virus
DGGPNLYNIRN

SEQ ID NO: 520976 - protein, 11 aa, Influenza virus
DGHFVNIELED

SEQ ID NO: 520977 - protein, 11 aa, Influenza virus
DGIGRMTICIQ

SEQ ID NO: 520978 - protein, 11 aa, Influenza virus
DGIGRMTICVQ

SEQ ID NO: 520979 - protein, 11 aa, Influenza virus
DGITNKVNSII

SEQ ID NO: 520980 - protein, 11 aa, Influenza virus
DGKAPISLGDC

SEQ ID NO: 520981 - protein, 11 aa, Influenza virus
DGKAWLHICVT

SEQ ID NO: 520982 - protein, 11 aa, Influenza virus
DGKAWLHVCIT

SEQ ID NO: 520983 - protein, 11 aa, Influenza virus
DGKAWLHVCVT

SEQ ID NO: 520984 - protein, 11 aa, Influenza virus
DGKEWLHVCIT

SEQ ID NO: 520985 - protein, 11 aa, Influenza virus
DGKEWMHICMT

SEQ ID NO: 520986 - protein, 11 aa, Influenza virus
DGKEWMHVCIT

SEQ ID NO: 520987 - protein, 11 aa, Influenza virus
DGKEWMHVCMA

SEQ ID NO: 520988 - protein, 11 aa, Influenza virus
DGKEWMHVCMT

SEQ ID NO: 520989 - protein, 11 aa, Influenza virus
DGKGCFEIYHA

SEQ ID NO: 520990 - protein, 11 aa, Influenza virus
DGKGCFEIYHK

SEQ ID NO: 520991 - protein, 11 aa, Influenza virus
DGKGCFEIYHN

SEQ ID NO: 520992 - protein, 11 aa, Influenza virus
DGKGCFEIYHT

SEQ ID NO: 520993 - protein, 11 aa, Influenza virus
DGKSSACKRAN

SEQ ID NO: 520994 - protein, 11 aa, Influenza virus
DGKVECVCRDN

SEQ ID NO: 520995 - protein, 11 aa, Influenza virus
DGLLDVWTYNA

SEQ ID NO: 520996 - protein, 11 aa, Influenza virus
DGLQSSDDFAL

SEQ ID NO: 520997 - protein, 11 aa, Influenza virus
DGNGCFEIFHQ

SEQ ID NO: 520998 - protein, 11 aa, Influenza virus
DGNIIFLWGIH

SEQ ID NO: 520999 - protein, 11 aa, Influenza virus
DGPAANNADHR

SEQ ID NO: 521000 - protein, 11 aa, Influenza virus
DGPAANSADHR

SEQ ID NO: 521001 - protein, 11 aa, Influenza virus
DGPAANSAHHR

SEQ ID NO: 521002 - protein, 11 aa, Influenza virus
DGPANKQASYK

SEQ ID NO: 521003 - protein, 11 aa, Influenza virus
DGPANNQASYK

SEQ ID NO: 521004 - protein, 11 aa, Influenza virus
DGPANNQASYR

SEQ ID NO: 521005 - protein, 11 aa, Influenza virus
DGPANSQASYK

SEQ ID NO: 521006 - protein, 11 aa, Influenza virus
DGPANSQAYTK

SEQ ID NO: 521007 - protein, 11 aa, Influenza virus
DGPASNQASYK

SEQ ID NO: 521008 - protein, 11 aa, Influenza virus
DGPGWLTIGIT

SEQ ID NO: 521009 - protein, 11 aa, Influenza virus
DGPGWLTLGIT

SEQ ID NO: 521010 - protein, 11 aa, Influenza virus
DGPSDAQAFYK

SEQ ID NO: 521011 - protein, 11 aa, Influenza virus
DGPSNAQAFYK

SEQ ID NO: 521012 - protein, 11 aa, Influenza virus
DGQDCDLINGA

SEQ ID NO: 521013 - protein, 11 aa, Influenza virus
DGQRSWMKIYW

SEQ ID NO: 521014 - protein, 11 aa, Influenza virus
DGQRSWMKLYW

SEQ ID NO: 521015 - protein, 11 aa, Influenza virus
DGQSGRIDFHW

SEQ ID NO: 521016 - protein, 11 aa, Influenza virus
DGRAWLHVCVT

SEQ ID NO: 521017 - protein, 11 aa, Influenza virus
DGRGCFEIYHK

SEQ ID NO: 521018 - protein, 11 aa, Influenza virus
DGSANSQAYTK

SEQ ID NO: 521019 - protein, 11 aa, Influenza virus
DGSASGKADTR

SEQ ID NO: 521020 - protein, 11 aa, Influenza virus
DGSASGQAYTK

SEQ ID NO: 521021 - protein, 11 aa, Influenza virus
DGSASGRADTK

SEQ ID NO: 521022 - protein, 11 aa, Influenza virus
DGSASGRADTR

SEQ ID NO: 521023 - protein, 11 aa, Influenza virus
DGSASSQAHTK

SEQ ID NO: 521024 - protein, 11 aa, Influenza virus
DGSASSQAYTK

SEQ ID NO: 521025 - protein, 11 aa, Influenza virus
DGSATGPADTR

SEQ ID NO: 521026 - protein, 11 aa, Influenza virus
DGSATGPAETR

SEQ ID NO: 521027 - protein, 11 aa, Influenza virus
DGSGWLTLGIT

SEQ ID NO: 521028 - protein, 11 aa, Influenza virus
DGSIGKVCRTL

SEQ ID NO: 521029 - protein, 11 aa, Influenza virus
DGSSSACLRGG

SEQ ID NO: 521030 - protein, 11 aa, Influenza virus
DGSYFFGDNAE

SEQ ID NO: 521031 - protein, 11 aa, Influenza virus
DGTACFEIFHK

SEQ ID NO: 521032 - protein, 11 aa, Influenza virus
DGTAFRGLIST

SEQ ID NO: 521033 - protein, 11 aa, Influenza virus
DGTGCFEIFHK

SEQ ID NO: 521034 - protein, 11 aa, Influenza virus
DGTGCFEIFHR

SEQ ID NO: 521035 - protein, 11 aa, Influenza virus
DGTGCFEILHK

SEQ ID NO: 521036 - protein, 11 aa, Influenza virus
DGTIAGFIEGG

SEQ ID NO: 521037 - protein, 11 aa, Influenza virus
DGVCPVVFTDG

SEQ ID NO: 521038 - protein, 11 aa, Influenza virus
DGVGRMTICIQ

SEQ ID NO: 521039 - protein, 11 aa, Influenza virus
DGVGRMTICVQ

SEQ ID NO: 521040 - protein, 11 aa, Influenza virus
DGVTASCLDKG

SEQ ID NO: 521041 - protein, 11 aa, Influenza virus
DGVTASCLDRG

SEQ ID NO: 521042 - protein, 11 aa, Influenza virus
DGVTASCRDNG

SEQ ID NO: 521043 - protein, 11 aa, Influenza virus
DGVTNKVNSII

SEQ ID NO: 521044 - protein, 11 aa, Influenza virus
DGVWIGRTKSL

SEQ ID NO: 521045 - protein, 11 aa, Influenza virus
DGVYKALSIYS

SEQ ID NO: 521046 - protein, 11 aa, Influenza virus
DGWINSPNHAK

SEQ ID NO: 521047 - protein, 11 aa, Influenza virus
DGWYGFHHSNA

SEQ ID NO: 521048 - protein, 11 aa, Influenza virus
DGWYGFHHSNS

SEQ ID NO: 521049 - protein, 11 aa, Influenza virus
DGWYGFKHQNA

SEQ ID NO: 521050 - protein, 11 aa, Influenza virus
DGWYGFRHHNS

SEQ ID NO: 521051 - protein, 11 aa, Influenza virus
DGWYGFRHLNS

SEQ ID NO: 521052 - protein, 11 aa, Influenza virus
DGWYGFRHQKA

SEQ ID NO: 521053 - protein, 11 aa, Influenza virus
DGWYGFRHQNA

SEQ ID NO: 521054 - protein, 11 aa, Influenza virus
DGWYGFRHQNS

SEQ ID NO: 521055 - protein, 11 aa, Influenza virus
DGWYGFRHQNT

SEQ ID NO: 521056 - protein, 11 aa, Influenza virus
DGWYGFRYQNS

SEQ ID NO: 521057 - protein, 11 aa, Influenza virus
DGWYGYHHENS

SEQ ID NO: 521058 - protein, 11 aa, Influenza virus
DGWYGYHHQNE

SEQ ID NO: 521059 - protein, 11 aa, Influenza virus
DGWYGYHHQNG

SEQ ID NO: 521060 - protein, 11 aa, Influenza virus
DGWYGYHHSND

SEQ ID NO: 521061 - protein, 11 aa, Influenza virus
DGWYGYKHQNA

SEQ ID NO: 521062 - protein, 11 aa, Influenza virus
DGWYGYRHQNA

SEQ ID NO: 521063 - protein, 11 aa, Influenza virus
DHAQYREEALL

SEQ ID NO: 521064 - protein, 11 aa, Influenza virus
DHCMESIRNNT

SEQ ID NO: 521065 - protein, 11 aa, Influenza virus
DHEGEGIPLYD

SEQ ID NO: 521066 - protein, 11 aa, Influenza virus
DHICIGYHANN

SEQ ID NO: 521067 - protein, 11 aa, Influenza virus
DHIEVTNATEL

SEQ ID NO: 521068 - protein, 11 aa, Influenza virus
DHKDYEEEAKL

SEQ ID NO: 521069 - protein, 11 aa, Influenza virus
DHKEYEEEAKL

SEQ ID NO: 521070 - protein, 11 aa, Influenza virus
DHMAIIKKYTS

SEQ ID NO: 521071 - protein, 11 aa, Influenza virus
DHMAIIKRYTS

SEQ ID NO: 521072 - protein, 11 aa, Influenza virus
DHNIYRDEAIN

SEQ ID NO: 521073 - protein, 11 aa, Influenza virus
DHSDNADKICL

SEQ ID NO: 521074 - protein, 11 aa, Influenza virus
DHSQYREEALL

SEQ ID NO: 521075 - protein, 11 aa, Influenza virus
DHTQYREEALL

SEQ ID NO: 521076 - protein, 11 aa, Influenza virus
DHTSQYLCTGV

SEQ ID NO: 521077 - protein, 11 aa, Influenza virus
DICYPGKFTNE

SEQ ID NO: 521078 - protein, 11 aa, Influenza virus
DICYPGRFTNE

SEQ ID NO: 521079 - protein, 11 aa, Influenza virus
DIDIYCICRDN

SEQ ID NO: 521080 - protein, 11 aa, Influenza virus
DIDQSLIIAAR

SEQ ID NO: 521081 - protein, 11 aa, Influenza virus
DIDVYCICRDN

SEQ ID NO: 521082 - protein, 11 aa, Influenza virus
DIDVYCVCRDN

SEQ ID NO: 521083 - protein, 11 aa, Influenza virus
DIEAMASQGTK

SEQ ID NO: 521084 - protein, 11 aa, Influenza virus
DIEAMATQGTK

SEQ ID NO: 521085 - protein, 11 aa, Influenza virus
DIEIMASQGTK

SEQ ID NO: 521086 - protein, 11 aa, Influenza virus
DIFVIREPFIS

SEQ ID NO: 521087 - protein, 11 aa, Influenza virus
DIFVMREPFIS

SEQ ID NO: 521088 - protein, 11 aa, Influenza virus
DIIDNDNWSGY

SEQ ID NO: 521089 - protein, 11 aa, Influenza virus
DIIDNNNWSGY

SEQ ID NO: 521090 - protein, 11 aa, Influenza virus
DIIFLWGIHHP

SEQ ID NO: 521091 - protein, 11 aa, Influenza virus
DIILWFSFGAS

SEQ ID NO: 521092 - protein, 11 aa, Influenza virus
DIILWFSFGES

SEQ ID NO: 521093 - protein, 11 aa, Influenza virus
DIILWFSFSIS

SEQ ID NO: 521094 - protein, 11 aa, Influenza virus
DIILWISFSIS

SEQ ID NO: 521095 - protein, 11 aa, Influenza virus
DIILWISFSMS

SEQ ID NO: 521096 - protein, 11 aa, Influenza virus
DIILWVSFSIS

SEQ ID NO: 521097 - protein, 11 aa, Influenza virus
DIINGALGSPG

SEQ ID NO: 521098 - protein, 11 aa, Influenza virus
DIIVFNTIGNL

SEQ ID NO: 521099 - protein, 11 aa, Influenza virus
DILDGVTASCR

SEQ ID NO: 521100 - protein, 11 aa, Influenza virus
DILEGTTASCQ

SEQ ID NO: 521101 - protein, 11 aa, Influenza virus
DILEKAHNGKL

SEQ ID NO: 521102 - protein, 11 aa, Influenza virus
DILEKTHNGKL

SEQ ID NO: 521103 - protein, 11 aa, Influenza virus
DILEKVHNGKL

SEQ ID NO: 521104 - protein, 11 aa, Influenza virus
DILERTHNGKL

SEQ ID NO: 521105 - protein, 11 aa, Influenza virus
DILHKCDNECM

SEQ ID NO: 521106 - protein, 11 aa, Influenza virus
DILHKCDNKCM

SEQ ID NO: 521107 - protein, 11 aa, Influenza virus
DILHKCNNECM

SEQ ID NO: 521108 - protein, 11 aa, Influenza virus
DILKHNPTEEQ

SEQ ID NO: 521109 - protein, 11 aa, Influenza virus
DILKQNPTEEQ

SEQ ID NO: 521110 - protein, 11 aa, Influenza virus
DILRQNPSEEQ

SEQ ID NO: 521111 - protein, 11 aa, Influenza virus
DILRQNPTEEQ

SEQ ID NO: 521112 - protein, 11 aa, Influenza virus
DILRQNSTEEQ

SEQ ID NO: 521113 - protein, 11 aa, Influenza virus
DILRTQESECQ

SEQ ID NO: 521114 - protein, 11 aa, Influenza virus
DILRTQESECV

SEQ ID NO: 521115 - protein, 11 aa, Influenza virus
DILRTQESSCS

SEQ ID NO: 521116 - protein, 11 aa, Influenza virus
DILRTQESSCT

SEQ ID NO: 521117 - protein, 11 aa, Influenza virus
DILVTREPYVS

SEQ ID NO: 521118 - protein, 11 aa, Influenza virus
DIMQNKLNNVI

SEQ ID NO: 521119 - protein, 11 aa, Influenza virus
DIMRTQESSCT

SEQ ID NO: 521120 - protein, 11 aa, Influenza virus
DINIAEYSIDS

SEQ ID NO: 521121 - protein, 11 aa, Influenza virus
DINIMASQGTK

SEQ ID NO: 521122 - protein, 11 aa, Influenza virus
DINLHAYISFR

SEQ ID NO: 521123 - protein, 11 aa, Influenza virus
DINMADYSIDS

SEQ ID NO: 521124 - protein, 11 aa, Influenza virus
DINMEDYSIDS

SEQ ID NO: 521125 - protein, 11 aa, Influenza virus
DIRTATREGKH

SEQ ID NO: 521126 - protein, 11 aa, Influenza virus
DISMEDYSIDS

SEQ ID NO: 521127 - protein, 11 aa, Influenza virus
DISMEDYSIGS

SEQ ID NO: 521128 - protein, 11 aa, Influenza virus
DITIGSICMVT

SEQ ID NO: 521129 - protein, 11 aa, Influenza virus
DIVLVMKRKRD

SEQ ID NO: 521130 - protein, 11 aa, Influenza virus
DIVNAALGSPG

SEQ ID NO: 521131 - protein, 11 aa, Influenza virus
DIVNGALGSPG

SEQ ID NO: 521132 - protein, 11 aa, Influenza virus
DIVNSALGSPG

SEQ ID NO: 521133 - protein, 11 aa, Influenza virus
DIWAYNAELIV

SEQ ID NO: 521134 - protein, 11 aa, Influenza virus
DIWAYNAELLV

SEQ ID NO: 521135 - protein, 11 aa, Influenza virus
DIWITREPYVS

SEQ ID NO: 521136 - protein, 11 aa, Influenza virus
DIWSYNAKLLV

SEQ ID NO: 521137 - protein, 11 aa, Influenza virus
DIWSYNAQLLV

SEQ ID NO: 521138 - protein, 11 aa, Influenza virus
DIWSYNARLLV

SEQ ID NO: 521139 - protein, 11 aa, Influenza virus
DIWTYNAELLV

SEQ ID NO: 521140 - protein, 11 aa, Influenza virus
DIWTYQAELLV

SEQ ID NO: 521141 - protein, 11 aa, Influenza virus
DIWVTRELYVS

SEQ ID NO: 521142 - protein, 11 aa, Influenza virus
DIWVTREPYAS

SEQ ID NO: 521143 - protein, 11 aa, Influenza virus
DIWVTREPYVS

SEQ ID NO: 521144 - protein, 11 aa, Influenza virus
DIWVTRVPYVS

SEQ ID NO: 521145 - protein, 11 aa, Influenza virus
DIYCICRDNWK

SEQ ID NO: 521146 - protein, 11 aa, Influenza virus
DIYCVCRDNWK

SEQ ID NO: 521147 - protein, 11 aa, Influenza virus
DKASTQKAIDE

SEQ ID NO: 521148 - protein, 11 aa, Influenza virus
DKASTQKAINE

SEQ ID NO: 521149 - protein, 11 aa, Influenza virus
DKAVKLYKKLK

SEQ ID NO: 521150 - protein, 11 aa, Influenza virus
DKAVKLYRKLK

SEQ ID NO: 521151 - protein, 11 aa, Influenza virus
DKCYQFALGQG

SEQ ID NO: 521152 - protein, 11 aa, Influenza virus
DKDSNGVQDII

SEQ ID NO: 521153 - protein, 11 aa, Influenza virus
DKEPMGFRYSG

SEQ ID NO: 521154 - protein, 11 aa, Influenza virus
DKESMGFRYSG

SEQ ID NO: 521155 - protein, 11 aa, Influenza virus
DKESTQKAIDQ

SEQ ID NO: 521156 - protein, 11 aa, Influenza virus
DKESTQKAIDR

SEQ ID NO: 521157 - protein, 11 aa, Influenza virus
DKGNGCFEIFH

SEQ ID NO: 521158 - protein, 11 aa, Influenza virus
DKGSIQSDKPF

SEQ ID NO: 521159 - protein, 11 aa, Influenza virus
DKHDSNVKNLF

SEQ ID NO: 521160 - protein, 11 aa, Influenza virus
DKHSNGTIKDR

SEQ ID NO: 521161 - protein, 11 aa, Influenza virus
DKHSNGTMKDR

SEQ ID NO: 521162 - protein, 11 aa, Influenza virus
DKHSNGTVKDR

SEQ ID NO: 521163 - protein, 11 aa, Influenza virus
DKHSNNTVKDR

SEQ ID NO: 521164 - protein, 11 aa, Influenza virus
DKHSSGTVKDR

SEQ ID NO: 521165 - protein, 11 aa, Influenza virus
DKICIGYHANN

SEQ ID NO: 521166 - protein, 11 aa, Influenza virus
DKICIGYLSNN

SEQ ID NO: 521167 - protein, 11 aa, Influenza virus
DKICIGYQTNN

SEQ ID NO: 521168 - protein, 11 aa, Influenza virus
DKICLGHHAVA

SEQ ID NO: 521169 - protein, 11 aa, Influenza virus
DKICLGHHAVP

SEQ ID NO: 521170 - protein, 11 aa, Influenza virus
DKICLGHHAVS

SEQ ID NO: 521171 - protein, 11 aa, Influenza virus
DKICLGHHAVT

SEQ ID NO: 521172 - protein, 11 aa, Influenza virus
DKICVGYLSTN

SEQ ID NO: 521173 - protein, 11 aa, Influenza virus
DKIDDQIEDLW

SEQ ID NO: 521174 - protein, 11 aa, Influenza virus
DKIDDQIEELW

SEQ ID NO: 521175 - protein, 11 aa, Influenza virus
DKIDDQIEGLW

SEQ ID NO: 521176 - protein, 11 aa, Influenza virus
DKIDDQIENLW

SEQ ID NO: 521177 - protein, 11 aa, Influenza virus
DKIDTLTETGV

SEQ ID NO: 521178 - protein, 11 aa, Influenza virus
DKINDQIEDLW

SEQ ID NO: 521179 - protein, 11 aa, Influenza virus
DKITFEATGNL

SEQ ID NO: 521180 - protein, 11 aa, Influenza virus
DKITNKINNIV

SEQ ID NO: 521181 - protein, 11 aa, Influenza virus
DKITNKVNNIV

SEQ ID NO: 521182 - protein, 11 aa, Influenza virus
DKLTQGRQTFD

SEQ ID NO: 521183 - protein, 11 aa, Influenza virus
DKLTQGRQTYD

SEQ ID NO: 521184 - protein, 11 aa, Influenza virus
DKLYIWGIHHP

SEQ ID NO: 521185 - protein, 11 aa, Influenza virus
DKLYIWGVHHP

SEQ ID NO: 521186 - protein, 11 aa, Influenza virus
DKLYVWGIHHP

SEQ ID NO: 521187 - protein, 11 aa, Influenza virus
DKLYVWGVHHP

SEQ ID NO: 521188 - protein, 11 aa, Influenza virus
DKMNGNYDSIR

SEQ ID NO: 521189 - protein, 11 aa, Influenza virus
DKMNREFEVMN

SEQ ID NO: 521190 - protein, 11 aa, Influenza virus
DKMNREFEVVD

SEQ ID NO: 521191 - protein, 11 aa, Influenza virus
DKMNREFEVVN

SEQ ID NO: 521192 - protein, 11 aa, Influenza virus
DKMNREFGVVN

SEQ ID NO: 521193 - protein, 11 aa, Influenza virus
DKNALGDCPKY

SEQ ID NO: 521194 - protein, 11 aa, Influenza virus
DKNALGECPKY

SEQ ID NO: 521195 - protein, 11 aa, Influenza virus
DKNSNGVQDII

SEQ ID NO: 521196 - protein, 11 aa, Influenza virus
DKPFQNVSRIA

SEQ ID NO: 521197 - protein, 11 aa, Influenza virus
DKQTKTMTITF

SEQ ID NO: 521198 - protein, 11 aa, Influenza virus
DKRIGSCTSPC

SEQ ID NO: 521199 - protein, 11 aa, Influenza virus
DKTLDLHDANV

SEQ ID NO: 521200 - protein, 11 aa, Influenza virus
DKTLDMHDANV

SEQ ID NO: 521201 - protein, 11 aa, Influenza virus
DKTLNMHDANV

SEQ ID NO: 521202 - protein, 11 aa, Influenza virus
DKTNQQFELID

SEQ ID NO: 521203 - protein, 11 aa, Influenza virus
DKTNQQFEMID

SEQ ID NO: 521204 - protein, 11 aa, Influenza virus
DKTPYRSLIRF

SEQ ID NO: 521205 - protein, 11 aa, Influenza virus
DKTSTQKAINE

SEQ ID NO: 521206 - protein, 11 aa, Influenza virus
DKVCTKGKKAV

SEQ ID NO: 521207 - protein, 11 aa, Influenza virus
DKVDTLTENGV

SEQ ID NO: 521208 - protein, 11 aa, Influenza virus
DKVDTLTETGV

SEQ ID NO: 521209 - protein, 11 aa, Influenza virus
DKVRLQLKDNA

SEQ ID NO: 521210 - protein, 11 aa, Influenza virus
DKVRLQLRDNA

SEQ ID NO: 521211 - protein, 11 aa, Influenza virus
DKVRMQLKDNA

SEQ ID NO: 521212 - protein, 11 aa, Influenza virus
DKVRMQLRDNA

SEQ ID NO: 521213 - protein, 11 aa, Influenza virus
DKVRMQLRDNV

SEQ ID NO: 521214 - protein, 11 aa, Influenza virus
DKVSTQKAINE

SEQ ID NO: 521215 - protein, 11 aa, Influenza virus
DKVSTQKALNE

SEQ ID NO: 521216 - protein, 11 aa, Influenza virus
DKVWWTSNSII

SEQ ID NO: 521217 - protein, 11 aa, Influenza virus
DKVWWTSNSIV

SEQ ID NO: 521218 - protein, 11 aa, Influenza virus
DKYHQIEKEFE

SEQ ID NO: 521219 - protein, 11 aa, Influenza virus
DLADSEMDKLY

SEQ ID NO: 521220 - protein, 11 aa, Influenza virus
DLADSEMKKLY

SEQ ID NO: 521221 - protein, 11 aa, Influenza virus
DLADSEMLNLY

SEQ ID NO: 521222 - protein, 11 aa, Influenza virus
DLADSEMNKLY

SEQ ID NO: 521223 - protein, 11 aa, Influenza virus
DLADSEMNNLY

SEQ ID NO: 521224 - protein, 11 aa, Influenza virus
DLADSEMSKLY

SEQ ID NO: 521225 - protein, 11 aa, Influenza virus
DLANSEMNKLY

SEQ ID NO: 521226 - protein, 11 aa, Influenza virus
DLDYQIGYICS

SEQ ID NO: 521227 - protein, 11 aa, Influenza virus
DLDYQIGYVCS

SEQ ID NO: 521228 - protein, 11 aa, Influenza virus
DLEALMEWIKT

SEQ ID NO: 521229 - protein, 11 aa, Influenza virus
DLEALMEWLKT

SEQ ID NO: 521230 - protein, 11 aa, Influenza virus
DLEKYIEDTKI

SEQ ID NO: 521231 - protein, 11 aa, Influenza virus
DLEKYVEDTKI

SEQ ID NO: 521232 - protein, 11 aa, Influenza virus
DLEKYVEDTKV

SEQ ID NO: 521233 - protein, 11 aa, Influenza virus
DLENYVEDTKI

SEQ ID NO: 521234 - protein, 11 aa, Influenza virus
DLERYVEDTKI

SEQ ID NO: 521235 - protein, 11 aa, Influenza virus
DLGAPLELRDC

SEQ ID NO: 521236 - protein, 11 aa, Influenza virus
DLGNGCFEFWH

SEQ ID NO: 521237 - protein, 11 aa, Influenza virus
DLGPATAQMAL

SEQ ID NO: 521238 - protein, 11 aa, Influenza virus
DLGSCGILGTI

SEQ ID NO: 521239 - protein, 11 aa, Influenza virus
DLGSPLELRDC

SEQ ID NO: 521240 - protein, 11 aa, Influenza virus
DLGTPLELRDC

SEQ ID NO: 521241 - protein, 11 aa, Influenza virus
DLHDANVKNLH

SEQ ID NO: 521242 - protein, 11 aa, Influenza virus
DLHDANVRNLH

SEQ ID NO: 521243 - protein, 11 aa, Influenza virus
DLHDSNVKNLH

SEQ ID NO: 521244 - protein, 11 aa, Influenza virus
DLHDSNVKNLY

SEQ ID NO: 521245 - protein, 11 aa, Influenza virus
DLHDSNVRNLH

SEQ ID NO: 521246 - protein, 11 aa, Influenza virus
DLHDSNVRSLH

SEQ ID NO: 521247 - protein, 11 aa, Influenza virus
DLHLEFKADLI

SEQ ID NO: 521248 - protein, 11 aa, Influenza virus
DLHLTGIWDTL

SEQ ID NO: 521249 - protein, 11 aa, Influenza virus
DLHLTGMWDTL

SEQ ID NO: 521250 - protein, 11 aa, Influenza virus
DLHLTGTWDTL

SEQ ID NO: 521251 - protein, 11 aa, Influenza virus
DLIETNHTGTY

SEQ ID NO: 521252 - protein, 11 aa, Influenza virus
DLIETTHTGTY

SEQ ID NO: 521253 - protein, 11 aa, Influenza virus
DLIFLARSALI

SEQ ID NO: 521254 - protein, 11 aa, Influenza virus
DLIFLARSALV

SEQ ID NO: 521255 - protein, 11 aa, Influenza virus
DLIFMARSALI

SEQ ID NO: 521256 - protein, 11 aa, Influenza virus
DLIFSARSALI

SEQ ID NO: 521257 - protein, 11 aa, Influenza virus
DLIGKNSWSYI

SEQ ID NO: 521258 - protein, 11 aa, Influenza virus
DLIGKTSWSYI

SEQ ID NO: 521259 - protein, 11 aa, Influenza virus
DLIIERKEGTD

SEQ ID NO: 521260 - protein, 11 aa, Influenza virus
DLIIERREGAD

SEQ ID NO: 521261 - protein, 11 aa, Influenza virus
DLIIERREGND

SEQ ID NO: 521262 - protein, 11 aa, Influenza virus
DLIIERREGSD

SEQ ID NO: 521263 - protein, 11 aa, Influenza virus
DLIIERREGTD

SEQ ID NO: 521264 - protein, 11 aa, Influenza virus
DLIIERRNSSD

SEQ ID NO: 521265 - protein, 11 aa, Influenza virus
DLILFNTIGNL

SEQ ID NO: 521266 - protein, 11 aa, Influenza virus
DLINGALGSPG

SEQ ID NO: 521267 - protein, 11 aa, Influenza virus
DLIVFNTIGNL

SEQ ID NO: 521268 - protein, 11 aa, Influenza virus
DLKSTQAAIDK

SEQ ID NO: 521269 - protein, 11 aa, Influenza virus
DLKSTQAAIDQ

SEQ ID NO: 521270 - protein, 11 aa, Influenza virus
DLKSTQAAINQ

SEQ ID NO: 521271 - protein, 11 aa, Influenza virus
DLKSTQAAITQ

SEQ ID NO: 521272 - protein, 11 aa, Influenza virus
DLKSTQAAVNQ

SEQ ID NO: 521273 - protein, 11 aa, Influenza virus
DLKSTQTAIDQ

SEQ ID NO: 521274 - protein, 11 aa, Influenza virus
DLLVAMENQHT

SEQ ID NO: 521275 - protein, 11 aa, Influenza virus
DLNFVNRANQR

SEQ ID NO: 521276 - protein, 11 aa, Influenza virus
DLNMGQPFYSH

SEQ ID NO: 521277 - protein, 11 aa, Influenza virus
DLNYQIGYICS

SEQ ID NO: 521278 - protein, 11 aa, Influenza virus
DLRSGYEMLKV

SEQ ID NO: 521279 - protein, 11 aa, Influenza virus
DLRSGYETFKV

SEQ ID NO: 521280 - protein, 11 aa, Influenza virus
DLSFQGRGVFE

SEQ ID NO: 521281 - protein, 11 aa, Influenza virus
DLTDSEMNKLF

SEQ ID NO: 521282 - protein, 11 aa, Influenza virus
DLTDSEMNKLY

SEQ ID NO: 521283 - protein, 11 aa, Influenza virus
DLTDSEMSKLF

SEQ ID NO: 521284 - protein, 11 aa, Influenza virus
DLTDSEMSKLY

SEQ ID NO: 521285 - protein, 11 aa, Influenza virus
DLTFLARSALI

SEQ ID NO: 521286 - protein, 11 aa, Influenza virus
DLTNSEMNKLY

SEQ ID NO: 521287 - protein, 11 aa, Influenza virus
DLVETNHTGTY

SEQ ID NO: 521288 - protein, 11 aa, Influenza virus
DLVETSHTGTY

SEQ ID NO: 521289 - protein, 11 aa, Influenza virus
DLWAYNAELLV

SEQ ID NO: 521290 - protein, 11 aa, Influenza virus
DLWSYNADVLV

SEQ ID NO: 521291 - protein, 11 aa, Influenza virus
DLWSYNAELLI

SEQ ID NO: 521292 - protein, 11 aa, Influenza virus
DLWSYNAELLV

SEQ ID NO: 521293 - protein, 11 aa, Influenza virus
DLWSYNAGLLV

SEQ ID NO: 521294 - protein, 11 aa, Influenza virus
DLWSYNAQLLV

SEQ ID NO: 521295 - protein, 11 aa, Influenza virus
DLYGTQPLSIS

SEQ ID NO: 521296 - protein, 11 aa, Influenza virus
DLYGTQSLSIS

SEQ ID NO: 521297 - protein, 11 aa, Influenza virus
DLYKVATGRVT

SEQ ID NO: 521298 - protein, 11 aa, Influenza virus
DLYLNGREWSY

SEQ ID NO: 521299 - protein, 11 aa, Influenza virus
DLYLSGREWSY

SEQ ID NO: 521300 - protein, 11 aa, Influenza virus
DLYLTGTWDTL

SEQ ID NO: 521301 - protein, 11 aa, Influenza virus
DMADSEMLNLY

SEQ ID NO: 521302 - protein, 11 aa, Influenza virus
DMGDSEMLNLY

SEQ ID NO: 521303 - protein, 11 aa, Influenza virus
DMHDANVKNLH

SEQ ID NO: 521304 - protein, 11 aa, Influenza virus
DMHDANVRNLH

SEQ ID NO: 521305 - protein, 11 aa, Influenza virus
DMSIGITVIKN

SEQ ID NO: 521306 - protein, 11 aa, Influenza virus
DMSIGVAVIKN

SEQ ID NO: 521307 - protein, 11 aa, Influenza virus
DMSIGVTVIKN

SEQ ID NO: 521308 - protein, 11 aa, Influenza virus
DMSIGVTVIRN

SEQ ID NO: 521309 - protein, 11 aa, Influenza virus
DMTDSEMNKLF

SEQ ID NO: 521310 - protein, 11 aa, Influenza virus
DNADKICLGHH

SEQ ID NO: 521311 - protein, 11 aa, Influenza virus
DNAIDEGDGCF

SEQ ID NO: 521312 - protein, 11 aa, Influenza virus
DNAIRFGEGEQ

SEQ ID NO: 521313 - protein, 11 aa, Influenza virus
DNAIRFGESEQ

SEQ ID NO: 521314 - protein, 11 aa, Influenza virus
DNAIRIGEDAH

SEQ ID NO: 521315 - protein, 11 aa, Influenza virus
DNAIRIGEEAH

SEQ ID NO: 521316 - protein, 11 aa, Influenza virus
DNAIRIGEGAH

SEQ ID NO: 521317 - protein, 11 aa, Influenza virus
DNAIRIGENAH

SEQ ID NO: 521318 - protein, 11 aa, Influenza virus
DNAKDEGNGCF

SEQ ID NO: 521319 - protein, 11 aa, Influenza virus
DNAKDLGNGCF

SEQ ID NO: 521320 - protein, 11 aa, Influenza virus
DNAKEIGNGCF

SEQ ID NO: 521321 - protein, 11 aa, Influenza virus
DNAKELGNGCF

SEQ ID NO: 521322 - protein, 11 aa, Influenza virus
DNAKEMGNGCF

SEQ ID NO: 521323 - protein, 11 aa, Influenza virus
DNAKETGNGCF

SEQ ID NO: 521324 - protein, 11 aa, Influenza virus
DNAKEVGNGCF

SEQ ID NO: 521325 - protein, 11 aa, Influenza virus
DNAKEWGNGCF

SEQ ID NO: 521326 - protein, 11 aa, Influenza virus
DNANDLGNGCF

SEQ ID NO: 521327 - protein, 11 aa, Influenza virus
DNARELGNGCF

SEQ ID NO: 521328 - protein, 11 aa, Influenza virus
DNATATVYYDR

SEQ ID NO: 521329 - protein, 11 aa, Influenza virus
DNATATVYYNR

SEQ ID NO: 521330 - protein, 11 aa, Influenza virus
DNAVRFGESEQ

SEQ ID NO: 521331 - protein, 11 aa, Influenza virus
DNAVRIGEDAH

SEQ ID NO: 521332 - protein, 11 aa, Influenza virus
DNCMERIRNNT

SEQ ID NO: 521333 - protein, 11 aa, Influenza virus
DNCMESIRDNT

SEQ ID NO: 521334 - protein, 11 aa, Influenza virus
DNCMESIRNNT

SEQ ID NO: 521335 - protein, 11 aa, Influenza virus
DNDAYAVIHYG

SEQ ID NO: 521336 - protein, 11 aa, Influenza virus
DNDNWSGYSGS

SEQ ID NO: 521337 - protein, 11 aa, Influenza virus
DNEAVAVLKYN

SEQ ID NO: 521338 - protein, 11 aa, Influenza virus
DNECMETIKNG

SEQ ID NO: 521339 - protein, 11 aa, Influenza virus
DNEFTEVEQQI

SEQ ID NO: 521340 - protein, 11 aa, Influenza virus
DNENATATVYY

SEQ ID NO: 521341 - protein, 11 aa, Influenza virus
DNEPGSGDWPD

SEQ ID NO: 521342 - protein, 11 aa, Influenza virus
DNEPGSGNGLM

SEQ ID NO: 521343 - protein, 11 aa, Influenza virus
DNEPGSGNWPD

SEQ ID NO: 521344 - protein, 11 aa, Influenza virus
DNEQTDLYKVA

SEQ ID NO: 521345 - protein, 11 aa, Influenza virus
DNGAVAVLKYK

SEQ ID NO: 521346 - protein, 11 aa, Influenza virus
DNGAVAVLKYN

SEQ ID NO: 521347 - protein, 11 aa, Influenza virus
DNGDGCFEILH

SEQ ID NO: 521348 - protein, 11 aa, Influenza virus
DNGIRIGSKGD

SEQ ID NO: 521349 - protein, 11 aa, Influenza virus
DNGIRIGSKGH

SEQ ID NO: 521350 - protein, 11 aa, Influenza virus
DNGIRIGSRGE

SEQ ID NO: 521351 - protein, 11 aa, Influenza virus
DNGIRIGSRGH

SEQ ID NO: 521352 - protein, 11 aa, Influenza virus
DNGIRVGSRGH

SEQ ID NO: 521353 - protein, 11 aa, Influenza virus
DNGVRIGSKGD

SEQ ID NO: 521354 - protein, 11 aa, Influenza virus
DNGVWIGRTKS

SEQ ID NO: 521355 - protein, 11 aa, Influenza virus
DNGWVSTDKDS

SEQ ID NO: 521356 - protein, 11 aa, Influenza virus
DNHSMSDIEAM

SEQ ID NO: 521357 - protein, 11 aa, Influenza virus
DNHVEVVSAKE

SEQ ID NO: 521358 - protein, 11 aa, Influenza virus
DNIEVTNATEL

SEQ ID NO: 521359 - protein, 11 aa, Influenza virus
DNITFLHNGGL

SEQ ID NO: 521360 - protein, 11 aa, Influenza virus
DNITFSDNGGL

SEQ ID NO: 521361 - protein, 11 aa, Influenza virus
DNITFSHNGGL

SEQ ID NO: 521362 - protein, 11 aa, Influenza virus
DNIYKILSIYS

SEQ ID NO: 521363 - protein, 11 aa, Influenza virus
DNKADHRIYWI

SEQ ID NO: 521364 - protein, 11 aa, Influenza virus
DNKCMETIKNG

SEQ ID NO: 521365 - protein, 11 aa, Influenza virus
DNKHSNDTIHD

SEQ ID NO: 521366 - protein, 11 aa, Influenza virus
DNKHSNDTVHD

SEQ ID NO: 521367 - protein, 11 aa, Influenza virus
DNKHSNGTIHD

SEQ ID NO: 521368 - protein, 11 aa, Influenza virus
DNKNWSGYSGS

SEQ ID NO: 521369 - protein, 11 aa, Influenza virus
DNKTKKMTITF

SEQ ID NO: 521370 - protein, 11 aa, Influenza virus
DNLIGKTSWSY

SEQ ID NO: 521371 - protein, 11 aa, Influenza virus
DNLNWSGYSGS

SEQ ID NO: 521372 - protein, 11 aa, Influenza virus
DNLQAYQKRMG

SEQ ID NO: 521373 - protein, 11 aa, Influenza virus
DNMQNKLNNVI

SEQ ID NO: 521374 - protein, 11 aa, Influenza virus
DNMQNRLNNVI

SEQ ID NO: 521375 - protein, 11 aa, Influenza virus
DNNCIESIRNG

SEQ ID NO: 521376 - protein, 11 aa, Influenza virus
DNNGELRHLFS

SEQ ID NO: 521377 - protein, 11 aa, Influenza virus
DNNIRIGSKGD

SEQ ID NO: 521378 - protein, 11 aa, Influenza virus
DNNKNATNPLT

SEQ ID NO: 521379 - protein, 11 aa, Influenza virus
DNNNWSGYSGS

SEQ ID NO: 521380 - protein, 11 aa, Influenza virus
DNPIRLSGGGD

SEQ ID NO: 521381 - protein, 11 aa, Influenza virus
DNPNWSGYSGS

SEQ ID NO: 521382 - protein, 11 aa, Influenza virus
DNQCMESIRNN

SEQ ID NO: 521383 - protein, 11 aa, Influenza virus
DNQTKKMTITF

SEQ ID NO: 521384 - protein, 11 aa, Influenza virus
DNQTKTMTITF

SEQ ID NO: 521385 - protein, 11 aa, Influenza virus
DNQVFPQLNQT

SEQ ID NO: 521386 - protein, 11 aa, Influenza virus
DNRSGYSGIFS

SEQ ID NO: 521387 - protein, 11 aa, Influenza virus
DNSIRIGSKGD

SEQ ID NO: 521388 - protein, 11 aa, Influenza virus
DNSIRIGSRGD

SEQ ID NO: 521389 - protein, 11 aa, Influenza virus
DNSIRLAAGGA

SEQ ID NO: 521390 - protein, 11 aa, Influenza virus
DNSIRLAAGGD

SEQ ID NO: 521391 - protein, 11 aa, Influenza virus
DNSIRLSAGGA

SEQ ID NO: 521392 - protein, 11 aa, Influenza virus
DNSIRLSAGGD

SEQ ID NO: 521393 - protein, 11 aa, Influenza virus
DNSIRLSAGGH

SEQ ID NO: 521394 - protein, 11 aa, Influenza virus
DNSIRLSAGGN

SEQ ID NO: 521395 - protein, 11 aa, Influenza virus
DNSIRLSASGD

SEQ ID NO: 521396 - protein, 11 aa, Influenza virus
DNSNWSGYSGS

SEQ ID NO: 521397 - protein, 11 aa, Influenza virus
DNSVRIGSKGD

SEQ ID NO: 521398 - protein, 11 aa, Influenza virus
DNSVRLSASGD

SEQ ID NO: 521399 - protein, 11 aa, Influenza virus
DNTKWNENQNP

SEQ ID NO: 521400 - protein, 11 aa, Influenza virus
DNTWLGGTISP

SEQ ID NO: 521401 - protein, 11 aa, Influenza virus
DNTWLGRTISP

SEQ ID NO: 521402 - protein, 11 aa, Influenza virus
DNVKELGNGCF

SEQ ID NO: 521403 - protein, 11 aa, Influenza virus
DNVSWTSNSIV

SEQ ID NO: 521404 - protein, 11 aa, Influenza virus
DNVYKALSIYS

SEQ ID NO: 521405 - protein, 11 aa, Influenza virus
DNVYKILSIYS

SEQ ID NO: 521406 - protein, 11 aa, Influenza virus
DNVYKVLAIYS

SEQ ID NO: 521407 - protein, 11 aa, Influenza virus
DNVYKVLSIYS

SEQ ID NO: 521408 - protein, 11 aa, Influenza virus
DNVYRALSIYS

SEQ ID NO: 521409 - protein, 11 aa, Influenza virus
DNWHASNRPWI

SEQ ID NO: 521410 - protein, 11 aa, Influenza virus
DNWHASNRPWV

SEQ ID NO: 521411 - protein, 11 aa, Influenza virus
DNWHGANRPWV

SEQ ID NO: 521412 - protein, 11 aa, Influenza virus
DNWHGSNRPWI

SEQ ID NO: 521413 - protein, 11 aa, Influenza virus
DNWHGSNRPWL

SEQ ID NO: 521414 - protein, 11 aa, Influenza virus
DNWHGSNRPWV

SEQ ID NO: 521415 - protein, 11 aa, Influenza virus
DNWKGANRPII

SEQ ID NO: 521416 - protein, 11 aa, Influenza virus
DNWKGANRPVI

SEQ ID NO: 521417 - protein, 11 aa, Influenza virus
DNWKGSNRPII

SEQ ID NO: 521418 - protein, 11 aa, Influenza virus
DNWKGSNRPIV

SEQ ID NO: 521419 - protein, 11 aa, Influenza virus
DNWKGSNRPVI

SEQ ID NO: 521420 - protein, 11 aa, Influenza virus
DNWKGSNRPVV

SEQ ID NO: 521421 - protein, 11 aa, Influenza virus
DNWKGSNRPWI

SEQ ID NO: 521422 - protein, 11 aa, Influenza virus
DNWKGSNRPWM

SEQ ID NO: 521423 - protein, 11 aa, Influenza virus
DNWKGSNRPWV

SEQ ID NO: 521424 - protein, 11 aa, Influenza virus
DNWNGMNRPIL

SEQ ID NO: 521425 - protein, 11 aa, Influenza virus
DNWNGMNRPVL

SEQ ID NO: 521426 - protein, 11 aa, Influenza virus
DNWQGANRPII

SEQ ID NO: 521427 - protein, 11 aa, Influenza virus
DNWQGANRPVI

SEQ ID NO: 521428 - protein, 11 aa, Influenza virus
DNWQGSNRPVI

SEQ ID NO: 521429 - protein, 11 aa, Influenza virus
DNWRGANRPVI

SEQ ID NO: 521430 - protein, 11 aa, Influenza virus
DNWRGSNRPIV

SEQ ID NO: 521431 - protein, 11 aa, Influenza virus
DNWRGSNRPWI

SEQ ID NO: 521432 - protein, 11 aa, Influenza virus
DNWRGSNRPWV

SEQ ID NO: 521433 - protein, 11 aa, Influenza virus
DNWSGYSGSFI

SEQ ID NO: 521434 - protein, 11 aa, Influenza virus
DNWSGYSGSFS

SEQ ID NO: 521435 - protein, 11 aa, Influenza virus
DNWTGTNRPIL

SEQ ID NO: 521436 - protein, 11 aa, Influenza virus
DNWTGTNRPVL

SEQ ID NO: 521437 - protein, 11 aa, Influenza virus
DNYGVKGFGFR

SEQ ID NO: 521438 - protein, 11 aa, Influenza virus
DPAAPHGLCYP

SEQ ID NO: 521439 - protein, 11 aa, Influenza virus
DPDECRFYALS

SEQ ID NO: 521440 - protein, 11 aa, Influenza virus
DPDGCRFYALS

SEQ ID NO: 521441 - protein, 11 aa, Influenza virus
DPDHEGEGIPL

SEQ ID NO: 521442 - protein, 11 aa, Influenza virus
DPDPFRLLQNS

SEQ ID NO: 521443 - protein, 11 aa, Influenza virus
DPFKLLQNSQI

SEQ ID NO: 521444 - protein, 11 aa, Influenza virus
DPFKLLQNSQV

SEQ ID NO: 521445 - protein, 11 aa, Influenza virus
DPFKLLQTSQV

SEQ ID NO: 521446 - protein, 11 aa, Influenza virus
DPFRLLQNSQV

SEQ ID NO: 521447 - protein, 11 aa, Influenza virus
DPFRLLQSSQV

SEQ ID NO: 521448 - protein, 11 aa, Influenza virus
DPGAPHGLCYP

SEQ ID NO: 521449 - protein, 11 aa, Influenza virus
DPGDTVTFTFN

SEQ ID NO: 521450 - protein, 11 aa, Influenza virus
DPGIKGFAFLD

SEQ ID NO: 521451 - protein, 11 aa, Influenza virus
DPGVKGFAFLD

SEQ ID NO: 521452 - protein, 11 aa, Influenza virus
DPGVKGFAFLN

SEQ ID NO: 521453 - protein, 11 aa, Influenza virus
DPHLTGTWDTL

SEQ ID NO: 521454 - protein, 11 aa, Influenza virus
DPKGLFGAIAG

SEQ ID NO: 521455 - protein, 11 aa, Influenza virus
DPKKTGGPIYK

SEQ ID NO: 521456 - protein, 11 aa, Influenza virus
DPKKTGGPIYR

SEQ ID NO: 521457 - protein, 11 aa, Influenza virus
DPLASLLEMCH

SEQ ID NO: 521458 - protein, 11 aa, Influenza virus
DPLGCKMYALH

SEQ ID NO: 521459 - protein, 11 aa, Influenza virus
DPLGCKTYALH

SEQ ID NO: 521460 - protein, 11 aa, Influenza virus
DPLGCRMYALH

SEQ ID NO: 521461 - protein, 11 aa, Influenza virus
DPLLSLLEMCH

SEQ ID NO: 521462 - protein, 11 aa, Influenza virus
DPNALLKHRFE

SEQ ID NO: 521463 - protein, 11 aa, Influenza virus
DPNAPHKLCFP

SEQ ID NO: 521464 - protein, 11 aa, Influenza virus
DPNAPHKLCYP

SEQ ID NO: 521465 - protein, 11 aa, Influenza virus
DPNAPNKFCYP

SEQ ID NO: 521466 - protein, 11 aa, Influenza virus
DPNAPNKLCFP

SEQ ID NO: 521467 - protein, 11 aa, Influenza virus
DPNAPNKLCYP

SEQ ID NO: 521468 - protein, 11 aa, Influenza virus
DPNDERGNPGV

SEQ ID NO: 521469 - protein, 11 aa, Influenza virus
DPNECRFYALS

SEQ ID NO: 521470 - protein, 11 aa, Influenza virus
DPNEERGNPGV

SEQ ID NO: 521471 - protein, 11 aa, Influenza virus
DPNEERGSPGV

SEQ ID NO: 521472 - protein, 11 aa, Influenza virus
DPNHEGEGIPL

SEQ ID NO: 521473 - protein, 11 aa, Influenza virus
DPNNEKGNPGV

SEQ ID NO: 521474 - protein, 11 aa, Influenza virus
DPNNERGNPGV

SEQ ID NO: 521475 - protein, 11 aa, Influenza virus
DPNNIDRAVKL

SEQ ID NO: 521476 - protein, 11 aa, Influenza virus
DPNNMARAVKL

SEQ ID NO: 521477 - protein, 11 aa, Influenza virus
DPNNMDKAVKL

SEQ ID NO: 521478 - protein, 11 aa, Influenza virus
DPNNMDRAVKL

SEQ ID NO: 521479 - protein, 11 aa, Influenza virus
DPNTLLKHRFE

SEQ ID NO: 521480 - protein, 11 aa, Influenza virus
DPNVLLKHRFE

SEQ ID NO: 521481 - protein, 11 aa, Influenza virus
DPNWSGYSGSF

SEQ ID NO: 521482 - protein, 11 aa, Influenza virus
DPPYSHGTGTG

SEQ ID NO: 521483 - protein, 11 aa, Influenza virus
DPRMCSLMQGS

SEQ ID NO: 521484 - protein, 11 aa, Influenza virus
DPSAPHGLCYP

SEQ ID NO: 521485 - protein, 11 aa, Influenza virus
DPSAPHRLCYP

SEQ ID NO: 521486 - protein, 11 aa, Influenza virus
DPSGCKMYALH

SEQ ID NO: 521487 - protein, 11 aa, Influenza virus
DPSGYAQTDCV

SEQ ID NO: 521488 - protein, 11 aa, Influenza virus
DPSHEGEGIPL

SEQ ID NO: 521489 - protein, 11 aa, Influenza virus
DPSIMSCDSPS

SEQ ID NO: 521490 - protein, 11 aa, Influenza virus
DPSNMDRAVKL

SEQ ID NO: 521491 - protein, 11 aa, Influenza virus
DPSTISCDSPS

SEQ ID NO: 521492 - protein, 11 aa, Influenza virus
DPSTMSCDSPS

SEQ ID NO: 521493 - protein, 11 aa, Influenza virus
DPSTVSCDSPS

SEQ ID NO: 521494 - protein, 11 aa, Influenza virus
DPSVVSCDSPS

SEQ ID NO: 521495 - protein, 11 aa, Influenza virus
DPTAPHGLCYP

SEQ ID NO: 521496 - protein, 11 aa, Influenza virus
DPTGCKMYALH

SEQ ID NO: 521497 - protein, 11 aa, Influenza virus
DPVKLSGGYKD

SEQ ID NO: 521498 - protein, 11 aa, Influenza virus
DPVKLSSGYKD

SEQ ID NO: 521499 - protein, 11 aa, Influenza virus
DPWVLLNASWF

SEQ ID NO: 521500 - protein, 11 aa, Influenza virus
DPYLNGREWSY

SEQ ID NO: 521501 - protein, 11 aa, Influenza virus
DPYPGNNBNGV

SEQ ID NO: 521502 - protein, 11 aa, Influenza virus
DPYPGNNNKGV

SEQ ID NO: 521503 - protein, 11 aa, Influenza virus
DPYPGNNNNGV

SEQ ID NO: 521504 - protein, 11 aa, Influenza virus
DPYPGSNNNGV

SEQ ID NO: 521505 - protein, 11 aa, Influenza virus
DQAWSYIVERP

SEQ ID NO: 521506 - protein, 11 aa, Influenza virus
DQCMESIRNNT

SEQ ID NO: 521507 - protein, 11 aa, Influenza virus
DQDWSYIVERP

SEQ ID NO: 521508 - protein, 11 aa, Influenza virus
DQELGDAPFLD

SEQ ID NO: 521509 - protein, 11 aa, Influenza virus
DQGAGYAADKE

SEQ ID NO: 521510 - protein, 11 aa, Influenza virus
DQGNGCFEIFH

SEQ ID NO: 521511 - protein, 11 aa, Influenza virus
DQGSGYAADKA

SEQ ID NO: 521512 - protein, 11 aa, Influenza virus
DQGSGYAADKE

SEQ ID NO: 521513 - protein, 11 aa, Influenza virus
DQGTGQAADYK

SEQ ID NO: 521514 - protein, 11 aa, Influenza virus
DQGWSYIVERP

SEQ ID NO: 521515 - protein, 11 aa, Influenza virus
DQICIGHHANN

SEQ ID NO: 521516 - protein, 11 aa, Influenza virus
DQICIGYHANN

SEQ ID NO: 521517 - protein, 11 aa, Influenza virus
DQICIGYHSNN

SEQ ID NO: 521518 - protein, 11 aa, Influenza virus
DQICVGYHANN

SEQ ID NO: 521519 - protein, 11 aa, Influenza virus
DQICVGYHSNN

SEQ ID NO: 521520 - protein, 11 aa, Influenza virus
DQIEDLWAYNA

SEQ ID NO: 521521 - protein, 11 aa, Influenza virus
DQIEELWAYNA

SEQ ID NO: 521522 - protein, 11 aa, Influenza virus
DQIEGLWAYNA

SEQ ID NO: 521523 - protein, 11 aa, Influenza virus
DQIENLWAYNA

SEQ ID NO: 521524 - protein, 11 aa, Influenza virus
DQIEVTNATEL

SEQ ID NO: 521525 - protein, 11 aa, Influenza virus
DQIIDIWAYNA

SEQ ID NO: 521526 - protein, 11 aa, Influenza virus
DQINGKLNRLI

SEQ ID NO: 521527 - protein, 11 aa, Influenza virus
DQIQDIWAYNA

SEQ ID NO: 521528 - protein, 11 aa, Influenza virus
DQIQDLWAYNA

SEQ ID NO: 521529 - protein, 11 aa, Influenza virus
DQIQDVWAYNA

SEQ ID NO: 521530 - protein, 11 aa, Influenza virus
DQIQNIWAYNA

SEQ ID NO: 521531 - protein, 11 aa, Influenza virus
DQISGKLNRLI

SEQ ID NO: 521532 - protein, 11 aa, Influenza virus
DQISIVPNIGS

SEQ ID NO: 521533 - protein, 11 aa, Influenza virus
DQITDIWAYNA

SEQ ID NO: 521534 - protein, 11 aa, Influenza virus
DQITGKLNHLI

SEQ ID NO: 521535 - protein, 11 aa, Influenza virus
DQITGKLNRLI

SEQ ID NO: 521536 - protein, 11 aa, Influenza virus
DQITRKLNRLI

SEQ ID NO: 521537 - protein, 11 aa, Influenza virus
DQITTKINNII

SEQ ID NO: 521538 - protein, 11 aa, Influenza virus
DQKSLRGRGST

SEQ ID NO: 521539 - protein, 11 aa, Influenza virus
DQKSTQEAIDK

SEQ ID NO: 521540 - protein, 11 aa, Influenza virus
DQKSTQEAIEK

SEQ ID NO: 521541 - protein, 11 aa, Influenza virus
DQKSTQEAIGK

SEQ ID NO: 521542 - protein, 11 aa, Influenza virus
DQKSTQEAINK

SEQ ID NO: 521543 - protein, 11 aa, Influenza virus
DQLKLATGLRN

SEQ ID NO: 521544 - protein, 11 aa, Influenza virus
DQSLIIAARNI

SEQ ID NO: 521545 - protein, 11 aa, Influenza virus
DQSLIIAARSI

SEQ ID NO: 521546 - protein, 11 aa, Influenza virus
DQSLVIAARNI

SEQ ID NO: 521547 - protein, 11 aa, Influenza virus
DQSWSYIVERP

SEQ ID NO: 521548 - protein, 11 aa, Influenza virus
DQVEVTNATEL

SEQ ID NO: 521549 - protein, 11 aa, Influenza virus
DQVKLSSGYKD

SEQ ID NO: 521550 - protein, 11 aa, Influenza virus
DQVNGKLNRLI

SEQ ID NO: 521551 - protein, 11 aa, Influenza virus
DQVREGRNPGN

SEQ ID NO: 521552 - protein, 11 aa, Influenza virus
DQVRESRNPGN

SEQ ID NO: 521553 - protein, 11 aa, Influenza virus
DQVTDIWAYNA

SEQ ID NO: 521554 - protein, 11 aa, Influenza virus
DQVTGKLNRLI

SEQ ID NO: 521555 - protein, 11 aa, Influenza virus
DRAAFRGLIST

SEQ ID NO: 521556 - protein, 11 aa, Influenza virus
DRAPYRSLIRF

SEQ ID NO: 521557 - protein, 11 aa, Influenza virus
DRATFLRSNAP

SEQ ID NO: 521558 - protein, 11 aa, Influenza virus
DRAVKLYKKLK

SEQ ID NO: 521559 - protein, 11 aa, Influenza virus
DRAVKLYRKLK

SEQ ID NO: 521560 - protein, 11 aa, Influenza virus
DRCYQFALGQG

SEQ ID NO: 521561 - protein, 11 aa, Influenza virus
DRDSTQKAIDI

SEQ ID NO: 521562 - protein, 11 aa, Influenza virus
DRDSTQKAIDN

SEQ ID NO: 521563 - protein, 11 aa, Influenza virus
DRDSTQMAIDN

SEQ ID NO: 521564 - protein, 11 aa, Influenza virus
DRDSTQRAIDN

SEQ ID NO: 521565 - protein, 11 aa, Influenza virus
DRFLRVKDQQG

SEQ ID NO: 521566 - protein, 11 aa, Influenza virus
DRFLRVRDQLG

SEQ ID NO: 521567 - protein, 11 aa, Influenza virus
DRFLRVRDQMG

SEQ ID NO: 521568 - protein, 11 aa, Influenza virus
DRFLRVRDQQG

SEQ ID NO: 521569 - protein, 11 aa, Influenza virus
DRFLRVRDQRG

SEQ ID NO: 521570 - protein, 11 aa, Influenza virus
DRFYRICKLVG

SEQ ID NO: 521571 - protein, 11 aa, Influenza virus
DRFYRTCKLLG

SEQ ID NO: 521572 - protein, 11 aa, Influenza virus
DRFYRTCKLVG

SEQ ID NO: 521573 - protein, 11 aa, Influenza virus
DRGLFGAIAGF

SEQ ID NO: 521574 - protein, 11 aa, Influenza virus
DRGLFGAKAGF

SEQ ID NO: 521575 - protein, 11 aa, Influenza virus
DRGNGCFEIFH

SEQ ID NO: 521576 - protein, 11 aa, Influenza virus
DRGSTQKAIDN

SEQ ID NO: 521577 - protein, 11 aa, Influenza virus
DRHSNGTVKDR

SEQ ID NO: 521578 - protein, 11 aa, Influenza virus
DRHSNNTVKDR

SEQ ID NO: 521579 - protein, 11 aa, Influenza virus
DRICIGYHANN

SEQ ID NO: 521580 - protein, 11 aa, Influenza virus
DRICIGYLSTN

SEQ ID NO: 521581 - protein, 11 aa, Influenza virus
DRICIGYQSNN

SEQ ID NO: 521582 - protein, 11 aa, Influenza virus
DRICLGHHAVA

SEQ ID NO: 521583 - protein, 11 aa, Influenza virus
DRICVGYHANN

SEQ ID NO: 521584 - protein, 11 aa, Influenza virus
DRICVGYLSTN

SEQ ID NO: 521585 - protein, 11 aa, Influenza virus
DRIDDAVTDIW

SEQ ID NO: 521586 - protein, 11 aa, Influenza virus
DRIDDAVTDVW

SEQ ID NO: 521587 - protein, 11 aa, Influenza virus
DRIEVTNATEL

SEQ ID NO: 521588 - protein, 11 aa, Influenza virus
DRIPHRTLLMN

SEQ ID NO: 521589 - protein, 11 aa, Influenza virus
DRIPHRTLLMS

SEQ ID NO: 521590 - protein, 11 aa, Influenza virus
DRIQDIWAYNA

SEQ ID NO: 521591 - protein, 11 aa, Influenza virus
DRISHRTLLMN

SEQ ID NO: 521592 - protein, 11 aa, Influenza virus
DRITTKINNII

SEQ ID NO: 521593 - protein, 11 aa, Influenza virus
DRLQDTTWDVF

SEQ ID NO: 521594 - protein, 11 aa, Influenza virus
DRLRRDQKSLR

SEQ ID NO: 521595 - protein, 11 aa, Influenza virus
DRLTQGRQTYD

SEQ ID NO: 521596 - protein, 11 aa, Influenza virus
DRLVLAIGLRN

SEQ ID NO: 521597 - protein, 11 aa, Influenza virus
DRLVLATGLRN

SEQ ID NO: 521598 - protein, 11 aa, Influenza virus
DRNAIGDCPKY

SEQ ID NO: 521599 - protein, 11 aa, Influenza virus
DRNALGDCPKY

SEQ ID NO: 521600 - protein, 11 aa, Influenza virus
DRNFWRGDNGR

SEQ ID NO: 521601 - protein, 11 aa, Influenza virus
DRNFWRGENGR

SEQ ID NO: 521602 - protein, 11 aa, Influenza virus
DRPKVNGQAGR

SEQ ID NO: 521603 - protein, 11 aa, Influenza virus
DRRLTTTIKTW

SEQ ID NO: 521604 - protein, 11 aa, Influenza virus
DRSFRPNIGPR

SEQ ID NO: 521605 - protein, 11 aa, Influenza virus
DRSPFRALISW

SEQ ID NO: 521606 - protein, 11 aa, Influenza virus
DRSPFRALVSW

SEQ ID NO: 521607 - protein, 11 aa, Influenza virus
DRSPFRTLMSC

SEQ ID NO: 521608 - protein, 11 aa, Influenza virus
DRSPFRTLMSV

SEQ ID NO: 521609 - protein, 11 aa, Influenza virus
DRSPHRALMSC

SEQ ID NO: 521610 - protein, 11 aa, Influenza virus
DRSPHRSLMSC

SEQ ID NO: 521611 - protein, 11 aa, Influenza virus
DRSPHRTLLMN

SEQ ID NO: 521612 - protein, 11 aa, Influenza virus
DRSPHRTLMSC

SEQ ID NO: 521613 - protein, 11 aa, Influenza virus
DRSPQRTLMSC

SEQ ID NO: 521614 - protein, 11 aa, Influenza virus
DRSPYRALISW

SEQ ID NO: 521615 - protein, 11 aa, Influenza virus
DRSPYRALMSC

SEQ ID NO: 521616 - protein, 11 aa, Influenza virus
DRSPYRALMSV

SEQ ID NO: 521617 - protein, 11 aa, Influenza virus
DRSPYRTLMSC

SEQ ID NO: 521618 - protein, 11 aa, Influenza virus
DRSPYRTLMSV

SEQ ID NO: 521619 - protein, 11 aa, Influenza virus
DRSQFRALISW

SEQ ID NO: 521620 - protein, 11 aa, Influenza virus
DRSQYRALISW

SEQ ID NO: 521621 - protein, 11 aa, Influenza virus
DRSQYRALVSW

SEQ ID NO: 521622 - protein, 11 aa, Influenza virus
DRSQYRSLISW

SEQ ID NO: 521623 - protein, 11 aa, Influenza virus
DRTAFRGLIST

SEQ ID NO: 521624 - protein, 11 aa, Influenza virus
DRTAFRGLMST

SEQ ID NO: 521625 - protein, 11 aa, Influenza virus
DRTLDLHDANV

SEQ ID NO: 521626 - protein, 11 aa, Influenza virus
DRTNHQFELID

SEQ ID NO: 521627 - protein, 11 aa, Influenza virus
DRTPHRTLLMN

SEQ ID NO: 521628 - protein, 11 aa, Influenza virus
DRTPYRSLIKF

SEQ ID NO: 521629 - protein, 11 aa, Influenza virus
DRTPYRSLIQF

SEQ ID NO: 521630 - protein, 11 aa, Influenza virus
DRTPYRSLIRF

SEQ ID NO: 521631 - protein, 11 aa, Influenza virus
DRTSHRTLLMN

SEQ ID NO: 521632 - protein, 11 aa, Influenza virus
DRTSYRSLIRF

SEQ ID NO: 521633 - protein, 11 aa, Influenza virus
DRTTFRGLIST

SEQ ID NO: 521634 - protein, 11 aa, Influenza virus
DRTTFRGLLST

SEQ ID NO: 521635 - protein, 11 aa, Influenza virus
DRVDDAVTDIW

SEQ ID NO: 521636 - protein, 11 aa, Influenza virus
DRVDDAVTDVW

SEQ ID NO: 521637 - protein, 11 aa, Influenza virus
DRVRKQLRQNA

SEQ ID NO: 521638 - protein, 11 aa, Influenza virus
DRVRLQLRDNA

SEQ ID NO: 521639 - protein, 11 aa, Influenza virus
DRVWWTSNSIV

SEQ ID NO: 521640 - protein, 11 aa, Influenza virus
DSCMDTIRNGT

SEQ ID NO: 521641 - protein, 11 aa, Influenza virus
DSCMEAIRNGT

SEQ ID NO: 521642 - protein, 11 aa, Influenza virus
DSCMESIRNNT

SEQ ID NO: 521643 - protein, 11 aa, Influenza virus
DSCMETIRNGT

SEQ ID NO: 521644 - protein, 11 aa, Influenza virus
DSDILVTREPY

SEQ ID NO: 521645 - protein, 11 aa, Influenza virus
DSDVLVTREPY

SEQ ID NO: 521646 - protein, 11 aa, Influenza virus
DSDVLVTRESY

SEQ ID NO: 521647 - protein, 11 aa, Influenza virus
DSECVSHNGTW

SEQ ID NO: 521648 - protein, 11 aa, Influenza virus
DSEMDKLFERV

SEQ ID NO: 521649 - protein, 11 aa, Influenza virus
DSEMDKLYERV

SEQ ID NO: 521650 - protein, 11 aa, Influenza virus
DSEMDKLYTRV

SEQ ID NO: 521651 - protein, 11 aa, Influenza virus
DSEMKKLYERV

SEQ ID NO: 521652 - protein, 11 aa, Influenza virus
DSEMLNLYDRV

SEQ ID NO: 521653 - protein, 11 aa, Influenza virus
DSEMLNLYEGV

SEQ ID NO: 521654 - protein, 11 aa, Influenza virus
DSEMLNLYERV

SEQ ID NO: 521655 - protein, 11 aa, Influenza virus
DSEMNKLFEKT

SEQ ID NO: 521656 - protein, 11 aa, Influenza virus
DSEMNKLFERI

SEQ ID NO: 521657 - protein, 11 aa, Influenza virus
DSEMNKLFERT

SEQ ID NO: 521658 - protein, 11 aa, Influenza virus
DSEMNKLFERV

SEQ ID NO: 521659 - protein, 11 aa, Influenza virus
DSEMNKLHERV

SEQ ID NO: 521660 - protein, 11 aa, Influenza virus
DSEMNKLYEKV

SEQ ID NO: 521661 - protein, 11 aa, Influenza virus
DSEMNKLYERV

SEQ ID NO: 521662 - protein, 11 aa, Influenza virus
DSEMNRLFERV

SEQ ID NO: 521663 - protein, 11 aa, Influenza virus
DSEMSKLFEKT

SEQ ID NO: 521664 - protein, 11 aa, Influenza virus
DSEMSKLFERT

SEQ ID NO: 521665 - protein, 11 aa, Influenza virus
DSEMSKLFERV

SEQ ID NO: 521666 - protein, 11 aa, Influenza virus
DSEMSKLYERV

SEQ ID NO: 521667 - protein, 11 aa, Influenza virus
DSEMSKLYGRV

SEQ ID NO: 521668 - protein, 11 aa, Influenza virus
DSFRQSERGED

SEQ ID NO: 521669 - protein, 11 aa, Influenza virus
DSFRQSERGEE

SEQ ID NO: 521670 - protein, 11 aa, Influenza virus
DSFYAELKWLV

SEQ ID NO: 521671 - protein, 11 aa, Influenza virus
DSFYRSMKWLT

SEQ ID NO: 521672 - protein, 11 aa, Influenza virus
DSGYVCSGLVG

SEQ ID NO: 521673 - protein, 11 aa, Influenza virus
DSHLKFKADLI

SEQ ID NO: 521674 - protein, 11 aa, Influenza virus
DSIGSWSHNIL

SEQ ID NO: 521675 - protein, 11 aa, Influenza virus
DSIGSWSQNIL

SEQ ID NO: 521676 - protein, 11 aa, Influenza virus
DSIIFNSIGNL

SEQ ID NO: 521677 - protein, 11 aa, Influenza virus
DSIKSWRKDIL

SEQ ID NO: 521678 - protein, 11 aa, Influenza virus
DSIKSWRRDIL

SEQ ID NO: 521679 - protein, 11 aa, Influenza virus
DSIRGEFNQVE

SEQ ID NO: 521680 - protein, 11 aa, Influenza virus
DSIRGEFSQVE

SEQ ID NO: 521681 - protein, 11 aa, Influenza virus
DSITDIWTYQA

SEQ ID NO: 521682 - protein, 11 aa, Influenza virus
DSITEVWSYNA

SEQ ID NO: 521683 - protein, 11 aa, Influenza virus
DSITYIWTYQA

SEQ ID NO: 521684 - protein, 11 aa, Influenza virus
DSIVSWSQNIL

SEQ ID NO: 521685 - protein, 11 aa, Influenza virus
DSLNITAASLN

SEQ ID NO: 521686 - protein, 11 aa, Influenza virus
DSLTEIWSYNA

SEQ ID NO: 521687 - protein, 11 aa, Influenza virus
DSMTEIWSYNA

SEQ ID NO: 521688 - protein, 11 aa, Influenza virus
DSMTEVWSYNA

SEQ ID NO: 521689 - protein, 11 aa, Influenza virus
DSNALLKHRFE

SEQ ID NO: 521690 - protein, 11 aa, Influenza virus
DSNGNFIAPEY

SEQ ID NO: 521691 - protein, 11 aa, Influenza virus
DSNGVQDIIDN

SEQ ID NO: 521692 - protein, 11 aa, Influenza virus
DSNVENLFDEV

SEQ ID NO: 521693 - protein, 11 aa, Influenza virus
DSNVKNLFDEV

SEQ ID NO: 521694 - protein, 11 aa, Influenza virus
DSNVKNLYDKV

SEQ ID NO: 521695 - protein, 11 aa, Influenza virus
DSNVKNLYDRV

SEQ ID NO: 521696 - protein, 11 aa, Influenza virus
DSNVKNLYEKV

SEQ ID NO: 521697 - protein, 11 aa, Influenza virus
DSNVKNLYNKV

SEQ ID NO: 521698 - protein, 11 aa, Influenza virus
DSNVRNLYDKV

SEQ ID NO: 521699 - protein, 11 aa, Influenza virus
DSNYVCSGLVG

SEQ ID NO: 521700 - protein, 11 aa, Influenza virus
DSQTATKRIRM

SEQ ID NO: 521701 - protein, 11 aa, Influenza virus
DSQTATKRLRM

SEQ ID NO: 521702 - protein, 11 aa, Influenza virus
DSRAVGKCPRY

SEQ ID NO: 521703 - protein, 11 aa, Influenza virus
DSRSGYEILKV

SEQ ID NO: 521704 - protein, 11 aa, Influenza virus
DSRSGYEMLKV

SEQ ID NO: 521705 - protein, 11 aa, Influenza virus
DSRSGYETFKV

SEQ ID NO: 521706 - protein, 11 aa, Influenza virus
DSRSGYETFRI

SEQ ID NO: 521707 - protein, 11 aa, Influenza virus
DSRSGYETFRV

SEQ ID NO: 521708 - protein, 11 aa, Influenza virus
DSRSGYEVLKV

SEQ ID NO: 521709 - protein, 11 aa, Influenza virus
DSSFYAEMKWL

SEQ ID NO: 521710 - protein, 11 aa, Influenza virus
DSSILTDSQTA

SEQ ID NO: 521711 - protein, 11 aa, Influenza virus
DSSYICSGLVG

SEQ ID NO: 521712 - protein, 11 aa, Influenza virus
DSSYVCSGLVG

SEQ ID NO: 521713 - protein, 11 aa, Influenza virus
DSTAVAVIKYN

SEQ ID NO: 521714 - protein, 11 aa, Influenza virus
DSTDSEMNKLY

SEQ ID NO: 521715 - protein, 11 aa, Influenza virus
DSTQKAIDIMQ

SEQ ID NO: 521716 - protein, 11 aa, Influenza virus
DSTQKAIDNMQ

SEQ ID NO: 521717 - protein, 11 aa, Influenza virus
DSTQMAIDNMQ

SEQ ID NO: 521718 - protein, 11 aa, Influenza virus
DSTQRAIDNMQ

SEQ ID NO: 521719 - protein, 11 aa, Influenza virus
DSTWLGRTISP

SEQ ID NO: 521720 - protein, 11 aa, Influenza virus
DSVGSWSQNIL

SEQ ID NO: 521721 - protein, 11 aa, Influenza virus
DSVKLSSGYKD

SEQ ID NO: 521722 - protein, 11 aa, Influenza virus
DSVLVNTYQWI

SEQ ID NO: 521723 - protein, 11 aa, Influenza virus
DSVTELWSYNA

SEQ ID NO: 521724 - protein, 11 aa, Influenza virus
DSVYKALSIYS

SEQ ID NO: 521725 - protein, 11 aa, Influenza virus
DSWAVGRCPRY

SEQ ID NO: 521726 - protein, 11 aa, Influenza virus
DTCYPFDVPDY

SEQ ID NO: 521727 - protein, 11 aa, Influenza virus
DTDVVNFLSME

SEQ ID NO: 521728 - protein, 11 aa, Influenza virus
DTDVVNFVSME

SEQ ID NO: 521729 - protein, 11 aa, Influenza virus
DTDVVNYVSME

SEQ ID NO: 521730 - protein, 11 aa, Influenza virus
DTDVYCICRDN

SEQ ID NO: 521731 - protein, 11 aa, Influenza virus
DTEISFTITGD

SEQ ID NO: 521732 - protein, 11 aa, Influenza virus
DTELSFTITGD

SEQ ID NO: 521733 - protein, 11 aa, Influenza virus
DTELSFTVTGD

SEQ ID NO: 521734 - protein, 11 aa, Influenza virus
DTFKSWKGNIM

SEQ ID NO: 521735 - protein, 11 aa, Influenza virus
DTGDGCFEILH

SEQ ID NO: 521736 - protein, 11 aa, Influenza virus
DTGKGCFDILH

SEQ ID NO: 521737 - protein, 11 aa, Influenza virus
DTGNGCFDILH

SEQ ID NO: 521738 - protein, 11 aa, Influenza virus
DTICIGYHANN

SEQ ID NO: 521739 - protein, 11 aa, Influenza virus
DTICVGYHANN

SEQ ID NO: 521740 - protein, 11 aa, Influenza virus
DTIIEKNVTVT

SEQ ID NO: 521741 - protein, 11 aa, Influenza virus
DTIIENNVTVT

SEQ ID NO: 521742 - protein, 11 aa, Influenza virus
DTIIESNVTVT

SEQ ID NO: 521743 - protein, 11 aa, Influenza virus
DTIIFEANGNL

SEQ ID NO: 521744 - protein, 11 aa, Influenza virus
DTIIFEASGNL

SEQ ID NO: 521745 - protein, 11 aa, Influenza virus
DTIIFEATGNL

SEQ ID NO: 521746 - protein, 11 aa, Influenza virus
DTILEKNITVT

SEQ ID NO: 521747 - protein, 11 aa, Influenza virus
DTILEKNVTVT

SEQ ID NO: 521748 - protein, 11 aa, Influenza virus
DTILEQNVTVT

SEQ ID NO: 521749 - protein, 11 aa, Influenza virus
DTILERNVTVT

SEQ ID NO: 521750 - protein, 11 aa, Influenza virus
DTIMEKNITVT

SEQ ID NO: 521751 - protein, 11 aa, Influenza virus
DTIMEKNVTVT

SEQ ID NO: 521752 - protein, 11 aa, Influenza virus
DTIMERNVTVT

SEQ ID NO: 521753 - protein, 11 aa, Influenza virus
DTINFESTGNL

SEQ ID NO: 521754 - protein, 11 aa, Influenza virus
DTINYYNETFV

SEQ ID NO: 521755 - protein, 11 aa, Influenza virus
DTIREKNVTVT

SEQ ID NO: 521756 - protein, 11 aa, Influenza virus
DTISFESTGNL

SEQ ID NO: 521757 - protein, 11 aa, Influenza virus
DTITFEATGNL

SEQ ID NO: 521758 - protein, 11 aa, Influenza virus
DTITFSFNGAF

SEQ ID NO: 521759 - protein, 11 aa, Influenza virus
DTKCQTPLGAI

SEQ ID NO: 521760 - protein, 11 aa, Influenza virus
DTKIDLWSYNA

SEQ ID NO: 521761 - protein, 11 aa, Influenza virus
DTKILFIEEGK

SEQ ID NO: 521762 - protein, 11 aa, Influenza virus
DTKVDLWSYNA

SEQ ID NO: 521763 - protein, 11 aa, Influenza virus
DTLCICYHANN

SEQ ID NO: 521764 - protein, 11 aa, Influenza virus
DTLCIGYHANN

SEQ ID NO: 521765 - protein, 11 aa, Influenza virus
DTLKSWKGNIM

SEQ ID NO: 521766 - protein, 11 aa, Influenza virus
DTLLEKNVTVT

SEQ ID NO: 521767 - protein, 11 aa, Influenza virus
DTLLENDVPVT

SEQ ID NO: 521768 - protein, 11 aa, Influenza virus
DTLLENGVPVT

SEQ ID NO: 521769 - protein, 11 aa, Influenza virus
DTLLENNVPVT

SEQ ID NO: 521770 - protein, 11 aa, Influenza virus
DTLLESDVPVT

SEQ ID NO: 521771 - protein, 11 aa, Influenza virus
DTLTEKGIEVV

SEQ ID NO: 521772 - protein, 11 aa, Influenza virus
DTLTENGVPVT

SEQ ID NO: 521773 - protein, 11 aa, Influenza virus
DTLTETGVPVT

SEQ ID NO: 521774 - protein, 11 aa, Influenza virus
DTNKTFQNIDK

SEQ ID NO: 521775 - protein, 11 aa, Influenza virus
DTNKTFQNIDR

SEQ ID NO: 521776 - protein, 11 aa, Influenza virus
DTPRNDDSSSN

SEQ ID NO: 521777 - protein, 11 aa, Influenza virus
DTPRNDDSSSS

SEQ ID NO: 521778 - protein, 11 aa, Influenza virus
DTPRNEDGSSS

SEQ ID NO: 521779 - protein, 11 aa, Influenza virus
DTPRNEDSSSN

SEQ ID NO: 521780 - protein, 11 aa, Influenza virus
DTPRNEDSSSS

SEQ ID NO: 521781 - protein, 11 aa, Influenza virus
DTRILFIEEGK

SEQ ID NO: 521782 - protein, 11 aa, Influenza virus
DTRILFIKEGK

SEQ ID NO: 521783 - protein, 11 aa, Influenza virus
DTRILFIREGK

SEQ ID NO: 521784 - protein, 11 aa, Influenza virus
DTRILFVKEGK

SEQ ID NO: 521785 - protein, 11 aa, Influenza virus
DTRSGYEMLKV

SEQ ID NO: 521786 - protein, 11 aa, Influenza virus
DTTAVAVLKYN

SEQ ID NO: 521787 - protein, 11 aa, Influenza virus
DTTCWSWPDGA

SEQ ID NO: 521788 - protein, 11 aa, Influenza virus
DTTGWPWPDGA

SEQ ID NO: 521789 - protein, 11 aa, Influenza virus
DTTGWSWPDGA

SEQ ID NO: 521790 - protein, 11 aa, Influenza virus
DTTMEKNVTVT

SEQ ID NO: 521791 - protein, 11 aa, Influenza virus
DTTSWSWPDGA

SEQ ID NO: 521792 - protein, 11 aa, Influenza virus
DTTWDVFIERP

SEQ ID NO: 521793 - protein, 11 aa, Influenza virus
DTTYQRTRALV

SEQ ID NO: 521794 - protein, 11 aa, Influenza virus
DTVDTLTENGV

SEQ ID NO: 521795 - protein, 11 aa, Influenza virus
DTVLEKNVTVT

SEQ ID NO: 521796 - protein, 11 aa, Influenza virus
DTVLERNVTVT

SEQ ID NO: 521797 - protein, 11 aa, Influenza virus
DTVNFSFNGAF

SEQ ID NO: 521798 - protein, 11 aa, Influenza virus
DTVNRTHQYSE

SEQ ID NO: 521799 - protein, 11 aa, Influenza virus
DTVREKNVTVT

SEQ ID NO: 521800 - protein, 11 aa, Influenza virus
DTVTFIFNGAF

SEQ ID NO: 521801 - protein, 11 aa, Influenza virus
DTVTFNFNGAF

SEQ ID NO: 521802 - protein, 11 aa, Influenza virus
DTVTFSFNGAF

SEQ ID NO: 521803 - protein, 11 aa, Influenza virus
DTVTFTFNGAF

SEQ ID NO: 521804 - protein, 11 aa, Influenza virus
DVDQSLIIAAR

SEQ ID NO: 521805 - protein, 11 aa, Influenza virus
DVDQSLVIAAR

SEQ ID NO: 521806 - protein, 11 aa, Influenza virus
DVDVYCICRDN

SEQ ID NO: 521807 - protein, 11 aa, Influenza virus
DVFIERPTAVD

SEQ ID NO: 521808 - protein, 11 aa, Influenza virus
DVFVIREPFIS

SEQ ID NO: 521809 - protein, 11 aa, Influenza virus
DVGYLCAGIPT

SEQ ID NO: 521810 - protein, 11 aa, Influenza virus
DVILWFSFGAS

SEQ ID NO: 521811 - protein, 11 aa, Influenza virus
DVILWFSLGAS

SEQ ID NO: 521812 - protein, 11 aa, Influenza virus
DVIMEVVFPNE

SEQ ID NO: 521813 - protein, 11 aa, Influenza virus
DVINFESTGNL

SEQ ID NO: 521814 - protein, 11 aa, Influenza virus
DVIRSWRKQIL

SEQ ID NO: 521815 - protein, 11 aa, Influenza virus
DVISFESTGNL

SEQ ID NO: 521816 - protein, 11 aa, Influenza virus
DVLDGVTASCL

SEQ ID NO: 521817 - protein, 11 aa, Influenza virus
DVLVIWGIHHP

SEQ ID NO: 521818 - protein, 11 aa, Influenza virus
DVLVLWGIHHP

SEQ ID NO: 521819 - protein, 11 aa, Influenza virus
DVLVMWGIHHP

SEQ ID NO: 521820 - protein, 11 aa, Influenza virus
DVLVMWGLHHP

SEQ ID NO: 521821 - protein, 11 aa, Influenza virus
DVLVTREPYVS

SEQ ID NO: 521822 - protein, 11 aa, Influenza virus
DVPDYQSLRSI

SEQ ID NO: 521823 - protein, 11 aa, Influenza virus
DVPEWSYIVEK

SEQ ID NO: 521824 - protein, 11 aa, Influenza virus
DVRCVCRDNWK

SEQ ID NO: 521825 - protein, 11 aa, Influenza virus
DVSFQGRGVFE

SEQ ID NO: 521826 - protein, 11 aa, Influenza virus
DVSWASNSIVT

SEQ ID NO: 521827 - protein, 11 aa, Influenza virus
DVSWTSNSIVT

SEQ ID NO: 521828 - protein, 11 aa, Influenza virus
DVTDSEMNKLF

SEQ ID NO: 521829 - protein, 11 aa, Influenza virus
DVVLVMKRKRD

SEQ ID NO: 521830 - protein, 11 aa, Influenza virus
DVVLVMKRKRN

SEQ ID NO: 521831 - protein, 11 aa, Influenza virus
DVVNFLSMEFS

SEQ ID NO: 521832 - protein, 11 aa, Influenza virus
DVVNFVSMEFS

SEQ ID NO: 521833 - protein, 11 aa, Influenza virus
DVVNYVSMEFS

SEQ ID NO: 521834 - protein, 11 aa, Influenza virus
DVVRSWKKQIL

SEQ ID NO: 521835 - protein, 11 aa, Influenza virus
DVVRSWRKKIL

SEQ ID NO: 521836 - protein, 11 aa, Influenza virus
DVVRSWRKQIL

SEQ ID NO: 521837 - protein, 11 aa, Influenza virus
DVVRSWRRQIL

SEQ ID NO: 521838 - protein, 11 aa, Influenza virus
DVWAYNAELLV

SEQ ID NO: 521839 - protein, 11 aa, Influenza virus
DVWLGRTVSIN

SEQ ID NO: 521840 - protein, 11 aa, Influenza virus
DVWLGRTVSIS

SEQ ID NO: 521841 - protein, 11 aa, Influenza virus
DVWLGRTVSNS

SEQ ID NO: 521842 - protein, 11 aa, Influenza virus
DVWLGRTVSTS

SEQ ID NO: 521843 - protein, 11 aa, Influenza virus
DVWMGRTISKD

SEQ ID NO: 521844 - protein, 11 aa, Influenza virus
DVWMGRTISMD

SEQ ID NO: 521845 - protein, 11 aa, Influenza virus
DVWMGRTISRD

SEQ ID NO: 521846 - protein, 11 aa, Influenza virus
DVWSYNAKLLV

SEQ ID NO: 521847 - protein, 11 aa, Influenza virus
DVWTYNAEILV

SEQ ID NO: 521848 - protein, 11 aa, Influenza virus
DVWTYNAELLI

SEQ ID NO: 521849 - protein, 11 aa, Influenza virus
DVWTYNAELLV

SEQ ID NO: 521850 - protein, 11 aa, Influenza virus
DVWVTREPYVS

SEQ ID NO: 521851 - protein, 11 aa, Influenza virus
DVYCICRDNWK

SEQ ID NO: 521852 - protein, 11 aa, Influenza virus
DVYCVCRDNWK

SEQ ID NO: 521853 - protein, 11 aa, Influenza virus
DVYKILSIYSC

SEQ ID NO: 521854 - protein, 11 aa, Influenza virus
DVYQILAIYST

SEQ ID NO: 521855 - protein, 11 aa, Influenza virus
DWILWISFAIS

SEQ ID NO: 521856 - protein, 11 aa, Influenza virus
DWILWISFAMS

SEQ ID NO: 521857 - protein, 11 aa, Influenza virus
DWILWISFATS

SEQ ID NO: 521858 - protein, 11 aa, Influenza virus
DWPDGAKIEYF

SEQ ID NO: 521859 - protein, 11 aa, Influenza virus
DWPDGAKIKYF

SEQ ID NO: 521860 - protein, 11 aa, Influenza virus
DWSGYSGSFID

SEQ ID NO: 521861 - protein, 11 aa, Influenza virus
DWSGYSGSFII

SEQ ID NO: 521862 - protein, 11 aa, Influenza virus
DWSGYSGSFIQ

SEQ ID NO: 521863 - protein, 11 aa, Influenza virus
DWSGYSGSFIV

SEQ ID NO: 521864 - protein, 11 aa, Influenza virus
DWSGYSGSFMD

SEQ ID NO: 521865 - protein, 11 aa, Influenza virus
DWSGYSGSFSV

SEQ ID NO: 521866 - protein, 11 aa, Influenza virus
DWSGYSGSFTV

SEQ ID NO: 521867 - protein, 11 aa, Influenza virus
DWSGYSGSFVD

SEQ ID NO: 521868 - protein, 11 aa, Influenza virus
DWSGYSGSFVI

SEQ ID NO: 521869 - protein, 11 aa, Influenza virus
DWSGYSGSFVQ

SEQ ID NO: 521870 - protein, 11 aa, Influenza virus
DWSGYSGSFVV

SEQ ID NO: 521871 - protein, 11 aa, Influenza virus
DWSWHDGAILP

SEQ ID NO: 521872 - protein, 11 aa, Influenza virus
DWSWHDGAVLP

SEQ ID NO: 521873 - protein, 11 aa, Influenza virus
DWSYIVERPSA

SEQ ID NO: 521874 - protein, 11 aa, Influenza virus
DWTLNRNQPAA

SEQ ID NO: 521875 - protein, 11 aa, Influenza virus
DWVDDAVTDIW

SEQ ID NO: 521876 - protein, 11 aa, Influenza virus
DWVLWISFAIS

SEQ ID NO: 521877 - protein, 11 aa, Influenza virus
DYARLYIWGVH

SEQ ID NO: 521878 - protein, 11 aa, Influenza virus
DYEEEAKLERS

SEQ ID NO: 521879 - protein, 11 aa, Influenza virus
DYEELKEQLST

SEQ ID NO: 521880 - protein, 11 aa, Influenza virus
DYEELREQLSS

SEQ ID NO: 521881 - protein, 11 aa, Influenza virus
DYEELREQLST

SEQ ID NO: 521882 - protein, 11 aa, Influenza virus
DYESTQAAIDQ

SEQ ID NO: 521883 - protein, 11 aa, Influenza virus
DYHDSNVKNLY

SEQ ID NO: 521884 - protein, 11 aa, Influenza virus
DYHYEECSCYP

SEQ ID NO: 521885 - protein, 11 aa, Influenza virus
DYILDEESRAR

SEQ ID NO: 521886 - protein, 11 aa, Influenza virus
DYKEESQLKRQ

SEQ ID NO: 521887 - protein, 11 aa, Influenza virus
DYKSTPSAIDQ

SEQ ID NO: 521888 - protein, 11 aa, Influenza virus
DYKSTQAAIDQ

SEQ ID NO: 521889 - protein, 11 aa, Influenza virus
DYKSTQAAVDQ

SEQ ID NO: 521890 - protein, 11 aa, Influenza virus
DYKSTQKTIDQ

SEQ ID NO: 521891 - protein, 11 aa, Influenza virus
DYKSTQSAIDQ

SEQ ID NO: 521892 - protein, 11 aa, Influenza virus
DYKSTQSAINQ

SEQ ID NO: 521893 - protein, 11 aa, Influenza virus
DYKSTQSAVDQ

SEQ ID NO: 521894 - protein, 11 aa, Influenza virus
DYLIGKTSWSY

SEQ ID NO: 521895 - protein, 11 aa, Influenza virus
DYNNTTGRDVL

SEQ ID NO: 521896 - protein, 11 aa, Influenza virus
DYPKYEEESKL

SEQ ID NO: 521897 - protein, 11 aa, Influenza virus
DYPKYEEESRL

SEQ ID NO: 521898 - protein, 11 aa, Influenza virus
DYPKYEKESKL

SEQ ID NO: 521899 - protein, 11 aa, Influenza virus
DYQIGYICSGV

SEQ ID NO: 521900 - protein, 11 aa, Influenza virus
DYQIGYVCSGI

SEQ ID NO: 521901 - protein, 11 aa, Influenza virus
DYQIGYVCSGV

SEQ ID NO: 521902 - protein, 11 aa, Influenza virus
DYQSIRSILAN

SEQ ID NO: 521903 - protein, 11 aa, Influenza virus
DYQSLRSILAN

SEQ ID NO: 521904 - protein, 11 aa, Influenza virus
DYQSLRSILAS

SEQ ID NO: 521905 - protein, 11 aa, Influenza virus
DYREESQLKKQ

SEQ ID NO: 521906 - protein, 11 aa, Influenza virus
DYREESQLKRQ

SEQ ID NO: 521907 - protein, 11 aa, Influenza virus
DYRYTYRCHKG

SEQ ID NO: 521908 - protein, 11 aa, Influenza virus
DYRYTYRCHRG

SEQ ID NO: 521909 - protein, 11 aa, Influenza virus
DYSIDSGYVCS

SEQ ID NO: 521910 - protein, 11 aa, Influenza virus
DYSIDSNYVCS

SEQ ID NO: 521911 - protein, 11 aa, Influenza virus
DYSIDSSYICS

SEQ ID NO: 521912 - protein, 11 aa, Influenza virus
DYSIDSSYVCS

SEQ ID NO: 521913 - protein, 11 aa, Influenza virus
DYSKYEEESKL

SEQ ID NO: 521914 - protein, 11 aa, Influenza virus
DYTIDEESRAR

SEQ ID NO: 521915 - protein, 11 aa, Influenza virus
DYTLDEESRAR

SEQ ID NO: 521916 - protein, 11 aa, Influenza virus
DYTRLYIWGVH

SEQ ID NO: 521917 - protein, 11 aa, Influenza virus
DYWAEGDCYRA

SEQ ID NO: 521918 - protein, 11 aa, Influenza virus
DYWAEGECYRA

SEQ ID NO: 521919 - protein, 11 aa, Influenza virus
DYWAKEECYRA

SEQ ID NO: 521920 - protein, 11 aa, Influenza virus
DYWAKGDCYRA

SEQ ID NO: 521921 - protein, 11 aa, Influenza virus
DYWAKGECYRA

SEQ ID NO: 521922 - protein, 11 aa, Influenza virus
DYYWAILKPGQ

SEQ ID NO: 521923 - protein, 11 aa, Influenza virus
DYYWAVLKPGQ

SEQ ID NO: 521924 - protein, 11 aa, Influenza virus
DYYWGILKRGE

SEQ ID NO: 521925 - protein, 11 aa, Influenza virus
EAESSIKEKDM

SEQ ID NO: 521926 - protein, 11 aa, Influenza virus
EAESSVKEKDL

SEQ ID NO: 521927 - protein, 11 aa, Influenza virus
EAESSVKEKDM

SEQ ID NO: 521928 - protein, 11 aa, Influenza virus
EAESSVREKDM

SEQ ID NO: 521929 - protein, 11 aa, Influenza virus
EAHILVTREPY

SEQ ID NO: 521930 - protein, 11 aa, Influenza virus
EAIDKITNKIN

SEQ ID NO: 521931 - protein, 11 aa, Influenza virus
EAIDKITNKVN

SEQ ID NO: 521932 - protein, 11 aa, Influenza virus
EAIEECLINDP

SEQ ID NO: 521933 - protein, 11 aa, Influenza virus
EAIEKITNKVN

SEQ ID NO: 521934 - protein, 11 aa, Influenza virus
EAIGKITNKVN

SEQ ID NO: 521935 - protein, 11 aa, Influenza virus
EAINKITNKVN

SEQ ID NO: 521936 - protein, 11 aa, Influenza virus
EAINNRFQIQG

SEQ ID NO: 521937 - protein, 11 aa, Influenza virus
EAINNRIKINP

SEQ ID NO: 521938 - protein, 11 aa, Influenza virus
EAINSRFQIQG

SEQ ID NO: 521939 - protein, 11 aa, Influenza virus
EAIRNGTYNHE

SEQ ID NO: 521940 - protein, 11 aa, Influenza virus
EAISNRFQIQG

SEQ ID NO: 521941 - protein, 11 aa, Influenza virus
EAKLEKSRING

SEQ ID NO: 521942 - protein, 11 aa, Influenza virus
EAKLERSKINE

SEQ ID NO: 521943 - protein, 11 aa, Influenza virus
EAKLERSKING

SEQ ID NO: 521944 - protein, 11 aa, Influenza virus
EAKYVEWTSNS

SEQ ID NO: 521945 - protein, 11 aa, Influenza virus
EAKYVWWASNS

SEQ ID NO: 521946 - protein, 11 aa, Influenza virus
EAKYVWWTSNS

SEQ ID NO: 521947 - protein, 11 aa, Influenza virus
EALKMTIASDI

SEQ ID NO: 521948 - protein, 11 aa, Influenza virus
EALLNRININP

SEQ ID NO: 521949 - protein, 11 aa, Influenza virus
EALLNRLNINP

SEQ ID NO: 521950 - protein, 11 aa, Influenza virus
EALLNRLNINS

SEQ ID NO: 521951 - protein, 11 aa, Influenza virus
EALLNRLSINP

SEQ ID NO: 521952 - protein, 11 aa, Influenza virus
EALMEWIKTRP

SEQ ID NO: 521953 - protein, 11 aa, Influenza virus
EALMEWLKTRP

SEQ ID NO: 521954 - protein, 11 aa, Influenza virus
EALQNRIMINP

SEQ ID NO: 521955 - protein, 11 aa, Influenza virus
EALRQIIRESG

SEQ ID NO: 521956 - protein, 11 aa, Influenza virus
EALRQKIMESG

SEQ ID NO: 521957 - protein, 11 aa, Influenza virus
EAMAFLEDSHP

SEQ ID NO: 521958 - protein, 11 aa, Influenza virus
EAMAFLEESHP

SEQ ID NO: 521959 - protein, 11 aa, Influenza virus
EAMAFLEKSHP

SEQ ID NO: 521960 - protein, 11 aa, Influenza virus
EAMAFLENSHP

SEQ ID NO: 521961 - protein, 11 aa, Influenza virus
EAMALLEESHP

SEQ ID NO: 521962 - protein, 11 aa, Influenza virus
EAMASQGTKRS

SEQ ID NO: 521963 - protein, 11 aa, Influenza virus
EAMATQGTKRS

SEQ ID NO: 521964 - protein, 11 aa, Influenza virus
EAMISRARIDA

SEQ ID NO: 521965 - protein, 11 aa, Influenza virus
EAMMSRARIDA

SEQ ID NO: 521966 - protein, 11 aa, Influenza virus
EAMQNRIQIDP

SEQ ID NO: 521967 - protein, 11 aa, Influenza virus
EAMVSRARIDA

SEQ ID NO: 521968 - protein, 11 aa, Influenza virus
EAPGWSWDDGA

SEQ ID NO: 521969 - protein, 11 aa, Influenza virus
EAPSPYNSKFE

SEQ ID NO: 521970 - protein, 11 aa, Influenza virus
EAPSPYNSRFE

SEQ ID NO: 521971 - protein, 11 aa, Influenza virus
EAQDVIMEIVF

SEQ ID NO: 521972 - protein, 11 aa, Influenza virus
EAQDVIMEVVF

SEQ ID NO: 521973 - protein, 11 aa, Influenza virus
EARGLFGAIAG

SEQ ID NO: 521974 - protein, 11 aa, Influenza virus
EARVWWTSNSI

SEQ ID NO: 521975 - protein, 11 aa, Influenza virus
EAVAWSATACH

SEQ ID NO: 521976 - protein, 11 aa, Influenza virus
EAVEECLINDP

SEQ ID NO: 521977 - protein, 11 aa, Influenza virus
EAVIYGNPKCD

SEQ ID NO: 521978 - protein, 11 aa, Influenza virus
ECFNPCFYVEL

SEQ ID NO: 521979 - protein, 11 aa, Influenza virus
ECFNPITGSPG

SEQ ID NO: 521980 - protein, 11 aa, Influenza virus
ECFWVMTDGPA

SEQ ID NO: 521981 - protein, 11 aa, Influenza virus
ECFYSGGTINS

SEQ ID NO: 521982 - protein, 11 aa, Influenza virus
ECICINGTCTV

SEQ ID NO: 521983 - protein, 11 aa, Influenza virus
ECICRDNWTGT

SEQ ID NO: 521984 - protein, 11 aa, Influenza virus
ECIEKIRNGTY

SEQ ID NO: 521985 - protein, 11 aa, Influenza virus
ECIEKVRNGTY

SEQ ID NO: 521986 - protein, 11 aa, Influenza virus
ECIERVRNGTY

SEQ ID NO: 521987 - protein, 11 aa, Influenza virus
ECIESVRNGTY

SEQ ID NO: 521988 - protein, 11 aa, Influenza virus
ECIGWSSTSCH

SEQ ID NO: 521989 - protein, 11 aa, Influenza virus
ECITPNGSIPN

SEQ ID NO: 521990 - protein, 11 aa, Influenza virus
ECITPNGSISN

SEQ ID NO: 521991 - protein, 11 aa, Influenza virus
ECKTFFLTQGA

SEQ ID NO: 521992 - protein, 11 aa, Influenza virus
ECLINDPWVLL

SEQ ID NO: 521993 - protein, 11 aa, Influenza virus
ECMESVKNGTY

SEQ ID NO: 521994 - protein, 11 aa, Influenza virus
ECMESVRNGTY

SEQ ID NO: 521995 - protein, 11 aa, Influenza virus
ECMETIKNGTY

SEQ ID NO: 521996 - protein, 11 aa, Influenza virus
ECPKYIKSDQL

SEQ ID NO: 521997 - protein, 11 aa, Influenza virus
ECPKYVKQGSL

SEQ ID NO: 521998 - protein, 11 aa, Influenza virus
ECPKYVKSDRL

SEQ ID NO: 521999 - protein, 11 aa, Influenza virus
ECPKYVKSEKL

SEQ ID NO: 522000 - protein, 11 aa, Influenza virus
ECPKYVKSERL

SEQ ID NO: 522001 - protein, 11 aa, Influenza virus
ECPKYVRSEKL

SEQ ID NO: 522002 - protein, 11 aa, Influenza virus
ECPRYVKSEKL

SEQ ID NO: 522003 - protein, 11 aa, Influenza virus
ECQLNEGIMNT

SEQ ID NO: 522004 - protein, 11 aa, Influenza virus
ECQLNEGVINT

SEQ ID NO: 522005 - protein, 11 aa, Influenza virus
ECQLNEGVMNT

SEQ ID NO: 522006 - protein, 11 aa, Influenza virus
ECRFYALSQGT

SEQ ID NO: 522007 - protein, 11 aa, Influenza virus
ECRIFALSQGT

SEQ ID NO: 522008 - protein, 11 aa, Influenza virus
ECRMFALSQGT

SEQ ID NO: 522009 - protein, 11 aa, Influenza virus
ECRTFFLTHGA

SEQ ID NO: 522010 - protein, 11 aa, Influenza virus
ECRTFFLTHGS

SEQ ID NO: 522011 - protein, 11 aa, Influenza virus
ECRTFFLTQGA

SEQ ID NO: 522012 - protein, 11 aa, Influenza virus
ECRTFFLTQGS

SEQ ID NO: 522013 - protein, 11 aa, Influenza virus
ECSCYMDIDVY

SEQ ID NO: 522014 - protein, 11 aa, Influenza virus
ECSCYPNDGKV

SEQ ID NO: 522015 - protein, 11 aa, Influenza virus
ECSCYPNEGKV

SEQ ID NO: 522016 - protein, 11 aa, Influenza virus
ECSCYPNLGIV

SEQ ID NO: 522017 - protein, 11 aa, Influenza virus
ECSCYPNLGKV

SEQ ID NO: 522018 - protein, 11 aa, Influenza virus
ECSCYPNLGQV

SEQ ID NO: 522019 - protein, 11 aa, Influenza virus
ECSCYPNMGKV

SEQ ID NO: 522020 - protein, 11 aa, Influenza virus
ECSCYPNNGKV

SEQ ID NO: 522021 - protein, 11 aa, Influenza virus
ECSCYPNSGKV

SEQ ID NO: 522022 - protein, 11 aa, Influenza virus
ECSCYPQYPDV

SEQ ID NO: 522023 - protein, 11 aa, Influenza virus
ECSCYPQYPNV

SEQ ID NO: 522024 - protein, 11 aa, Influenza virus
ECSCYPRYPDV

SEQ ID NO: 522025 - protein, 11 aa, Influenza virus
ECSCYPRYPGV

SEQ ID NO: 522026 - protein, 11 aa, Influenza virus
ECSCYPRYPNV

SEQ ID NO: 522027 - protein, 11 aa, Influenza virus
ECSCYVDIDIY

SEQ ID NO: 522028 - protein, 11 aa, Influenza virus
ECSCYVDIDVY

SEQ ID NO: 522029 - protein, 11 aa, Influenza virus
ECSCYVDTDVY

SEQ ID NO: 522030 - protein, 11 aa, Influenza virus
ECSCYVDVDVY

SEQ ID NO: 522031 - protein, 11 aa, Influenza virus
ECVCHKGICPV

SEQ ID NO: 522032 - protein, 11 aa, Influenza virus
ECVCHKGVCPV

SEQ ID NO: 522033 - protein, 11 aa, Influenza virus
ECVCHNGICPV

SEQ ID NO: 522034 - protein, 11 aa, Influenza virus
ECVCHNGTCAV

SEQ ID NO: 522035 - protein, 11 aa, Influenza virus
ECVCHNGTCVV

SEQ ID NO: 522036 - protein, 11 aa, Influenza virus
ECVCHNGVCPV

SEQ ID NO: 522037 - protein, 11 aa, Influenza virus
ECVCHNSTCVV

SEQ ID NO: 522038 - protein, 11 aa, Influenza virus
ECVCHSGICPV

SEQ ID NO: 522039 - protein, 11 aa, Influenza virus
ECVCINGICTV

SEQ ID NO: 522040 - protein, 11 aa, Influenza virus
ECVCINGSCAV

SEQ ID NO: 522041 - protein, 11 aa, Influenza virus
ECVCINGSCIV

SEQ ID NO: 522042 - protein, 11 aa, Influenza virus
ECVCINGSCTV

SEQ ID NO: 522043 - protein, 11 aa, Influenza virus
ECVCINGTCAV

SEQ ID NO: 522044 - protein, 11 aa, Influenza virus
ECVCINGTCTV

SEQ ID NO: 522045 - protein, 11 aa, Influenza virus
ECVCISGTCAV

SEQ ID NO: 522046 - protein, 11 aa, Influenza virus
ECVCQDEFCYT

SEQ ID NO: 522047 - protein, 11 aa, Influenza virus
ECVCQNGVCPV

SEQ ID NO: 522048 - protein, 11 aa, Influenza virus
ECVCRDNWNGM

SEQ ID NO: 522049 - protein, 11 aa, Influenza virus
ECVCRDNWRGS

SEQ ID NO: 522050 - protein, 11 aa, Influenza virus
ECVCRDNWTGT

SEQ ID NO: 522051 - protein, 11 aa, Influenza virus
ECVGWSSTSCH

SEQ ID NO: 522052 - protein, 11 aa, Influenza virus
ECVRHNGTCAV

SEQ ID NO: 522053 - protein, 11 aa, Influenza virus
ECVSHNGTWAV

SEQ ID NO: 522054 - protein, 11 aa, Influenza virus
ECYNPCFYVEL

SEQ ID NO: 522055 - protein, 11 aa, Influenza virus
ECYRACFYVEL

SEQ ID NO: 522056 - protein, 11 aa, Influenza virus
ECYWVMTDGPA

SEQ ID NO: 522057 - protein, 11 aa, Influenza virus
EDCTGCFEIFH

SEQ ID NO: 522058 - protein, 11 aa, Influenza virus
EDDVWMGRTIS

SEQ ID NO: 522059 - protein, 11 aa, Influenza virus
EDEQMYQKCCN

SEQ ID NO: 522060 - protein, 11 aa, Influenza virus
EDEQMYQKCCS

SEQ ID NO: 522061 - protein, 11 aa, Influenza virus
EDEQMYQKCCT

SEQ ID NO: 522062 - protein, 11 aa, Influenza virus
EDEQMYQRCCN

SEQ ID NO: 522063 - protein, 11 aa, Influenza virus
EDERMYQKCCN

SEQ ID NO: 522064 - protein, 11 aa, Influenza virus
EDEVWWTSNSI

SEQ ID NO: 522065 - protein, 11 aa, Influenza virus
EDFQLIPMISK

SEQ ID NO: 522066 - protein, 11 aa, Influenza virus
EDGDIIFLWGI

SEQ ID NO: 522067 - protein, 11 aa, Influenza virus
EDGFIDVWTYN

SEQ ID NO: 522068 - protein, 11 aa, Influenza virus
EDGFLDVWTYN

SEQ ID NO: 522069 - protein, 11 aa, Influenza virus
EDGFLGVWTYN

SEQ ID NO: 522070 - protein, 11 aa, Influenza virus
EDGKGCFDLYH

SEQ ID NO: 522071 - protein, 11 aa, Influenza virus
EDGKGCFEIYH

SEQ ID NO: 522072 - protein, 11 aa, Influenza virus
EDGKGCFELYH

SEQ ID NO: 522073 - protein, 11 aa, Influenza virus
EDGKGWFELYH

SEQ ID NO: 522074 - protein, 11 aa, Influenza virus
EDGLLDVWTYN

SEQ ID NO: 522075 - protein, 11 aa, Influenza virus
EDGNGCFEIFH

SEQ ID NO: 522076 - protein, 11 aa, Influenza virus
EDGNGCFELYH

SEQ ID NO: 522077 - protein, 11 aa, Influenza virus
EDGNIIFLWGI

SEQ ID NO: 522078 - protein, 11 aa, Influenza virus
EDGRGCFEIYH

SEQ ID NO: 522079 - protein, 11 aa, Influenza virus
EDGSIGKVCRT

SEQ ID NO: 522080 - protein, 11 aa, Influenza virus
EDGTACFEIFH

SEQ ID NO: 522081 - protein, 11 aa, Influenza virus
EDGTGCFEIFH

SEQ ID NO: 522082 - protein, 11 aa, Influenza virus
EDGTGCFEILH

SEQ ID NO: 522083 - protein, 11 aa, Influenza virus
EDGVYKALSIY

SEQ ID NO: 522084 - protein, 11 aa, Influenza virus
EDKGNGCFEIF

SEQ ID NO: 522085 - protein, 11 aa, Influenza virus
EDKRYGPALSI

SEQ ID NO: 522086 - protein, 11 aa, Influenza virus
EDKVWWTSNSI

SEQ ID NO: 522087 - protein, 11 aa, Influenza virus
EDLGNGCFKIY

SEQ ID NO: 522088 - protein, 11 aa, Influenza virus
EDLIFLARSAL

SEQ ID NO: 522089 - protein, 11 aa, Influenza virus
EDLIFMARSAL

SEQ ID NO: 522090 - protein, 11 aa, Influenza virus
EDLIFSARSAL

SEQ ID NO: 522091 - protein, 11 aa, Influenza virus
EDLTFLARSAL

SEQ ID NO: 522092 - protein, 11 aa, Influenza virus
EDLWAYNAELL

SEQ ID NO: 522093 - protein, 11 aa, Influenza virus
EDMGNGCFKIY

SEQ ID NO: 522094 - protein, 11 aa, Influenza virus
EDMGNGCFRIY

SEQ ID NO: 522095 - protein, 11 aa, Influenza virus
EDMGNGCFTIY

SEQ ID NO: 522096 - protein, 11 aa, Influenza virus
EDMGNGCLKIY

SEQ ID NO: 522097 - protein, 11 aa, Influenza virus
EDNIYKILSIY

SEQ ID NO: 522098 - protein, 11 aa, Influenza virus
EDNVYKALSIY

SEQ ID NO: 522099 - protein, 11 aa, Influenza virus
EDNVYKILSIY

SEQ ID NO: 522100 - protein, 11 aa, Influenza virus
EDNVYKVLAIY

SEQ ID NO: 522101 - protein, 11 aa, Influenza virus
EDNVYKVLSIY

SEQ ID NO: 522102 - protein, 11 aa, Influenza virus
EDNVYRALSIY

SEQ ID NO: 522103 - protein, 11 aa, Influenza virus
EDPAAPHGLCY

SEQ ID NO: 522104 - protein, 11 aa, Influenza virus
EDPDHEGEGIP

SEQ ID NO: 522105 - protein, 11 aa, Influenza virus
EDPGAPHGLCY

SEQ ID NO: 522106 - protein, 11 aa, Influenza virus
EDPNAPHKLCF

SEQ ID NO: 522107 - protein, 11 aa, Influenza virus
EDPNAPHKLCY

SEQ ID NO: 522108 - protein, 11 aa, Influenza virus
EDPNAPNKFCY

SEQ ID NO: 522109 - protein, 11 aa, Influenza virus
EDPNAPNKLCF

SEQ ID NO: 522110 - protein, 11 aa, Influenza virus
EDPNAPNKLCY

SEQ ID NO: 522111 - protein, 11 aa, Influenza virus
EDPNHEGEGIP

SEQ ID NO: 522112 - protein, 11 aa, Influenza virus
EDPSAPHGLCY

SEQ ID NO: 522113 - protein, 11 aa, Influenza virus
EDPSAPHRLCY

SEQ ID NO: 522114 - protein, 11 aa, Influenza virus
EDPSHEGEGIP

SEQ ID NO: 522115 - protein, 11 aa, Influenza virus
EDPTAPHGLCY

SEQ ID NO: 522116 - protein, 11 aa, Influenza virus
EDQGNGCFEIF

SEQ ID NO: 522117 - protein, 11 aa, Influenza virus
EDQITDIWAYN

SEQ ID NO: 522118 - protein, 11 aa, Influenza virus
EDRGNGCFEIF

SEQ ID NO: 522119 - protein, 11 aa, Influenza virus
EDRRYGPALSI

SEQ ID NO: 522120 - protein, 11 aa, Influenza virus
EDRVWWTSNSI

SEQ ID NO: 522121 - protein, 11 aa, Influenza virus
EDTKIDLWSYN

SEQ ID NO: 522122 - protein, 11 aa, Influenza virus
EDTKVDLWSYN

SEQ ID NO: 522123 - protein, 11 aa, Influenza virus
EDYKEESQLKR

SEQ ID NO: 522124 - protein, 11 aa, Influenza virus
EDYREESQLKK

SEQ ID NO: 522125 - protein, 11 aa, Influenza virus
EDYREESQLKR

SEQ ID NO: 522126 - protein, 11 aa, Influenza virus
EEAKLEKSRIN

SEQ ID NO: 522127 - protein, 11 aa, Influenza virus
EEAKLERSKIN

SEQ ID NO: 522128 - protein, 11 aa, Influenza virus
EEAKYVEWTSN

SEQ ID NO: 522129 - protein, 11 aa, Influenza virus
EEAKYVWWASN

SEQ ID NO: 522130 - protein, 11 aa, Influenza virus
EEAKYVWWTSN

SEQ ID NO: 522131 - protein, 11 aa, Influenza virus
EEALLNRININ

SEQ ID NO: 522132 - protein, 11 aa, Influenza virus
EEALLNRLNIN

SEQ ID NO: 522133 - protein, 11 aa, Influenza virus
EEALLNRLSIN

SEQ ID NO: 522134 - protein, 11 aa, Influenza virus
EEALRQIIRES

SEQ ID NO: 522135 - protein, 11 aa, Influenza virus
EEALRQKIMES

SEQ ID NO: 522136 - protein, 11 aa, Influenza virus
EEAMQNRIQID

SEQ ID NO: 522137 - protein, 11 aa, Influenza virus
EEAMQNRLKID

SEQ ID NO: 522138 - protein, 11 aa, Influenza virus
EECLINDPWVL

SEQ ID NO: 522139 - protein, 11 aa, Influenza virus
EECSCYGHDSK

SEQ ID NO: 522140 - protein, 11 aa, Influenza virus
EECSCYGHNQK

SEQ ID NO: 522141 - protein, 11 aa, Influenza virus
EECSCYGHNSK

SEQ ID NO: 522142 - protein, 11 aa, Influenza virus
EECSCYGHSQK

SEQ ID NO: 522143 - protein, 11 aa, Influenza virus
EECSCYMDIDV

SEQ ID NO: 522144 - protein, 11 aa, Influenza virus
EECSCYPNDGK

SEQ ID NO: 522145 - protein, 11 aa, Influenza virus
EECSCYPNEGK

SEQ ID NO: 522146 - protein, 11 aa, Influenza virus
EECSCYPNLCQ

SEQ ID NO: 522147 - protein, 11 aa, Influenza virus
EECSCYPNLGK

SEQ ID NO: 522148 - protein, 11 aa, Influenza virus
EECSCYPNLGQ

SEQ ID NO: 522149 - protein, 11 aa, Influenza virus
EECSCYPNMGK

SEQ ID NO: 522150 - protein, 11 aa, Influenza virus
EECSCYPNSGK

SEQ ID NO: 522151 - protein, 11 aa, Influenza virus
EECSCYPQYPD

SEQ ID NO: 522152 - protein, 11 aa, Influenza virus
EECSCYPQYPN

SEQ ID NO: 522153 - protein, 11 aa, Influenza virus
EECSCYPRFPG

SEQ ID NO: 522154 - protein, 11 aa, Influenza virus
EECSCYPRYPD

SEQ ID NO: 522155 - protein, 11 aa, Influenza virus
EECSCYPRYPG

SEQ ID NO: 522156 - protein, 11 aa, Influenza virus
EECSCYPRYPN

SEQ ID NO: 522157 - protein, 11 aa, Influenza virus
EECSCYPRYSG

SEQ ID NO: 522158 - protein, 11 aa, Influenza virus
EECSCYPSGEN

SEQ ID NO: 522159 - protein, 11 aa, Influenza virus
EECSCYPSGES

SEQ ID NO: 522160 - protein, 11 aa, Influenza virus
EECSCYPSGTD

SEQ ID NO: 522161 - protein, 11 aa, Influenza virus
EECSCYPSREN

SEQ ID NO: 522162 - protein, 11 aa, Influenza virus
EECSCYVDIDI

SEQ ID NO: 522163 - protein, 11 aa, Influenza virus
EECSCYVDIDV

SEQ ID NO: 522164 - protein, 11 aa, Influenza virus
EECSCYVDTDV

SEQ ID NO: 522165 - protein, 11 aa, Influenza virus
EECSCYVDVDV

SEQ ID NO: 522166 - protein, 11 aa, Influenza virus
EECYRACFYVE

SEQ ID NO: 522167 - protein, 11 aa, Influenza virus
EEDCTGCFEIF

SEQ ID NO: 522168 - protein, 11 aa, Influenza virus
EEDGKGCFEIY

SEQ ID NO: 522169 - protein, 11 aa, Influenza virus
EEDGNGCFEIF

SEQ ID NO: 522170 - protein, 11 aa, Influenza virus
EEDGRGCFEIY

SEQ ID NO: 522171 - protein, 11 aa, Influenza virus
EEDGTACFEIF

SEQ ID NO: 522172 - protein, 11 aa, Influenza virus
EEDGTGCFEIF

SEQ ID NO: 522173 - protein, 11 aa, Influenza virus
EEDGTGCFEIL

SEQ ID NO: 522174 - protein, 11 aa, Influenza virus
EEEAKLEKSRI

SEQ ID NO: 522175 - protein, 11 aa, Influenza virus
EEEAKLERSKI

SEQ ID NO: 522176 - protein, 11 aa, Influenza virus
EEELLTGNLQT

SEQ ID NO: 522177 - protein, 11 aa, Influenza virus
EEEMLTGNLQT

SEQ ID NO: 522178 - protein, 11 aa, Influenza virus
EEESDEALKMT

SEQ ID NO: 522179 - protein, 11 aa, Influenza virus
EEESKLKRNEI

SEQ ID NO: 522180 - protein, 11 aa, Influenza virus
EEESKLKRQEI

SEQ ID NO: 522181 - protein, 11 aa, Influenza virus
EEESKLNRNEI

SEQ ID NO: 522182 - protein, 11 aa, Influenza virus
EEESKLNRSEI

SEQ ID NO: 522183 - protein, 11 aa, Influenza virus
EEESKLNRTEI

SEQ ID NO: 522184 - protein, 11 aa, Influenza virus
EEESRLNRNEI

SEQ ID NO: 522185 - protein, 11 aa, Influenza virus
EEEVLTGNLQA

SEQ ID NO: 522186 - protein, 11 aa, Influenza virus
EEEVLTGNLQT

SEQ ID NO: 522187 - protein, 11 aa, Influenza virus
EEGDIIFLWGI

SEQ ID NO: 522188 - protein, 11 aa, Influenza virus
EEGSIGKLCRT

SEQ ID NO: 522189 - protein, 11 aa, Influenza virus
EEGSIGKVCRA

SEQ ID NO: 522190 - protein, 11 aa, Influenza virus
EEGSIGKVCRT

SEQ ID NO: 522191 - protein, 11 aa, Influenza virus
EEGTGIAADKE

SEQ ID NO: 522192 - protein, 11 aa, Influenza virus
EEGTGIAADRE

SEQ ID NO: 522193 - protein, 11 aa, Influenza virus
EEGTGVAADKE

SEQ ID NO: 522194 - protein, 11 aa, Influenza virus
EEGTSIWTSSS

SEQ ID NO: 522195 - protein, 11 aa, Influenza virus
EEHPNAGKDPK

SEQ ID NO: 522196 - protein, 11 aa, Influenza virus
EEHPSAGKDPK

SEQ ID NO: 522197 - protein, 11 aa, Influenza virus
EEHPSAGRDPK

SEQ ID NO: 522198 - protein, 11 aa, Influenza virus
EEHPSTGKDPK

SEQ ID NO: 522199 - protein, 11 aa, Influenza virus
EEKVWWTSNSI

SEQ ID NO: 522200 - protein, 11 aa, Influenza virus
EELKEQLSTVS

SEQ ID NO: 522201 - protein, 11 aa, Influenza virus
EELKSLFSSIK

SEQ ID NO: 522202 - protein, 11 aa, Influenza virus
EELLTGNLQTL

SEQ ID NO: 522203 - protein, 11 aa, Influenza virus
EELREHLSSVS

SEQ ID NO: 522204 - protein, 11 aa, Influenza virus
EELREQLSSVS

SEQ ID NO: 522205 - protein, 11 aa, Influenza virus
EELREQLSTVS

SEQ ID NO: 522206 - protein, 11 aa, Influenza virus
EELRFLFSSIK

SEQ ID NO: 522207 - protein, 11 aa, Influenza virus
EELRFVFSIAA

SEQ ID NO: 522208 - protein, 11 aa, Influenza virus
EELRFVFSNAA

SEQ ID NO: 522209 - protein, 11 aa, Influenza virus
EELRFVFSSAA

SEQ ID NO: 522210 - protein, 11 aa, Influenza virus
EELRRQKSLIW

SEQ ID NO: 522211 - protein, 11 aa, Influenza virus
EELRRQKWWVW

SEQ ID NO: 522212 - protein, 11 aa, Influenza virus
EELRSLFSSIK

SEQ ID NO: 522213 - protein, 11 aa, Influenza virus
EELWAYNAELL

SEQ ID NO: 522214 - protein, 11 aa, Influenza virus
EEMLTGNLQTL

SEQ ID NO: 522215 - protein, 11 aa, Influenza virus
EENPSAGKDPK

SEQ ID NO: 522216 - protein, 11 aa, Influenza virus
EENSTYKILSI

SEQ ID NO: 522217 - protein, 11 aa, Influenza virus
EENTSYKILSI

SEQ ID NO: 522218 - protein, 11 aa, Influenza virus
EENTTYKILSI

SEQ ID NO: 522219 - protein, 11 aa, Influenza virus
EENTTYRILSI

SEQ ID NO: 522220 - protein, 11 aa, Influenza virus
EEQAVDICKAA

SEQ ID NO: 522221 - protein, 11 aa, Influenza virus
EEQAVGICKAA

SEQ ID NO: 522222 - protein, 11 aa, Influenza virus
EEQAVNICKAA

SEQ ID NO: 522223 - protein, 11 aa, Influenza virus
EERGNPGVKGW

SEQ ID NO: 522224 - protein, 11 aa, Influenza virus
EERGSPGVKGW

SEQ ID NO: 522225 - protein, 11 aa, Influenza virus
EERNSIWTSSS

SEQ ID NO: 522226 - protein, 11 aa, Influenza virus
EERPSIWTSSS

SEQ ID NO: 522227 - protein, 11 aa, Influenza virus
EERTSIWTSSS

SEQ ID NO: 522228 - protein, 11 aa, Influenza virus
EESDEALKMTI

SEQ ID NO: 522229 - protein, 11 aa, Influenza virus
EESKLKRNEIK

SEQ ID NO: 522230 - protein, 11 aa, Influenza virus
EESKLKRQEID

SEQ ID NO: 522231 - protein, 11 aa, Influenza virus
EESKLKRQEIE

SEQ ID NO: 522232 - protein, 11 aa, Influenza virus
EESKLKRQEIN

SEQ ID NO: 522233 - protein, 11 aa, Influenza virus
EESKLNRNEIK

SEQ ID NO: 522234 - protein, 11 aa, Influenza virus
EESLLNRLSIN

SEQ ID NO: 522235 - protein, 11 aa, Influenza virus
EESQLKKQEIE

SEQ ID NO: 522236 - protein, 11 aa, Influenza virus
EESQLKRQEIE

SEQ ID NO: 522237 - protein, 11 aa, Influenza virus
EESRARIKTRL

SEQ ID NO: 522238 - protein, 11 aa, Influenza virus
EESRLNRNEIK

SEQ ID NO: 522239 - protein, 11 aa, Influenza virus
EESSIGKVCRT

SEQ ID NO: 522240 - protein, 11 aa, Influenza virus
EEVINATETVE

SEQ ID NO: 522241 - protein, 11 aa, Influenza virus
EEVKYVWWTSN

SEQ ID NO: 522242 - protein, 11 aa, Influenza virus
EEVLTGNLQAL

SEQ ID NO: 522243 - protein, 11 aa, Influenza virus
EEVLTGNLQTL

SEQ ID NO: 522244 - protein, 11 aa, Influenza virus
EEVRHRLKITE

SEQ ID NO: 522245 - protein, 11 aa, Influenza virus
EEVTNATETVE

SEQ ID NO: 522246 - protein, 11 aa, Influenza virus
EEVWIGRTKSL

SEQ ID NO: 522247 - protein, 11 aa, Influenza virus
EEYGKGRIFQS

SEQ ID NO: 522248 - protein, 11 aa, Influenza virus
EEYGRGRIFQS

SEQ ID NO: 522249 - protein, 11 aa, Influenza virus
EEYVEDTKIDL

SEQ ID NO: 522250 - protein, 11 aa, Influenza virus
EFCYTLITDGP

SEQ ID NO: 522251 - protein, 11 aa, Influenza virus
EFCYTLMTDGP

SEQ ID NO: 522252 - protein, 11 aa, Influenza virus
EFCYTLVTDGP

SEQ ID NO: 522253 - protein, 11 aa, Influenza virus
EFDEIGEDVAP

SEQ ID NO: 522254 - protein, 11 aa, Influenza virus
EFEPFQSLIPK

SEQ ID NO: 522255 - protein, 11 aa, Influenza virus
EFEPFQSLVPK

SEQ ID NO: 522256 - protein, 11 aa, Influenza virus
EFEPFQSLVPR

SEQ ID NO: 522257 - protein, 11 aa, Influenza virus
EFEQVEGRIQD

SEQ ID NO: 522258 - protein, 11 aa, Influenza virus
EFEQVEGRIQY

SEQ ID NO: 522259 - protein, 11 aa, Influenza virus
EFEQVEGRTQD

SEQ ID NO: 522260 - protein, 11 aa, Influenza virus
EFESIESEFNE

SEQ ID NO: 522261 - protein, 11 aa, Influenza virus
EFESIESEFSE

SEQ ID NO: 522262 - protein, 11 aa, Influenza virus
EFGNLERRLEN

SEQ ID NO: 522263 - protein, 11 aa, Influenza virus
EFGQVEGRIQD

SEQ ID NO: 522264 - protein, 11 aa, Influenza virus
EFGYLLKGESH

SEQ ID NO: 522265 - protein, 11 aa, Influenza virus
EFGYLLKGESY

SEQ ID NO: 522266 - protein, 11 aa, Influenza virus
EFGYLLRGESH

SEQ ID NO: 522267 - protein, 11 aa, Influenza virus
EFHDSNVKNLY

SEQ ID NO: 522268 - protein, 11 aa, Influenza virus
EFIAEQFTWNG

SEQ ID NO: 522269 - protein, 11 aa, Influenza virus
EFICVGWSSTS

SEQ ID NO: 522270 - protein, 11 aa, Influenza virus
EFKADLIIERR

SEQ ID NO: 522271 - protein, 11 aa, Influenza virus
EFKMNPNKKII

SEQ ID NO: 522272 - protein, 11 aa, Influenza virus
EFKMNPNQKII

SEQ ID NO: 522273 - protein, 11 aa, Influenza virus
EFLCVGWSSTS

SEQ ID NO: 522274 - protein, 11 aa, Influenza virus
EFLGQWDWPDG

SEQ ID NO: 522275 - protein, 11 aa, Influenza virus
EFLGQWNWPDG

SEQ ID NO: 522276 - protein, 11 aa, Influenza virus
EFLVAVENQHT

SEQ ID NO: 522277 - protein, 11 aa, Influenza virus
EFLVLMENERT

SEQ ID NO: 522278 - protein, 11 aa, Influenza virus
EFNEIEHQIGN

SEQ ID NO: 522279 - protein, 11 aa, Influenza virus
EFNEIEQQIGN

SEQ ID NO: 522280 - protein, 11 aa, Influenza virus
EFNEIEYQIGN

SEQ ID NO: 522281 - protein, 11 aa, Influenza virus
EFNEVEQQIGN

SEQ ID NO: 522282 - protein, 11 aa, Influenza virus
EFNKACELTDS

SEQ ID NO: 522283 - protein, 11 aa, Influenza virus
EFNKIEGRVQD

SEQ ID NO: 522284 - protein, 11 aa, Influenza virus
EFNNLEKRLEN

SEQ ID NO: 522285 - protein, 11 aa, Influenza virus
EFNNLERRLEN

SEQ ID NO: 522286 - protein, 11 aa, Influenza virus
EFNQVEKRINM

SEQ ID NO: 522287 - protein, 11 aa, Influenza virus
EFNQVENRINM

SEQ ID NO: 522288 - protein, 11 aa, Influenza virus
EFNQVEQRINM

SEQ ID NO: 522289 - protein, 11 aa, Influenza virus
EFPSTGNHGSL

SEQ ID NO: 522290 - protein, 11 aa, Influenza virus
EFQLIPMISKC

SEQ ID NO: 522291 - protein, 11 aa, Influenza virus
EFSEIEGRIQD

SEQ ID NO: 522292 - protein, 11 aa, Influenza virus
EFSEIEHQIGN

SEQ ID NO: 522293 - protein, 11 aa, Influenza virus
EFSEIEHQISN

SEQ ID NO: 522294 - protein, 11 aa, Influenza virus
EFSEIEQQIGN

SEQ ID NO: 522295 - protein, 11 aa, Influenza virus
EFSETEHQIGN

SEQ ID NO: 522296 - protein, 11 aa, Influenza virus
EFSEVEGRIQD

SEQ ID NO: 522297 - protein, 11 aa, Influenza virus
EFSNLEKRLEN

SEQ ID NO: 522298 - protein, 11 aa, Influenza virus
EFSNLERRLEN

SEQ ID NO: 522299 - protein, 11 aa, Influenza virus
EFSQVEQRINM

SEQ ID NO: 522300 - protein, 11 aa, Influenza virus
EFSQVERRINM

SEQ ID NO: 522301 - protein, 11 aa, Influenza virus
EFTEVEGRIQD

SEQ ID NO: 522302 - protein, 11 aa, Influenza virus
EFTEVEKQIGN

SEQ ID NO: 522303 - protein, 11 aa, Influenza virus
EFTEVEQQIGN

SEQ ID NO: 522304 - protein, 11 aa, Influenza virus
EFTSFFYRYGF

SEQ ID NO: 522305 - protein, 11 aa, Influenza virus
EFYHKCDDECM

SEQ ID NO: 522306 - protein, 11 aa, Influenza virus
EFYHKCDNECM

SEQ ID NO: 522307 - protein, 11 aa, Influenza virus
EFYHKCNDECM

SEQ ID NO: 522308 - protein, 11 aa, Influenza virus
EGALRQKIMES

SEQ ID NO: 522309 - protein, 11 aa, Influenza virus
EGDCYRACFYV

SEQ ID NO: 522310 - protein, 11 aa, Influenza virus
EGDGCFNFFHK

SEQ ID NO: 522311 - protein, 11 aa, Influenza virus
EGDGCFNLLHK

SEQ ID NO: 522312 - protein, 11 aa, Influenza virus
EGDGCFSILHK

SEQ ID NO: 522313 - protein, 11 aa, Influenza virus
EGDGCFSLLHK

SEQ ID NO: 522314 - protein, 11 aa, Influenza virus
EGDIIFLWGIH

SEQ ID NO: 522315 - protein, 11 aa, Influenza virus
EGECFYSGGTI

SEQ ID NO: 522316 - protein, 11 aa, Influenza virus
EGECYRACFYV

SEQ ID NO: 522317 - protein, 11 aa, Influenza virus
EGEGIPLHDAI

SEQ ID NO: 522318 - protein, 11 aa, Influenza virus
EGEGIPLYDAI

SEQ ID NO: 522319 - protein, 11 aa, Influenza virus
EGEGIPLYDAV

SEQ ID NO: 522320 - protein, 11 aa, Influenza virus
EGEQIIVTREP

SEQ ID NO: 522321 - protein, 11 aa, Influenza virus
EGFAPFSKDNG

SEQ ID NO: 522322 - protein, 11 aa, Influenza virus
EGFSAESRKLL

SEQ ID NO: 522323 - protein, 11 aa, Influenza virus
EGFSAESRKML

SEQ ID NO: 522324 - protein, 11 aa, Influenza virus
EGGWCGMIDGW

SEQ ID NO: 522325 - protein, 11 aa, Influenza virus
EGGWPGLINGW

SEQ ID NO: 522326 - protein, 11 aa, Influenza virus
EGGWPGLVAGW

SEQ ID NO: 522327 - protein, 11 aa, Influenza virus
EGGWQGLVDGW

SEQ ID NO: 522328 - protein, 11 aa, Influenza virus
EGGWQGMIDGW

SEQ ID NO: 522329 - protein, 11 aa, Influenza virus
EGGWQGMVDGW

SEQ ID NO: 522330 - protein, 11 aa, Influenza virus
EGGWSGLIAGW

SEQ ID NO: 522331 - protein, 11 aa, Influenza virus
EGGWSGLVAGW

SEQ ID NO: 522332 - protein, 11 aa, Influenza virus
EGGWSGLVDGW

SEQ ID NO: 522333 - protein, 11 aa, Influenza virus
EGGWSGMIDGW

SEQ ID NO: 522334 - protein, 11 aa, Influenza virus
EGGWTGLIDGW

SEQ ID NO: 522335 - protein, 11 aa, Influenza virus
EGGWTGMIDGW

SEQ ID NO: 522336 - protein, 11 aa, Influenza virus
EGGWTGMVDGW

SEQ ID NO: 522337 - protein, 11 aa, Influenza virus
EGGWTGMVNGW

SEQ ID NO: 522338 - protein, 11 aa, Influenza virus
EGHIEECSCYP

SEQ ID NO: 522339 - protein, 11 aa, Influenza virus
EGIAADYKSTQ

SEQ ID NO: 522340 - protein, 11 aa, Influenza virus
EGICYPGSIEN

SEQ ID NO: 522341 - protein, 11 aa, Influenza virus
EGICYPGSVEN

SEQ ID NO: 522342 - protein, 11 aa, Influenza virus
EGIGIAADRDS

SEQ ID NO: 522343 - protein, 11 aa, Influenza virus
EGIGQAADLKS

SEQ ID NO: 522344 - protein, 11 aa, Influenza virus
EGIILGNPKCD

SEQ ID NO: 522345 - protein, 11 aa, Influenza virus
EGIKLKSEDNV

SEQ ID NO: 522346 - protein, 11 aa, Influenza virus
EGIKLKTEDNI

SEQ ID NO: 522347 - protein, 11 aa, Influenza virus
EGIKLKTEDNV

SEQ ID NO: 522348 - protein, 11 aa, Influenza virus
EGIMNTSKPFQ

SEQ ID NO: 522349 - protein, 11 aa, Influenza virus
EGIPLHDAIKC

SEQ ID NO: 522350 - protein, 11 aa, Influenza virus
EGIPLYDAIKC

SEQ ID NO: 522351 - protein, 11 aa, Influenza virus
EGIPLYDAVKC

SEQ ID NO: 522352 - protein, 11 aa, Influenza virus
EGIPLYDAVRC

SEQ ID NO: 522353 - protein, 11 aa, Influenza virus
EGKHIVERILE

SEQ ID NO: 522354 - protein, 11 aa, Influenza virus
EGKIAHISPLS

SEQ ID NO: 522355 - protein, 11 aa, Influenza virus
EGKIIHISPLS

SEQ ID NO: 522356 - protein, 11 aa, Influenza virus
EGKISHISPLS

SEQ ID NO: 522357 - protein, 11 aa, Influenza virus
EGKIVHISPLS

SEQ ID NO: 522358 - protein, 11 aa, Influenza virus
EGKVECICRDN

SEQ ID NO: 522359 - protein, 11 aa, Influenza virus
EGKVECVCRDN

SEQ ID NO: 522360 - protein, 11 aa, Influenza virus
EGKVVHISPLS

SEQ ID NO: 522361 - protein, 11 aa, Influenza virus
EGLIDGWYGFK

SEQ ID NO: 522362 - protein, 11 aa, Influenza virus
EGLIDGWYGFR

SEQ ID NO: 522363 - protein, 11 aa, Influenza virus
EGLIDGWYGYK

SEQ ID NO: 522364 - protein, 11 aa, Influenza virus
EGLIDGWYGYR

SEQ ID NO: 522365 - protein, 11 aa, Influenza virus
EGLILGNPKCD

SEQ ID NO: 522366 - protein, 11 aa, Influenza virus
EGLILSNPKCD

SEQ ID NO: 522367 - protein, 11 aa, Influenza virus
EGLINGWYGFR

SEQ ID NO: 522368 - protein, 11 aa, Influenza virus
EGLIYGNPFCD

SEQ ID NO: 522369 - protein, 11 aa, Influenza virus
EGLIYGNPSCD

SEQ ID NO: 522370 - protein, 11 aa, Influenza virus
EGLIYGNPSCN

SEQ ID NO: 522371 - protein, 11 aa, Influenza virus
EGLPQSGRIVV

SEQ ID NO: 522372 - protein, 11 aa, Influenza virus
EGLVDGWYGFR

SEQ ID NO: 522373 - protein, 11 aa, Influenza virus
EGLVLGNPKCD

SEQ ID NO: 522374 - protein, 11 aa, Influenza virus
EGLVYGNPACD

SEQ ID NO: 522375 - protein, 11 aa, Influenza virus
EGLVYGNPSCD

SEQ ID NO: 522376 - protein, 11 aa, Influenza virus
EGLWAYNAELL

SEQ ID NO: 522377 - protein, 11 aa, Influenza virus
EGMCYPGFVEN

SEQ ID NO: 522378 - protein, 11 aa, Influenza virus
EGMCYPGSIEN

SEQ ID NO: 522379 - protein, 11 aa, Influenza virus
EGMCYPGSVEN

SEQ ID NO: 522380 - protein, 11 aa, Influenza virus
EGMGQAADLKS

SEQ ID NO: 522381 - protein, 11 aa, Influenza virus
EGMIDGWYGFR

SEQ ID NO: 522382 - protein, 11 aa, Influenza virus
EGMMDGWYGFR

SEQ ID NO: 522383 - protein, 11 aa, Influenza virus
EGMVDGWYGFR

SEQ ID NO: 522384 - protein, 11 aa, Influenza virus
EGMVNGWYGFR

SEQ ID NO: 522385 - protein, 11 aa, Influenza virus
EGNGCFELLHK

SEQ ID NO: 522386 - protein, 11 aa, Influenza virus
EGNGCFTFYHK

SEQ ID NO: 522387 - protein, 11 aa, Influenza virus
EGNGCFTFYHR

SEQ ID NO: 522388 - protein, 11 aa, Influenza virus
EGNILRTQESE

SEQ ID NO: 522389 - protein, 11 aa, Influenza virus
EGQRSWMKIYW

SEQ ID NO: 522390 - protein, 11 aa, Influenza virus
EGRGQAADLKS

SEQ ID NO: 522391 - protein, 11 aa, Influenza virus
EGRIQDLEKYI

SEQ ID NO: 522392 - protein, 11 aa, Influenza virus
EGRIQDLEKYV

SEQ ID NO: 522393 - protein, 11 aa, Influenza virus
EGRIQDLERYV

SEQ ID NO: 522394 - protein, 11 aa, Influenza virus
EGRNPGNAEIE

SEQ ID NO: 522395 - protein, 11 aa, Influenza virus
EGRRKTNLYGF

SEQ ID NO: 522396 - protein, 11 aa, Influenza virus
EGRRRTNLYGF

SEQ ID NO: 522397 - protein, 11 aa, Influenza virus
EGRTSDMRAEI

SEQ ID NO: 522398 - protein, 11 aa, Influenza virus
EGRTSDMRTEI

SEQ ID NO: 522399 - protein, 11 aa, Influenza virus
EGRTSDMRTEV

SEQ ID NO: 522400 - protein, 11 aa, Influenza virus
EGRWPGLVAGW

SEQ ID NO: 522401 - protein, 11 aa, Influenza virus
EGSIGKVCRAL

SEQ ID NO: 522402 - protein, 11 aa, Influenza virus
EGSIGKVCRTL

SEQ ID NO: 522403 - protein, 11 aa, Influenza virus
EGSYFFGDNAE

SEQ ID NO: 522404 - protein, 11 aa, Influenza virus
EGSYFFGDNAK

SEQ ID NO: 522405 - protein, 11 aa, Influenza virus
EGSYFFGDSAE

SEQ ID NO: 522406 - protein, 11 aa, Influenza virus
EGTAADYKSTP

SEQ ID NO: 522407 - protein, 11 aa, Influenza virus
EGTAADYKSTQ

SEQ ID NO: 522408 - protein, 11 aa, Influenza virus
EGTGIAADKES

SEQ ID NO: 522409 - protein, 11 aa, Influenza virus
EGTGIAADRDS

SEQ ID NO: 522410 - protein, 11 aa, Influenza virus
EGTGIAADRES

SEQ ID NO: 522411 - protein, 11 aa, Influenza virus
EGTGIAADRGS

SEQ ID NO: 522412 - protein, 11 aa, Influenza virus
EGTGIVADRDS

SEQ ID NO: 522413 - protein, 11 aa, Influenza virus
EGTGMAADQKS

SEQ ID NO: 522414 - protein, 11 aa, Influenza virus
EGTGMAADRDS

SEQ ID NO: 522415 - protein, 11 aa, Influenza virus
EGTGQAADLKS

SEQ ID NO: 522416 - protein, 11 aa, Influenza virus
EGTGTAADLKS

SEQ ID NO: 522417 - protein, 11 aa, Influenza virus
EGTSIWTSSSS

SEQ ID NO: 522418 - protein, 11 aa, Influenza virus
EGTTASCQNRG

SEQ ID NO: 522419 - protein, 11 aa, Influenza virus
EGVCYPGSIEN

SEQ ID NO: 522420 - protein, 11 aa, Influenza virus
EGVCYPGSIKN

SEQ ID NO: 522421 - protein, 11 aa, Influenza virus
EGVINTSKPFQ

SEQ ID NO: 522422 - protein, 11 aa, Influenza virus
EGVMNTSKPFQ

SEQ ID NO: 522423 - protein, 11 aa, Influenza virus
EGVMNTSKPLQ

SEQ ID NO: 522424 - protein, 11 aa, Influenza virus
EGWIDSPNHAK

SEQ ID NO: 522425 - protein, 11 aa, Influenza virus
EGWINSPNHAK

SEQ ID NO: 522426 - protein, 11 aa, Influenza virus
EGWINSPNHVK

SEQ ID NO: 522427 - protein, 11 aa, Influenza virus
EGWINSPSQAK

SEQ ID NO: 522428 - protein, 11 aa, Influenza virus
EGWIVGNPSCA

SEQ ID NO: 522429 - protein, 11 aa, Influenza virus
EGWVVIAKDNA

SEQ ID NO: 522430 - protein, 11 aa, Influenza virus
EGWVVIAQDNA

SEQ ID NO: 522431 - protein, 11 aa, Influenza virus
EGWVVIEKDNA

SEQ ID NO: 522432 - protein, 11 aa, Influenza virus
EGWVVVAKDNA

SEQ ID NO: 522433 - protein, 11 aa, Influenza virus
EGYSLVGIDPF

SEQ ID NO: 522434 - protein, 11 aa, Influenza virus
EGYSLVGVDPF

SEQ ID NO: 522435 - protein, 11 aa, Influenza virus
EHDANVRNLHD

SEQ ID NO: 522436 - protein, 11 aa, Influenza virus
EHDANVRNLHE

SEQ ID NO: 522437 - protein, 11 aa, Influenza virus
EHDSNVENLFD

SEQ ID NO: 522438 - protein, 11 aa, Influenza virus
EHDSNVKNLFD

SEQ ID NO: 522439 - protein, 11 aa, Influenza virus
EHEEVTNATET

SEQ ID NO: 522440 - protein, 11 aa, Influenza virus
EHIIMWGIHHP

SEQ ID NO: 522441 - protein, 11 aa, Influenza virus
EHLIIWGIHHP

SEQ ID NO: 522442 - protein, 11 aa, Influenza virus
EHLIMWGIHHP

SEQ ID NO: 522443 - protein, 11 aa, Influenza virus
EHLITWGIHHP

SEQ ID NO: 522444 - protein, 11 aa, Influenza virus
EHLIVWGIHHP

SEQ ID NO: 522445 - protein, 11 aa, Influenza virus
EHLSSVSSFER

SEQ ID NO: 522446 - protein, 11 aa, Influenza virus
EHPNAGKDPKK

SEQ ID NO: 522447 - protein, 11 aa, Influenza virus
EHPSAGKDPKK

SEQ ID NO: 522448 - protein, 11 aa, Influenza virus
EHPSAGRDPKK

SEQ ID NO: 522449 - protein, 11 aa, Influenza virus
EHPSTGKDPKK

SEQ ID NO: 522450 - protein, 11 aa, Influenza virus
EHQIGNVINWT

SEQ ID NO: 522451 - protein, 11 aa, Influenza virus
EHSNGTIHDRI

SEQ ID NO: 522452 - protein, 11 aa, Influenza virus
EHSNGTTHDRI

SEQ ID NO: 522453 - protein, 11 aa, Influenza virus
EHTAYSQITNG

SEQ ID NO: 522454 - protein, 11 aa, Influenza virus
EHTSQYLCTGI

SEQ ID NO: 522455 - protein, 11 aa, Influenza virus
EHTSQYLCTGV

SEQ ID NO: 522456 - protein, 11 aa, Influenza virus
EHTSRYVCTGI

SEQ ID NO: 522457 - protein, 11 aa, Influenza virus
EIAQKLEDVFA

SEQ ID NO: 522458 - protein, 11 aa, Influenza virus
EIAQRLEDVFA

SEQ ID NO: 522459 - protein, 11 aa, Influenza virus
EIAQRLEGVFA

SEQ ID NO: 522460 - protein, 11 aa, Influenza virus
EIAQRLENVFA

SEQ ID NO: 522461 - protein, 11 aa, Influenza virus
EIAQRLESVFA

SEQ ID NO: 522462 - protein, 11 aa, Influenza virus
EIASWAGNILR

SEQ ID NO: 522463 - protein, 11 aa, Influenza virus
EICFMYSDFHF

SEQ ID NO: 522464 - protein, 11 aa, Influenza virus
EICIAWSSSSC

SEQ ID NO: 522465 - protein, 11 aa, Influenza virus
EICIGHLSNNS

SEQ ID NO: 522466 - protein, 11 aa, Influenza virus
EICIGYLSNNS

SEQ ID NO: 522467 - protein, 11 aa, Influenza virus
EICIGYMSNNS

SEQ ID NO: 522468 - protein, 11 aa, Influenza virus
EICVAWSSSSC

SEQ ID NO: 522469 - protein, 11 aa, Influenza virus
EICVAWSSTSC

SEQ ID NO: 522470 - protein, 11 aa, Influenza virus
EIDRSFRPNIG

SEQ ID NO: 522471 - protein, 11 aa, Influenza virus
EIEDLIFLARS

SEQ ID NO: 522472 - protein, 11 aa, Influenza virus
EIEDLIFLTRS

SEQ ID NO: 522473 - protein, 11 aa, Influenza virus
EIEDLIFMARS

SEQ ID NO: 522474 - protein, 11 aa, Influenza virus
EIEDLIFSARS

SEQ ID NO: 522475 - protein, 11 aa, Influenza virus
EIEDLTFLARS

SEQ ID NO: 522476 - protein, 11 aa, Influenza virus
EIEGICYPGSI

SEQ ID NO: 522477 - protein, 11 aa, Influenza virus
EIEGIKLKSED

SEQ ID NO: 522478 - protein, 11 aa, Influenza virus
EIEGIKLKTED

SEQ ID NO: 522479 - protein, 11 aa, Influenza virus
EIEGRIQDLEK

SEQ ID NO: 522480 - protein, 11 aa, Influenza virus
EIEHQIGNVIN

SEQ ID NO: 522481 - protein, 11 aa, Influenza virus
EIEHQISNVIN

SEQ ID NO: 522482 - protein, 11 aa, Influenza virus
EIEKQIGNVIN

SEQ ID NO: 522483 - protein, 11 aa, Influenza virus
EIEQQIGNVIN

SEQ ID NO: 522484 - protein, 11 aa, Influenza virus
EIEYQIGNVIN

SEQ ID NO: 522485 - protein, 11 aa, Influenza virus
EIFHKCDDDCM

SEQ ID NO: 522486 - protein, 11 aa, Influenza virus
EIFHKCDDHCM

SEQ ID NO: 522487 - protein, 11 aa, Influenza virus
EIFHKCDDNCM

SEQ ID NO: 522488 - protein, 11 aa, Influenza virus
EIFHKCDDQCM

SEQ ID NO: 522489 - protein, 11 aa, Influenza virus
EIFHKCDNQCM

SEQ ID NO: 522490 - protein, 11 aa, Influenza virus
EIFHQCDNDCM

SEQ ID NO: 522491 - protein, 11 aa, Influenza virus
EIFHQCDNNCI

SEQ ID NO: 522492 - protein, 11 aa, Influenza virus
EIFHRCDDQCM

SEQ ID NO: 522493 - protein, 11 aa, Influenza virus
EIGAPQLNPID

SEQ ID NO: 522494 - protein, 11 aa, Influenza virus
EIGARIGEGQR

SEQ ID NO: 522495 - protein, 11 aa, Influenza virus
EIGEDIAPIEH

SEQ ID NO: 522496 - protein, 11 aa, Influenza virus
EIGEDIAPIEY

SEQ ID NO: 522497 - protein, 11 aa, Influenza virus
EIGEDLAPIEY

SEQ ID NO: 522498 - protein, 11 aa, Influenza virus
EIGEDVAPIEH

SEQ ID NO: 522499 - protein, 11 aa, Influenza virus
EIGEDVAPIEY

SEQ ID NO: 522500 - protein, 11 aa, Influenza virus
EIGNGCFEFYH

SEQ ID NO: 522501 - protein, 11 aa, Influenza virus
EIGTRIGDGQR

SEQ ID NO: 522502 - protein, 11 aa, Influenza virus
EIIIRMMENAR

SEQ ID NO: 522503 - protein, 11 aa, Influenza virus
EIILWFSFGAS

SEQ ID NO: 522504 - protein, 11 aa, Influenza virus
EIITIGSICMV

SEQ ID NO: 522505 - protein, 11 aa, Influenza virus
EIKGVELSSMG

SEQ ID NO: 522506 - protein, 11 aa, Influenza virus
EIKGVKLSNMG

SEQ ID NO: 522507 - protein, 11 aa, Influenza virus
EIKGVKLSSMG

SEQ ID NO: 522508 - protein, 11 aa, Influenza virus
EIKMNPNQKII

SEQ ID NO: 522509 - protein, 11 aa, Influenza virus
EIKMNPNQKIM

SEQ ID NO: 522510 - protein, 11 aa, Influenza virus
EILKVPNALTD

SEQ ID NO: 522511 - protein, 11 aa, Influenza virus
EILNNKNWSGY

SEQ ID NO: 522512 - protein, 11 aa, Influenza virus
EILRTQESECI

SEQ ID NO: 522513 - protein, 11 aa, Influenza virus
EILRTQESECV

SEQ ID NO: 522514 - protein, 11 aa, Influenza virus
EILTKITVDHM

SEQ ID NO: 522515 - protein, 11 aa, Influenza virus
EILTKTTVDHM

SEQ ID NO: 522516 - protein, 11 aa, Influenza virus
EILTRTTVDHM

SEQ ID NO: 522517 - protein, 11 aa, Influenza virus
EINGPDSVLVN

SEQ ID NO: 522518 - protein, 11 aa, Influenza virus
EINGPESVLIN

SEQ ID NO: 522519 - protein, 11 aa, Influenza virus
EINGPESVLVN

SEQ ID NO: 522520 - protein, 11 aa, Influenza virus
EINRIFRPNIG

SEQ ID NO: 522521 - protein, 11 aa, Influenza virus
EINRNFKPNIG

SEQ ID NO: 522522 - protein, 11 aa, Influenza virus
EINRSFKPNIG

SEQ ID NO: 522523 - protein, 11 aa, Influenza virus
EINRSFRPNIG

SEQ ID NO: 522524 - protein, 11 aa, Influenza virus
EINTWARNILR

SEQ ID NO: 522525 - protein, 11 aa, Influenza virus
EIPSWAGNILR

SEQ ID NO: 522526 - protein, 11 aa, Influenza virus
EIPSWAGNVLR

SEQ ID NO: 522527 - protein, 11 aa, Influenza virus
EIPSWEGNILR

SEQ ID NO: 522528 - protein, 11 aa, Influenza virus
EIRTFSFQLIL

SEQ ID NO: 522529 - protein, 11 aa, Influenza virus
EIRTFSFQLIN

SEQ ID NO: 522530 - protein, 11 aa, Influenza virus
EISFQGGHIEE

SEQ ID NO: 522531 - protein, 11 aa, Influenza virus
EISFTITGDNT

SEQ ID NO: 522532 - protein, 11 aa, Influenza virus
EISHCRATEYI

SEQ ID NO: 522533 - protein, 11 aa, Influenza virus
EITGIDKVCTK

SEQ ID NO: 522534 - protein, 11 aa, Influenza virus
EITGINKVCTK

SEQ ID NO: 522535 - protein, 11 aa, Influenza virus
EITTKINNIIE

SEQ ID NO: 522536 - protein, 11 aa, Influenza virus
EIVDNKNWSGY

SEQ ID NO: 522537 - protein, 11 aa, Influenza virus
EIVDNNNWSGY

SEQ ID NO: 522538 - protein, 11 aa, Influenza virus
EIVDNSNWSGY

SEQ ID NO: 522539 - protein, 11 aa, Influenza virus
EIVGNDNWSGY

SEQ ID NO: 522540 - protein, 11 aa, Influenza virus
EIVSNDNWSGY

SEQ ID NO: 522541 - protein, 11 aa, Influenza virus
EIWSYNAELLV

SEQ ID NO: 522542 - protein, 11 aa, Influenza virus
EKAHNGKLCRL

SEQ ID NO: 522543 - protein, 11 aa, Influenza virus
EKAIWTSGSSI

SEQ ID NO: 522544 - protein, 11 aa, Influenza virus
EKANVLIGQGD

SEQ ID NO: 522545 - protein, 11 aa, Influenza virus
EKDNAVRFGES

SEQ ID NO: 522546 - protein, 11 aa, Influenza virus
EKEEVTNATET

SEQ ID NO: 522547 - protein, 11 aa, Influenza virus
EKEFEQVEGRI

SEQ ID NO: 522548 - protein, 11 aa, Influenza virus
EKEFEQVEGRT

SEQ ID NO: 522549 - protein, 11 aa, Influenza virus
EKEFGQVEGRI

SEQ ID NO: 522550 - protein, 11 aa, Influenza virus
EKEFSEIEGRI

SEQ ID NO: 522551 - protein, 11 aa, Influenza virus
EKEFSEVEGRI

SEQ ID NO: 522552 - protein, 11 aa, Influenza virus
EKEFTEVEGRI

SEQ ID NO: 522553 - protein, 11 aa, Influenza virus
EKEGYSLVGID

SEQ ID NO: 522554 - protein, 11 aa, Influenza virus
EKEGYSLVGVD

SEQ ID NO: 522555 - protein, 11 aa, Influenza virus
EKEKEICSVVL

SEQ ID NO: 522556 - protein, 11 aa, Influenza virus
EKEKVTNATET

SEQ ID NO: 522557 - protein, 11 aa, Influenza virus
EKENSYPKINK

SEQ ID NO: 522558 - protein, 11 aa, Influenza virus
EKENSYPMINK

SEQ ID NO: 522559 - protein, 11 aa, Influenza virus
EKESKLNRNEI

SEQ ID NO: 522560 - protein, 11 aa, Influenza virus
EKESTQKAIDQ

SEQ ID NO: 522561 - protein, 11 aa, Influenza virus
EKFFPSSSYRR

SEQ ID NO: 522562 - protein, 11 aa, Influenza virus
EKFHQIEKEFS

SEQ ID NO: 522563 - protein, 11 aa, Influenza virus
EKGAKQEENLT

SEQ ID NO: 522564 - protein, 11 aa, Influenza virus
EKGIEVVNATE

SEQ ID NO: 522565 - protein, 11 aa, Influenza virus
EKGKVVKSVEL

SEQ ID NO: 522566 - protein, 11 aa, Influenza virus
EKGNPGVKGWA

SEQ ID NO: 522567 - protein, 11 aa, Influenza virus
EKGNQGVKGWA

SEQ ID NO: 522568 - protein, 11 aa, Influenza virus
EKGPKQEENLT

SEQ ID NO: 522569 - protein, 11 aa, Influenza virus
EKGPKQEENST

SEQ ID NO: 522570 - protein, 11 aa, Influenza virus
EKGTKQEENLT

SEQ ID NO: 522571 - protein, 11 aa, Influenza virus
EKGVEVVNATE

SEQ ID NO: 522572 - protein, 11 aa, Influenza virus
EKHLAYCNTDL

SEQ ID NO: 522573 - protein, 11 aa, Influenza virus
EKHPAYCNTDL

SEQ ID NO: 522574 - protein, 11 aa, Influenza virus
EKHSAYCNTDL

SEQ ID NO: 522575 - protein, 11 aa, Influenza virus
EKIEKIRPLLI

SEQ ID NO: 522576 - protein, 11 aa, Influenza virus
EKIHTRGLFGA

SEQ ID NO: 522577 - protein, 11 aa, Influenza virus
EKIRNGTYDHK

SEQ ID NO: 522578 - protein, 11 aa, Influenza virus
EKIRTRGLFGA

SEQ ID NO: 522579 - protein, 11 aa, Influenza virus
EKIRVKRRPVA

SEQ ID NO: 522580 - protein, 11 aa, Influenza virus
EKITNKVNNIV

SEQ ID NO: 522581 - protein, 11 aa, Influenza virus
EKKAKLANVVR

SEQ ID NO: 522582 - protein, 11 aa, Influenza virus
EKKINMINDKI

SEQ ID NO: 522583 - protein, 11 aa, Influenza virus
EKLEQSGLPVG

SEQ ID NO: 522584 - protein, 11 aa, Influenza virus
EKLTIIYSSSM

SEQ ID NO: 522585 - protein, 11 aa, Influenza virus
EKLTITYSSPM

SEQ ID NO: 522586 - protein, 11 aa, Influenza virus
EKLTITYSSSL

SEQ ID NO: 522587 - protein, 11 aa, Influenza virus
EKLTITYSSSM

SEQ ID NO: 522588 - protein, 11 aa, Influenza virus
EKLVLATGLRN

SEQ ID NO: 522589 - protein, 11 aa, Influenza virus
EKLVLATGPRN

SEQ ID NO: 522590 - protein, 11 aa, Influenza virus
EKMNGNYDSIR

SEQ ID NO: 522591 - protein, 11 aa, Influenza virus
EKMVLSAFDER

SEQ ID NO: 522592 - protein, 11 aa, Influenza virus
EKNALGDCPKY

SEQ ID NO: 522593 - protein, 11 aa, Influenza virus
EKNDLYGAQSL

SEQ ID NO: 522594 - protein, 11 aa, Influenza virus
EKNDLYGTQPL

SEQ ID NO: 522595 - protein, 11 aa, Influenza virus
EKNDLYGTQSL

SEQ ID NO: 522596 - protein, 11 aa, Influenza virus
EKNELYGTQSL

SEQ ID NO: 522597 - protein, 11 aa, Influenza virus
EKNITEIVYLN

SEQ ID NO: 522598 - protein, 11 aa, Influenza virus
EKNITKIVYLN

SEQ ID NO: 522599 - protein, 11 aa, Influenza virus
EKNITVTHAQD

SEQ ID NO: 522600 - protein, 11 aa, Influenza virus
EKNITVTHSVE

SEQ ID NO: 522601 - protein, 11 aa, Influenza virus
EKNPALRMKWM

SEQ ID NO: 522602 - protein, 11 aa, Influenza virus
EKNPAYCNTDL

SEQ ID NO: 522603 - protein, 11 aa, Influenza virus
EKNPSLRMKWM

SEQ ID NO: 522604 - protein, 11 aa, Influenza virus
EKNVTVTHAKD

SEQ ID NO: 522605 - protein, 11 aa, Influenza virus
EKNVTVTHAQD

SEQ ID NO: 522606 - protein, 11 aa, Influenza virus
EKNVTVTHAQN

SEQ ID NO: 522607 - protein, 11 aa, Influenza virus
EKNVTVTHSIE

SEQ ID NO: 522608 - protein, 11 aa, Influenza virus
EKNVTVTHSVD

SEQ ID NO: 522609 - protein, 11 aa, Influenza virus
EKNVTVTHSVE

SEQ ID NO: 522610 - protein, 11 aa, Influenza virus
EKNVTVTHSVN

SEQ ID NO: 522611 - protein, 11 aa, Influenza virus
EKQIGNLINWT

SEQ ID NO: 522612 - protein, 11 aa, Influenza virus
EKQIGNVINWT

SEQ ID NO: 522613 - protein, 11 aa, Influenza virus
EKQLGNVINWT

SEQ ID NO: 522614 - protein, 11 aa, Influenza virus
EKQTRGIFGAI

SEQ ID NO: 522615 - protein, 11 aa, Influenza virus
EKQTRGLFGAI

SEQ ID NO: 522616 - protein, 11 aa, Influenza virus
EKRGLFGAIAG

SEQ ID NO: 522617 - protein, 11 aa, Influenza virus
EKRIENLNKKM

SEQ ID NO: 522618 - protein, 11 aa, Influenza virus
EKRINMIADRV

SEQ ID NO: 522619 - protein, 11 aa, Influenza virus
EKRINMINDKI

SEQ ID NO: 522620 - protein, 11 aa, Influenza virus
EKRINMISDKI

SEQ ID NO: 522621 - protein, 11 aa, Influenza virus
EKRINMLADRI

SEQ ID NO: 522622 - protein, 11 aa, Influenza virus
EKRINMLADRV

SEQ ID NO: 522623 - protein, 11 aa, Influenza virus
EKRINMLADWV

SEQ ID NO: 522624 - protein, 11 aa, Influenza virus
EKRINVINDKI

SEQ ID NO: 522625 - protein, 11 aa, Influenza virus
EKRRKKRGLFG

SEQ ID NO: 522626 - protein, 11 aa, Influenza virus
EKRTNMINDKI

SEQ ID NO: 522627 - protein, 11 aa, Influenza virus
EKSRINGVKLE

SEQ ID NO: 522628 - protein, 11 aa, Influenza virus
EKTHNGKLCKL

SEQ ID NO: 522629 - protein, 11 aa, Influenza virus
EKTHNGKLCRL

SEQ ID NO: 522630 - protein, 11 aa, Influenza virus
EKTHNGRLCKL

SEQ ID NO: 522631 - protein, 11 aa, Influenza virus
EKTIWTSGSSI

SEQ ID NO: 522632 - protein, 11 aa, Influenza virus
EKTLDLHDSNV

SEQ ID NO: 522633 - protein, 11 aa, Influenza virus
EKTNDKYHQIE

SEQ ID NO: 522634 - protein, 11 aa, Influenza virus
EKTNEKFHQIE

SEQ ID NO: 522635 - protein, 11 aa, Influenza virus
EKTNEKYHQIE

SEQ ID NO: 522636 - protein, 11 aa, Influenza virus
EKTNKQFELID

SEQ ID NO: 522637 - protein, 11 aa, Influenza virus
EKTNQQFELID

SEQ ID NO: 522638 - protein, 11 aa, Influenza virus
EKTNQQFKLID

SEQ ID NO: 522639 - protein, 11 aa, Influenza virus
EKTNTEFESIE

SEQ ID NO: 522640 - protein, 11 aa, Influenza virus
EKTNTQFELID

SEQ ID NO: 522641 - protein, 11 aa, Influenza virus
EKTSIWTSSSS

SEQ ID NO: 522642 - protein, 11 aa, Influenza virus
EKTSWSYIVEK

SEQ ID NO: 522643 - protein, 11 aa, Influenza virus
EKVRLQLRDNA

SEQ ID NO: 522644 - protein, 11 aa, Influenza virus
EKVRMQLRDNV

SEQ ID NO: 522645 - protein, 11 aa, Influenza virus
EKVRNGTYDHK

SEQ ID NO: 522646 - protein, 11 aa, Influenza virus
EKVRRQLRENA

SEQ ID NO: 522647 - protein, 11 aa, Influenza virus
EKVWWTSNSIV

SEQ ID NO: 522648 - protein, 11 aa, Influenza virus
EKYGSGRIFQS

SEQ ID NO: 522649 - protein, 11 aa, Influenza virus
EKYGTGRIFQS

SEQ ID NO: 522650 - protein, 11 aa, Influenza virus
EKYHQIEKEFE

SEQ ID NO: 522651 - protein, 11 aa, Influenza virus
EKYHQIEKEFG

SEQ ID NO: 522652 - protein, 11 aa, Influenza virus
EKYVEDTKIDL

SEQ ID NO: 522653 - protein, 11 aa, Influenza virus
EKYVEDTKVDL

SEQ ID NO: 522654 - protein, 11 aa, Influenza virus
ELAEKAMKEHG

SEQ ID NO: 522655 - protein, 11 aa, Influenza virus
ELAEKAMKEYG

SEQ ID NO: 522656 - protein, 11 aa, Influenza virus
ELAEKTMKEYG

SEQ ID NO: 522657 - protein, 11 aa, Influenza virus
ELAERAMKEYG

SEQ ID NO: 522658 - protein, 11 aa, Influenza virus
ELCPSPLKLVD

SEQ ID NO: 522659 - protein, 11 aa, Influenza virus
ELCTINSWHIY

SEQ ID NO: 522660 - protein, 11 aa, Influenza virus
ELDEIGEDIAP

SEQ ID NO: 522661 - protein, 11 aa, Influenza virus
ELDEIGEDLAP

SEQ ID NO: 522662 - protein, 11 aa, Influenza virus
ELDEIGEDVAP

SEQ ID NO: 522663 - protein, 11 aa, Influenza virus
ELDNNGELRHL

SEQ ID NO: 522664 - protein, 11 aa, Influenza virus
ELEIGARIGEG

SEQ ID NO: 522665 - protein, 11 aa, Influenza virus
ELEIGTRIGDG

SEQ ID NO: 522666 - protein, 11 aa, Influenza virus
ELFHKCDDDCM

SEQ ID NO: 522667 - protein, 11 aa, Influenza virus
ELFVLMENERT

SEQ ID NO: 522668 - protein, 11 aa, Influenza virus
ELGAPLVLDDC

SEQ ID NO: 522669 - protein, 11 aa, Influenza virus
ELGDAPFLDRL

SEQ ID NO: 522670 - protein, 11 aa, Influenza virus
ELGDCSIAGWL

SEQ ID NO: 522671 - protein, 11 aa, Influenza virus
ELGIPFHLGTK

SEQ ID NO: 522672 - protein, 11 aa, Influenza virus
ELGIPFHLGTR

SEQ ID NO: 522673 - protein, 11 aa, Influenza virus
ELGNCSIAGWL

SEQ ID NO: 522674 - protein, 11 aa, Influenza virus
ELGNGCFEFYH

SEQ ID NO: 522675 - protein, 11 aa, Influenza virus
ELGSPLVLDDC

SEQ ID NO: 522676 - protein, 11 aa, Influenza virus
ELGVPFHLATK

SEQ ID NO: 522677 - protein, 11 aa, Influenza virus
ELGVPFHLGTK

SEQ ID NO: 522678 - protein, 11 aa, Influenza virus
ELGVPFHLGTR

SEQ ID NO: 522679 - protein, 11 aa, Influenza virus
ELGVPFYLGTK

SEQ ID NO: 522680 - protein, 11 aa, Influenza virus
ELGVPFYLGTR

SEQ ID NO: 522681 - protein, 11 aa, Influenza virus
ELGVSFHLGTK

SEQ ID NO: 522682 - protein, 11 aa, Influenza virus
ELIDNEFTEVE

SEQ ID NO: 522683 - protein, 11 aa, Influenza virus
ELIGKTSWSYI

SEQ ID NO: 522684 - protein, 11 aa, Influenza virus
ELIRGRPEEAK

SEQ ID NO: 522685 - protein, 11 aa, Influenza virus
ELIRGRPEEVK

SEQ ID NO: 522686 - protein, 11 aa, Influenza virus
ELIRGRPKEDK

SEQ ID NO: 522687 - protein, 11 aa, Influenza virus
ELIRGRPKEDR

SEQ ID NO: 522688 - protein, 11 aa, Influenza virus
ELIRGRPKEEK

SEQ ID NO: 522689 - protein, 11 aa, Influenza virus
ELIRMIKRGIN

SEQ ID NO: 522690 - protein, 11 aa, Influenza virus
ELIRMIKRGVN

SEQ ID NO: 522691 - protein, 11 aa, Influenza virus
ELIRMVKRGIN

SEQ ID NO: 522692 - protein, 11 aa, Influenza virus
ELIVLLENQKT

SEQ ID NO: 522693 - protein, 11 aa, Influenza virus
ELKEQLSTVSS

SEQ ID NO: 522694 - protein, 11 aa, Influenza virus
ELKSLFSSIKK

SEQ ID NO: 522695 - protein, 11 aa, Influenza virus
ELKWLISKSKE

SEQ ID NO: 522696 - protein, 11 aa, Influenza virus
ELKWLVSKDKG

SEQ ID NO: 522697 - protein, 11 aa, Influenza virus
ELKWLVSKNKG

SEQ ID NO: 522698 - protein, 11 aa, Influenza virus
ELKWLVSKSKG

SEQ ID NO: 522699 - protein, 11 aa, Influenza virus
ELKWLVSKTKG

SEQ ID NO: 522700 - protein, 11 aa, Influenza virus
ELLHKCNDSCM

SEQ ID NO: 522701 - protein, 11 aa, Influenza virus
ELLHKCNNSCM

SEQ ID NO: 522702 - protein, 11 aa, Influenza virus
ELLHKCNNTCM

SEQ ID NO: 522703 - protein, 11 aa, Influenza virus
ELLIAMENQHT

SEQ ID NO: 522704 - protein, 11 aa, Influenza virus
ELLILLENERT

SEQ ID NO: 522705 - protein, 11 aa, Influenza virus
ELLTGNLQTLK

SEQ ID NO: 522706 - protein, 11 aa, Influenza virus
ELLVAIENQHT

SEQ ID NO: 522707 - protein, 11 aa, Influenza virus
ELLVALENQHT

SEQ ID NO: 522708 - protein, 11 aa, Influenza virus
ELLVAMENQHT

SEQ ID NO: 522709 - protein, 11 aa, Influenza virus
ELLVLIENERT

SEQ ID NO: 522710 - protein, 11 aa, Influenza virus
ELLVLIENQKT

SEQ ID NO: 522711 - protein, 11 aa, Influenza virus
ELLVLLEDERT

SEQ ID NO: 522712 - protein, 11 aa, Influenza virus
ELLVLLENERT

SEQ ID NO: 522713 - protein, 11 aa, Influenza virus
ELLVLLENGRT

SEQ ID NO: 522714 - protein, 11 aa, Influenza virus
ELLVLLENQKI

SEQ ID NO: 522715 - protein, 11 aa, Influenza virus
ELLVLLENQKP

SEQ ID NO: 522716 - protein, 11 aa, Influenza virus
ELLVLLENQKT

SEQ ID NO: 522717 - protein, 11 aa, Influenza virus
ELLVLLGNQKT

SEQ ID NO: 522718 - protein, 11 aa, Influenza virus
ELLVLMENEIT

SEQ ID NO: 522719 - protein, 11 aa, Influenza virus
ELLVLMENEMT

SEQ ID NO: 522720 - protein, 11 aa, Influenza virus
ELLVLMENERT

SEQ ID NO: 522721 - protein, 11 aa, Influenza virus
ELNNNGELRHL

SEQ ID NO: 522722 - protein, 11 aa, Influenza virus
ELPFQNLSPRT

SEQ ID NO: 522723 - protein, 11 aa, Influenza virus
ELPSFGVSGIN

SEQ ID NO: 522724 - protein, 11 aa, Influenza virus
ELPSFGVSGVN

SEQ ID NO: 522725 - protein, 11 aa, Influenza virus
ELRDCKIEAVI

SEQ ID NO: 522726 - protein, 11 aa, Influenza virus
ELRDCKVEAVI

SEQ ID NO: 522727 - protein, 11 aa, Influenza virus
ELRDCSIAGWL

SEQ ID NO: 522728 - protein, 11 aa, Influenza virus
ELREHLSSVSS

SEQ ID NO: 522729 - protein, 11 aa, Influenza virus
ELREQLSSVSS

SEQ ID NO: 522730 - protein, 11 aa, Influenza virus
ELREQLSTVSS

SEQ ID NO: 522731 - protein, 11 aa, Influenza virus
ELRFLFSSIKK

SEQ ID NO: 522732 - protein, 11 aa, Influenza virus
ELRFVFSIAAS

SEQ ID NO: 522733 - protein, 11 aa, Influenza virus
ELRFVFSNAAS

SEQ ID NO: 522734 - protein, 11 aa, Influenza virus
ELRFVFSSAAS

SEQ ID NO: 522735 - protein, 11 aa, Influenza virus
ELRHLFSGIKS

SEQ ID NO: 522736 - protein, 11 aa, Influenza virus
ELRHLFSGIRS

SEQ ID NO: 522737 - protein, 11 aa, Influenza virus
ELRHLFSGVNS

SEQ ID NO: 522738 - protein, 11 aa, Influenza virus
ELRRCLLQSLQ

SEQ ID NO: 522739 - protein, 11 aa, Influenza virus
ELRRQKSLIWL

SEQ ID NO: 522740 - protein, 11 aa, Influenza virus
ELRRQKWWVWL

SEQ ID NO: 522741 - protein, 11 aa, Influenza virus
ELRSGYWAIRT

SEQ ID NO: 522742 - protein, 11 aa, Influenza virus
ELRSKYWAIRT

SEQ ID NO: 522743 - protein, 11 aa, Influenza virus
ELRSLFSSIKK

SEQ ID NO: 522744 - protein, 11 aa, Influenza virus
ELRSLFSSIKR

SEQ ID NO: 522745 - protein, 11 aa, Influenza virus
ELRSRYWAIRT

SEQ ID NO: 522746 - protein, 11 aa, Influenza virus
ELSFTITGDNT

SEQ ID NO: 522747 - protein, 11 aa, Influenza virus
ELSFTVTGDNT

SEQ ID NO: 522748 - protein, 11 aa, Influenza virus
ELSSMGVYQIL

SEQ ID NO: 522749 - protein, 11 aa, Influenza virus
ELVETNHTDEL

SEQ ID NO: 522750 - protein, 11 aa, Influenza virus
ELVRKTRFLPV

SEQ ID NO: 522751 - protein, 11 aa, Influenza virus
ELVRMIKRGIN

SEQ ID NO: 522752 - protein, 11 aa, Influenza virus
ELWAYNAELLV

SEQ ID NO: 522753 - protein, 11 aa, Influenza virus
ELWSYNAELLV

SEQ ID NO: 522754 - protein, 11 aa, Influenza virus
ELYGTQSLSIS

SEQ ID NO: 522755 - protein, 11 aa, Influenza virus
EMCAAWSSSSC

SEQ ID NO: 522756 - protein, 11 aa, Influenza virus
EMEGICYPGSI

SEQ ID NO: 522757 - protein, 11 aa, Influenza virus
EMEGICYPGSV

SEQ ID NO: 522758 - protein, 11 aa, Influenza virus
EMEGVCYPGSI

SEQ ID NO: 522759 - protein, 11 aa, Influenza virus
EMGNGCFEFYH

SEQ ID NO: 522760 - protein, 11 aa, Influenza virus
EMIRGQPKEKA

SEQ ID NO: 522761 - protein, 11 aa, Influenza virus
EMIRGQPKEKT

SEQ ID NO: 522762 - protein, 11 aa, Influenza virus
EMIRGQPNERT

SEQ ID NO: 522763 - protein, 11 aa, Influenza virus
EMIWDANGWVS

SEQ ID NO: 522764 - protein, 11 aa, Influenza virus
EMKWLLSNADN

SEQ ID NO: 522765 - protein, 11 aa, Influenza virus
EMKWLLSNNDN

SEQ ID NO: 522766 - protein, 11 aa, Influenza virus
EMKWLLSNSDN

SEQ ID NO: 522767 - protein, 11 aa, Influenza virus
EMKWLLSNSNN

SEQ ID NO: 522768 - protein, 11 aa, Influenza virus
EMKWLLSNTDN

SEQ ID NO: 522769 - protein, 11 aa, Influenza virus
EMKWLLSSKAN

SEQ ID NO: 522770 - protein, 11 aa, Influenza virus
EMKWLLSSKDN

SEQ ID NO: 522771 - protein, 11 aa, Influenza virus
EMKWLLSSSDN

SEQ ID NO: 522772 - protein, 11 aa, Influenza virus
EMKWLLSSTDN

SEQ ID NO: 522773 - protein, 11 aa, Influenza virus
EMKWLSSSGNN

SEQ ID NO: 522774 - protein, 11 aa, Influenza virus
EMKWLSSSMNN

SEQ ID NO: 522775 - protein, 11 aa, Influenza virus
EMLKIHNAGTD

SEQ ID NO: 522776 - protein, 11 aa, Influenza virus
EMLKIPNAETD

SEQ ID NO: 522777 - protein, 11 aa, Influenza virus
EMLKIPNAGID

SEQ ID NO: 522778 - protein, 11 aa, Influenza virus
EMLKIPNAGTD

SEQ ID NO: 522779 - protein, 11 aa, Influenza virus
EMLKVPNAGTD

SEQ ID NO: 522780 - protein, 11 aa, Influenza virus
EMLKVPNALTD

SEQ ID NO: 522781 - protein, 11 aa, Influenza virus
EMLNLYDRVRK

SEQ ID NO: 522782 - protein, 11 aa, Influenza virus
EMLNLYERVRK

SEQ ID NO: 522783 - protein, 11 aa, Influenza virus
EMLRIPNAGID

SEQ ID NO: 522784 - protein, 11 aa, Influenza virus
EMLTGNLQTLK

SEQ ID NO: 522785 - protein, 11 aa, Influenza virus
EMNKLFERVRR

SEQ ID NO: 522786 - protein, 11 aa, Influenza virus
EMNKLYEKVRR

SEQ ID NO: 522787 - protein, 11 aa, Influenza virus
EMNKLYERVKR

SEQ ID NO: 522788 - protein, 11 aa, Influenza virus
EMNKLYERVRK

SEQ ID NO: 522789 - protein, 11 aa, Influenza virus
EMNKLYERVRR

SEQ ID NO: 522790 - protein, 11 aa, Influenza virus
EMRRCLLQSLQ

SEQ ID NO: 522791 - protein, 11 aa, Influenza virus
EMSFQGRGVFE

SEQ ID NO: 522792 - protein, 11 aa, Influenza virus
EMTDSEMLNLY

SEQ ID NO: 522793 - protein, 11 aa, Influenza virus
EMTLDFHDSNV

SEQ ID NO: 522794 - protein, 11 aa, Influenza virus
EMVWDANGWVS

SEQ ID NO: 522795 - protein, 11 aa, Influenza virus
EMVWDDNGWVS

SEQ ID NO: 522796 - protein, 11 aa, Influenza virus
ENAEDIGNGCF

SEQ ID NO: 522797 - protein, 11 aa, Influenza virus
ENAEDKGNGCF

SEQ ID NO: 522798 - protein, 11 aa, Influenza virus
ENAEDMGDGCF

SEQ ID NO: 522799 - protein, 11 aa, Influenza virus
ENAEDMGGGCF

SEQ ID NO: 522800 - protein, 11 aa, Influenza virus
ENAEDMGNGCF

SEQ ID NO: 522801 - protein, 11 aa, Influenza virus
ENAEDMGNGCL

SEQ ID NO: 522802 - protein, 11 aa, Influenza virus
ENAEDQGNGCF

SEQ ID NO: 522803 - protein, 11 aa, Influenza virus
ENAEDRGNGCF

SEQ ID NO: 522804 - protein, 11 aa, Influenza virus
ENAEEDCTGCF

SEQ ID NO: 522805 - protein, 11 aa, Influenza virus
ENAEEDGNGCF

SEQ ID NO: 522806 - protein, 11 aa, Influenza virus
ENAEEDGTGCF

SEQ ID NO: 522807 - protein, 11 aa, Influenza virus
ENAEEMGNGCF

SEQ ID NO: 522808 - protein, 11 aa, Influenza virus
ENAIDAGDGCF

SEQ ID NO: 522809 - protein, 11 aa, Influenza virus
ENAIDNGDGCF

SEQ ID NO: 522810 - protein, 11 aa, Influenza virus
ENAIDTGDGCF

SEQ ID NO: 522811 - protein, 11 aa, Influenza virus
ENALDTGDGCF

SEQ ID NO: 522812 - protein, 11 aa, Influenza virus
ENAVDTGDGCF

SEQ ID NO: 522813 - protein, 11 aa, Influenza virus
ENDKTLDLHDA

SEQ ID NO: 522814 - protein, 11 aa, Influenza virus
ENDKTLDMHDA

SEQ ID NO: 522815 - protein, 11 aa, Influenza virus
ENDKTLNMHDA

SEQ ID NO: 522816 - protein, 11 aa, Influenza virus
ENDRTLDLHDA

SEQ ID NO: 522817 - protein, 11 aa, Influenza virus
ENEKTLDLHDS

SEQ ID NO: 522818 - protein, 11 aa, Influenza virus
ENEMTLDFHDS

SEQ ID NO: 522819 - protein, 11 aa, Influenza virus
ENERILDFHDS

SEQ ID NO: 522820 - protein, 11 aa, Influenza virus
ENERTLDFHDF

SEQ ID NO: 522821 - protein, 11 aa, Influenza virus
ENERTLDFHDL

SEQ ID NO: 522822 - protein, 11 aa, Influenza virus
ENERTLDFHDS

SEQ ID NO: 522823 - protein, 11 aa, Influenza virus
ENERTLDLHDA

SEQ ID NO: 522824 - protein, 11 aa, Influenza virus
ENERTLDLHDS

SEQ ID NO: 522825 - protein, 11 aa, Influenza virus
ENERTLDMHDA

SEQ ID NO: 522826 - protein, 11 aa, Influenza virus
ENERTLDMHDV

SEQ ID NO: 522827 - protein, 11 aa, Influenza virus
ENERTLDQHDA

SEQ ID NO: 522828 - protein, 11 aa, Influenza virus
ENERTLDYHDF

SEQ ID NO: 522829 - protein, 11 aa, Influenza virus
ENERTLDYHDS

SEQ ID NO: 522830 - protein, 11 aa, Influenza virus
ENERTLEFHDS

SEQ ID NO: 522831 - protein, 11 aa, Influenza virus
ENERTLYFHDS

SEQ ID NO: 522832 - protein, 11 aa, Influenza virus
ENGDIIFLWGI

SEQ ID NO: 522833 - protein, 11 aa, Influenza virus
ENGNGCFELYH

SEQ ID NO: 522834 - protein, 11 aa, Influenza virus
ENGRTLDLHDA

SEQ ID NO: 522835 - protein, 11 aa, Influenza virus
ENGRTLDMHDA

SEQ ID NO: 522836 - protein, 11 aa, Influenza virus
ENGRTLGLHDA

SEQ ID NO: 522837 - protein, 11 aa, Influenza virus
ENGTSVKTLTD

SEQ ID NO: 522838 - protein, 11 aa, Influenza virus
ENGVPVTSSID

SEQ ID NO: 522839 - protein, 11 aa, Influenza virus
ENGVPVTSSVD

SEQ ID NO: 522840 - protein, 11 aa, Influenza virus
ENGWEGLIDGW

SEQ ID NO: 522841 - protein, 11 aa, Influenza virus
ENGWEGLINGW

SEQ ID NO: 522842 - protein, 11 aa, Influenza virus
ENGWEGLVDGW

SEQ ID NO: 522843 - protein, 11 aa, Influenza virus
ENGWEGMIDGW

SEQ ID NO: 522844 - protein, 11 aa, Influenza virus
ENGWEGMMDGW

SEQ ID NO: 522845 - protein, 11 aa, Influenza virus
ENGWEGMVDGW

SEQ ID NO: 522846 - protein, 11 aa, Influenza virus
ENGWEGMVNGW

SEQ ID NO: 522847 - protein, 11 aa, Influenza virus
ENGWQGLIDGW

SEQ ID NO: 522848 - protein, 11 aa, Influenza virus
ENKHSNGTKHD

SEQ ID NO: 522849 - protein, 11 aa, Influenza virus
ENKKYGPALSI

SEQ ID NO: 522850 - protein, 11 aa, Influenza virus
ENKRYGPALSI

SEQ ID NO: 522851 - protein, 11 aa, Influenza virus
ENKYVNNTTII

SEQ ID NO: 522852 - protein, 11 aa, Influenza virus
ENLEELRFVFS

SEQ ID NO: 522853 - protein, 11 aa, Influenza virus
ENLFDEVRRRL

SEQ ID NO: 522854 - protein, 11 aa, Influenza virus
ENLNKKIDDGF

SEQ ID NO: 522855 - protein, 11 aa, Influenza virus
ENLNKKMEDGF

SEQ ID NO: 522856 - protein, 11 aa, Influenza virus
ENLNKKMEDGL

SEQ ID NO: 522857 - protein, 11 aa, Influenza virus
ENLNKKVDDGF

SEQ ID NO: 522858 - protein, 11 aa, Influenza virus
ENLNKKVDDGL

SEQ ID NO: 522859 - protein, 11 aa, Influenza virus
ENLNKKVEDGF

SEQ ID NO: 522860 - protein, 11 aa, Influenza virus
ENLNKRMEDGF

SEQ ID NO: 522861 - protein, 11 aa, Influenza virus
ENLNRKMEDGF

SEQ ID NO: 522862 - protein, 11 aa, Influenza virus
ENLNRKVDDGF

SEQ ID NO: 522863 - protein, 11 aa, Influenza virus
ENLQAYQKRMG

SEQ ID NO: 522864 - protein, 11 aa, Influenza virus
ENLQAYQNRMG

SEQ ID NO: 522865 - protein, 11 aa, Influenza virus
ENLQTYQKRMG

SEQ ID NO: 522866 - protein, 11 aa, Influenza virus
ENLWAYNAELL

SEQ ID NO: 522867 - protein, 11 aa, Influenza virus
ENNVTVTSSVE

SEQ ID NO: 522868 - protein, 11 aa, Influenza virus
ENPAHKSQLIW

SEQ ID NO: 522869 - protein, 11 aa, Influenza virus
ENPAHKSQLVW

SEQ ID NO: 522870 - protein, 11 aa, Influenza virus
ENPGVKGWAFD

SEQ ID NO: 522871 - protein, 11 aa, Influenza virus
ENPSAGKDPKK

SEQ ID NO: 522872 - protein, 11 aa, Influenza virus
ENPSHEGEGIP

SEQ ID NO: 522873 - protein, 11 aa, Influenza virus
ENPVHKSQLIW

SEQ ID NO: 522874 - protein, 11 aa, Influenza virus
ENPVICLGHHA

SEQ ID NO: 522875 - protein, 11 aa, Influenza virus
ENQEELKSLFS

SEQ ID NO: 522876 - protein, 11 aa, Influenza virus
ENQEELRFLFS

SEQ ID NO: 522877 - protein, 11 aa, Influenza virus
ENQEELRSLFS

SEQ ID NO: 522878 - protein, 11 aa, Influenza virus
ENQHIIDLADS

SEQ ID NO: 522879 - protein, 11 aa, Influenza virus
ENQHIIDVTDS

SEQ ID NO: 522880 - protein, 11 aa, Influenza virus
ENQHTIDLADS

SEQ ID NO: 522881 - protein, 11 aa, Influenza virus
ENQHTIDLTDA

SEQ ID NO: 522882 - protein, 11 aa, Influenza virus
ENQHTIDLTDS

SEQ ID NO: 522883 - protein, 11 aa, Influenza virus
ENQHTIDLTNS

SEQ ID NO: 522884 - protein, 11 aa, Influenza virus
ENQHTIDMADS

SEQ ID NO: 522885 - protein, 11 aa, Influenza virus
ENQHTIDMTDS

SEQ ID NO: 522886 - protein, 11 aa, Influenza virus
ENQHTIDSTDS

SEQ ID NO: 522887 - protein, 11 aa, Influenza virus
ENQHTIDVTDS

SEQ ID NO: 522888 - protein, 11 aa, Influenza virus
ENQHTIEMTDS

SEQ ID NO: 522889 - protein, 11 aa, Influenza virus
ENQHTIHLTDS

SEQ ID NO: 522890 - protein, 11 aa, Influenza virus
ENQKILDEHDS

SEQ ID NO: 522891 - protein, 11 aa, Influenza virus
ENQKTLDEHDA

SEQ ID NO: 522892 - protein, 11 aa, Influenza virus
ENQKTLDEHDS

SEQ ID NO: 522893 - protein, 11 aa, Influenza virus
ENQKTLDKHDS

SEQ ID NO: 522894 - protein, 11 aa, Influenza virus
ENQNPRIFLAM

SEQ ID NO: 522895 - protein, 11 aa, Influenza virus
ENQNPRMFLAM

SEQ ID NO: 522896 - protein, 11 aa, Influenza virus
ENQNPRVFLAM

SEQ ID NO: 522897 - protein, 11 aa, Influenza virus
ENQNPRVFLTM

SEQ ID NO: 522898 - protein, 11 aa, Influenza virus
ENQNTIDLTDS

SEQ ID NO: 522899 - protein, 11 aa, Influenza virus
ENQSPRMFLAM

SEQ ID NO: 522900 - protein, 11 aa, Influenza virus
ENRINMLADRI

SEQ ID NO: 522901 - protein, 11 aa, Influenza virus
ENRMVIASTTA

SEQ ID NO: 522902 - protein, 11 aa, Influenza virus
ENRMVLASTTA

SEQ ID NO: 522903 - protein, 11 aa, Influenza virus
ENRVWWTSNSI

SEQ ID NO: 522904 - protein, 11 aa, Influenza virus
ENSFEQITFIQ

SEQ ID NO: 522905 - protein, 11 aa, Influenza virus
ENSFEQITFLQ

SEQ ID NO: 522906 - protein, 11 aa, Influenza virus
ENSFEQITFMQ

SEQ ID NO: 522907 - protein, 11 aa, Influenza virus
ENSQGSGYAAD

SEQ ID NO: 522908 - protein, 11 aa, Influenza virus
ENSTYKILSIY

SEQ ID NO: 522909 - protein, 11 aa, Influenza virus
ENTGSYVRLYL

SEQ ID NO: 522910 - protein, 11 aa, Influenza virus
ENTSYKILSIY

SEQ ID NO: 522911 - protein, 11 aa, Influenza virus
ENTTYKILSIY

SEQ ID NO: 522912 - protein, 11 aa, Influenza virus
ENTTYRILSIY

SEQ ID NO: 522913 - protein, 11 aa, Influenza virus
ENTYVNKTTVI

SEQ ID NO: 522914 - protein, 11 aa, Influenza virus
ENTYVNNTTII

SEQ ID NO: 522915 - protein, 11 aa, Influenza virus
ENTYVNNTTVI

SEQ ID NO: 522916 - protein, 11 aa, Influenza virus
EPALIVWGVHH

SEQ ID NO: 522917 - protein, 11 aa, Influenza virus
EPDECRFYALS

SEQ ID NO: 522918 - protein, 11 aa, Influenza virus
EPFISCSHFEC

SEQ ID NO: 522919 - protein, 11 aa, Influenza virus
EPFISCSHLEC

SEQ ID NO: 522920 - protein, 11 aa, Influenza virus
EPFISCSHMEC

SEQ ID NO: 522921 - protein, 11 aa, Influenza virus
EPFISCSHSEC

SEQ ID NO: 522922 - protein, 11 aa, Influenza virus
EPFISCSPLEC

SEQ ID NO: 522923 - protein, 11 aa, Influenza virus
EPFISCSQLEC

SEQ ID NO: 522924 - protein, 11 aa, Influenza virus
EPFVACGPAEC

SEQ ID NO: 522925 - protein, 11 aa, Influenza virus
EPFVACGPSEC

SEQ ID NO: 522926 - protein, 11 aa, Influenza virus
EPFVACGPTEC

SEQ ID NO: 522927 - protein, 11 aa, Influenza virus
EPFVACSPSEC

SEQ ID NO: 522928 - protein, 11 aa, Influenza virus
EPFVSCGPSEC

SEQ ID NO: 522929 - protein, 11 aa, Influenza virus
EPFVSCSHLEC

SEQ ID NO: 522930 - protein, 11 aa, Influenza virus
EPGSGDWPDGS

SEQ ID NO: 522931 - protein, 11 aa, Influenza virus
EPGSGNWPDGA

SEQ ID NO: 522932 - protein, 11 aa, Influenza virus
EPGSGNWPDGP

SEQ ID NO: 522933 - protein, 11 aa, Influenza virus
EPGSGNWPDGS

SEQ ID NO: 522934 - protein, 11 aa, Influenza virus
EPGTFDIEGLY

SEQ ID NO: 522935 - protein, 11 aa, Influenza virus
EPGTFDIGGLY

SEQ ID NO: 522936 - protein, 11 aa, Influenza virus
EPGTFDLEGLY

SEQ ID NO: 522937 - protein, 11 aa, Influenza virus
EPGTFDLGGLY

SEQ ID NO: 522938 - protein, 11 aa, Influenza virus
EPISLGDCSFA

SEQ ID NO: 522939 - protein, 11 aa, Influenza virus
EPKGLFGAIAG

SEQ ID NO: 522940 - protein, 11 aa, Influenza virus
EPLCDVSGFAI

SEQ ID NO: 522941 - protein, 11 aa, Influenza virus
EPLCEVSGFAI

SEQ ID NO: 522942 - protein, 11 aa, Influenza virus
EPLCEVSGFAV

SEQ ID NO: 522943 - protein, 11 aa, Influenza virus
EPLCEVSGFVI

SEQ ID NO: 522944 - protein, 11 aa, Influenza virus
EPLCNVSGFAI

SEQ ID NO: 522945 - protein, 11 aa, Influenza virus
EPMGFRYSGIK

SEQ ID NO: 522946 - protein, 11 aa, Influenza virus
EPRGLFGAIAG

SEQ ID NO: 522947 - protein, 11 aa, Influenza virus
EPSGYAQTDCV

SEQ ID NO: 522948 - protein, 11 aa, Influenza virus
EPTGYAQTDCV

SEQ ID NO: 522949 - protein, 11 aa, Influenza virus
EPYPGNNNNGV

SEQ ID NO: 522950 - protein, 11 aa, Influenza virus
EPYVSCDPDEC

SEQ ID NO: 522951 - protein, 11 aa, Influenza virus
EPYVSCDPDGC

SEQ ID NO: 522952 - protein, 11 aa, Influenza virus
EPYVSCDPLGC

SEQ ID NO: 522953 - protein, 11 aa, Influenza virus
EPYVSCDPNEC

SEQ ID NO: 522954 - protein, 11 aa, Influenza virus
EPYVSCDPSGC

SEQ ID NO: 522955 - protein, 11 aa, Influenza virus
EPYVSCDPTGC

SEQ ID NO: 522956 - protein, 11 aa, Influenza virus
EPYVSCEPDEC

SEQ ID NO: 522957 - protein, 11 aa, Influenza virus
EQAVDICKAAI

SEQ ID NO: 522958 - protein, 11 aa, Influenza virus
EQAVDICKAAL

SEQ ID NO: 522959 - protein, 11 aa, Influenza virus
EQAVDICKAAM

SEQ ID NO: 522960 - protein, 11 aa, Influenza virus
EQAVGICKAAM

SEQ ID NO: 522961 - protein, 11 aa, Influenza virus
EQAVNICKAAM

SEQ ID NO: 522962 - protein, 11 aa, Influenza virus
EQEEVTNATET

SEQ ID NO: 522963 - protein, 11 aa, Influenza virus
EQFPVQTDEYK

SEQ ID NO: 522964 - protein, 11 aa, Influenza virus
EQFTWNGVKVD

SEQ ID NO: 522965 - protein, 11 aa, Influenza virus
EQGMGMAADKE

SEQ ID NO: 522966 - protein, 11 aa, Influenza virus
EQGSGYAADKE

SEQ ID NO: 522967 - protein, 11 aa, Influenza virus
EQGSGYAADLK

SEQ ID NO: 522968 - protein, 11 aa, Influenza virus
EQGSGYAADQK

SEQ ID NO: 522969 - protein, 11 aa, Influenza virus
EQGSGYAADRK

SEQ ID NO: 522970 - protein, 11 aa, Influenza virus
EQGTGIAADKA

SEQ ID NO: 522971 - protein, 11 aa, Influenza virus
EQGTGIAADKE

SEQ ID NO: 522972 - protein, 11 aa, Influenza virus
EQGTGIAADKT

SEQ ID NO: 522973 - protein, 11 aa, Influenza virus
EQGTGIAADKV

SEQ ID NO: 522974 - protein, 11 aa, Influenza virus
EQGTGIAAEKE

SEQ ID NO: 522975 - protein, 11 aa, Influenza virus
EQGVGIAADKE

SEQ ID NO: 522976 - protein, 11 aa, Influenza virus
EQGVGMAADKE

SEQ ID NO: 522977 - protein, 11 aa, Influenza virus
EQIADAQHRSH

SEQ ID NO: 522978 - protein, 11 aa, Influenza virus
EQIADSHHRSH

SEQ ID NO: 522979 - protein, 11 aa, Influenza virus
EQIADSQHKSH

SEQ ID NO: 522980 - protein, 11 aa, Influenza virus
EQIADSQHRSH

SEQ ID NO: 522981 - protein, 11 aa, Influenza virus
EQIAGSSEQAA

SEQ ID NO: 522982 - protein, 11 aa, Influenza virus
EQIIVTREPYV

SEQ ID NO: 522983 - protein, 11 aa, Influenza virus
EQITFIQALQL

SEQ ID NO: 522984 - protein, 11 aa, Influenza virus
EQITFLQALQL

SEQ ID NO: 522985 - protein, 11 aa, Influenza virus
EQITFMQALQL

SEQ ID NO: 522986 - protein, 11 aa, Influenza virus
EQIVVTREPYV

SEQ ID NO: 522987 - protein, 11 aa, Influenza virus
EQKQEFKMNPN

SEQ ID NO: 522988 - protein, 11 aa, Influenza virus
EQKVPVTQTME

SEQ ID NO: 522989 - protein, 11 aa, Influenza virus
EQLGSWSWHDG

SEQ ID NO: 522990 - protein, 11 aa, Influenza virus
EQLSQKFEEIR

SEQ ID NO: 522991 - protein, 11 aa, Influenza virus
EQLSSVSSFEK

SEQ ID NO: 522992 - protein, 11 aa, Influenza virus
EQLSSVSSFER

SEQ ID NO: 522993 - protein, 11 aa, Influenza virus
EQLSSVSSFKR

SEQ ID NO: 522994 - protein, 11 aa, Influenza virus
EQLSTVSSFER

SEQ ID NO: 522995 - protein, 11 aa, Influenza virus
EQMAGSSEQAA

SEQ ID NO: 522996 - protein, 11 aa, Influenza virus
EQMYQKCCNLF

SEQ ID NO: 522997 - protein, 11 aa, Influenza virus
EQMYQKCCSLF

SEQ ID NO: 522998 - protein, 11 aa, Influenza virus
EQMYQKCCTLF

SEQ ID NO: 522999 - protein, 11 aa, Influenza virus
EQMYQRCCNLF

SEQ ID NO: 523000 - protein, 11 aa, Influenza virus
EQNGKSGACKR

SEQ ID NO: 523001 - protein, 11 aa, Influenza virus
EQNIPVTQTME

SEQ ID NO: 523002 - protein, 11 aa, Influenza virus
EQNIPVTQVEE

SEQ ID NO: 523003 - protein, 11 aa, Influenza virus
EQNKLYGAGNK

SEQ ID NO: 523004 - protein, 11 aa, Influenza virus
EQNKLYGTGNK

SEQ ID NO: 523005 - protein, 11 aa, Influenza virus
EQNVPVTQAME

SEQ ID NO: 523006 - protein, 11 aa, Influenza virus
EQNVPVTQTME

SEQ ID NO: 523007 - protein, 11 aa, Influenza virus
EQNVPVTQVEE

SEQ ID NO: 523008 - protein, 11 aa, Influenza virus
EQQGRMDYYWA

SEQ ID NO: 523009 - protein, 11 aa, Influenza virus
EQQGRMDYYWG

SEQ ID NO: 523010 - protein, 11 aa, Influenza virus
EQQIGNVINWT

SEQ ID NO: 523011 - protein, 11 aa, Influenza virus
EQRINMLADRI

SEQ ID NO: 523012 - protein, 11 aa, Influenza virus
EQSGLPVGGNE

SEQ ID NO: 523013 - protein, 11 aa, Influenza virus
EQTALYKNANT

SEQ ID NO: 523014 - protein, 11 aa, Influenza virus
EQTDLYKVATG

SEQ ID NO: 523015 - protein, 11 aa, Influenza virus
EQTKLYGNGNK

SEQ ID NO: 523016 - protein, 11 aa, Influenza virus
EQTKLYGSGNK

SEQ ID NO: 523017 - protein, 11 aa, Influenza virus
EQTKLYGSGSK

SEQ ID NO: 523018 - protein, 11 aa, Influenza virus
EQTKLYKNTNT

SEQ ID NO: 523019 - protein, 11 aa, Influenza virus
EQTTLYKNANT

SEQ ID NO: 523020 - protein, 11 aa, Influenza virus
EQVAGSSEQAA

SEQ ID NO: 523021 - protein, 11 aa, Influenza virus
EQVEGRIQDLE

SEQ ID NO: 523022 - protein, 11 aa, Influenza virus
EQVIVTREPYV

SEQ ID NO: 523023 - protein, 11 aa, Influenza virus
EREAKLFVLFC

SEQ ID NO: 523024 - protein, 11 aa, Influenza virus
EREEVTNATET

SEQ ID NO: 523025 - protein, 11 aa, Influenza virus
EREGGRRRKRG

SEQ ID NO: 523026 - protein, 11 aa, Influenza virus
EREGYSLVGID

SEQ ID NO: 523027 - protein, 11 aa, Influenza virus
EREGYSLVGVD

SEQ ID NO: 523028 - protein, 11 aa, Influenza virus
ERELVRKTRFL

SEQ ID NO: 523029 - protein, 11 aa, Influenza virus
EREVEVVNATE

SEQ ID NO: 523030 - protein, 11 aa, Influenza virus
ERGEDTIEERF

SEQ ID NO: 523031 - protein, 11 aa, Influenza virus
ERGEETIEEKF

SEQ ID NO: 523032 - protein, 11 aa, Influenza virus
ERGEETIEERF

SEQ ID NO: 523033 - protein, 11 aa, Influenza virus
ERGEETVEERF

SEQ ID NO: 523034 - protein, 11 aa, Influenza virus
ERGIEVVNATE

SEQ ID NO: 523035 - protein, 11 aa, Influenza virus
ERGKLKRRAIA

SEQ ID NO: 523036 - protein, 11 aa, Influenza virus
ERGLFGAIAGF

SEQ ID NO: 523037 - protein, 11 aa, Influenza virus
ERGLQRRRFIQ

SEQ ID NO: 523038 - protein, 11 aa, Influenza virus
ERGLQRRRFVQ

SEQ ID NO: 523039 - protein, 11 aa, Influenza virus
ERGNPGVKGWA

SEQ ID NO: 523040 - protein, 11 aa, Influenza virus
ERGNQGVKGWA

SEQ ID NO: 523041 - protein, 11 aa, Influenza virus
ERGSPGVKGWA

SEQ ID NO: 523042 - protein, 11 aa, Influenza virus
ERGTKQEENLT

SEQ ID NO: 523043 - protein, 11 aa, Influenza virus
ERGTQGVKGWA

SEQ ID NO: 523044 - protein, 11 aa, Influenza virus
ERGVEVVDATE

SEQ ID NO: 523045 - protein, 11 aa, Influenza virus
ERGVEVVNATE

SEQ ID NO: 523046 - protein, 11 aa, Influenza virus
ERGYPGVKGWA

SEQ ID NO: 523047 - protein, 11 aa, Influenza virus
ERILDFHDSNV

SEQ ID NO: 523048 - protein, 11 aa, Influenza virus
ERILEEESDEA

SEQ ID NO: 523049 - protein, 11 aa, Influenza virus
ERIMFESNGGL

SEQ ID NO: 523050 - protein, 11 aa, Influenza virus
ERITFESNGGL

SEQ ID NO: 523051 - protein, 11 aa, Influenza virus
ERITFESSGGL

SEQ ID NO: 523052 - protein, 11 aa, Influenza virus
ERLGSWSWHDG

SEQ ID NO: 523053 - protein, 11 aa, Influenza virus
ERLTITYSSSM

SEQ ID NO: 523054 - protein, 11 aa, Influenza virus
ERLVLATGLRN

SEQ ID NO: 523055 - protein, 11 aa, Influenza virus
ERMCNILKGKF

SEQ ID NO: 523056 - protein, 11 aa, Influenza virus
ERMVLSAFDER

SEQ ID NO: 523057 - protein, 11 aa, Influenza virus
ERMYQKCCNLF

SEQ ID NO: 523058 - protein, 11 aa, Influenza virus
ERNALGDCPKY

SEQ ID NO: 523059 - protein, 11 aa, Influenza virus
ERNALGNCPKY

SEQ ID NO: 523060 - protein, 11 aa, Influenza virus
ERNDLYGTQSL

SEQ ID NO: 523061 - protein, 11 aa, Influenza virus
ERNITEIVYLN

SEQ ID NO: 523062 - protein, 11 aa, Influenza virus
ERNSIWTSSSS

SEQ ID NO: 523063 - protein, 11 aa, Influenza virus
ERNVTETLYLN

SEQ ID NO: 523064 - protein, 11 aa, Influenza virus
ERNVTVTHAKD

SEQ ID NO: 523065 - protein, 11 aa, Influenza virus
ERNVTVTHAKN

SEQ ID NO: 523066 - protein, 11 aa, Influenza virus
ERNVTVTHAQD

SEQ ID NO: 523067 - protein, 11 aa, Influenza virus
ERNVTVTHSVE

SEQ ID NO: 523068 - protein, 11 aa, Influenza virus
ERNVTVTHSVN

SEQ ID NO: 523069 - protein, 11 aa, Influenza virus
ERPKEIEGICY

SEQ ID NO: 523070 - protein, 11 aa, Influenza virus
ERPKEMEGICY

SEQ ID NO: 523071 - protein, 11 aa, Influenza virus
ERPKEMEGVCY

SEQ ID NO: 523072 - protein, 11 aa, Influenza virus
ERPSAPEGMCY

SEQ ID NO: 523073 - protein, 11 aa, Influenza virus
ERPTAVDTCYP

SEQ ID NO: 523074 - protein, 11 aa, Influenza virus
ERQIGNVINWT

SEQ ID NO: 523075 - protein, 11 aa, Influenza virus
ERQKINGVKLE

SEQ ID NO: 523076 - protein, 11 aa, Influenza virus
ERQKISGVKLE

SEQ ID NO: 523077 - protein, 11 aa, Influenza virus
ERQKVNGVKLE

SEQ ID NO: 523078 - protein, 11 aa, Influenza virus
ERQRINGVKLE

SEQ ID NO: 523079 - protein, 11 aa, Influenza virus
ERQTRGIFGAI

SEQ ID NO: 523080 - protein, 11 aa, Influenza virus
ERQTRGLFGAI

SEQ ID NO: 523081 - protein, 11 aa, Influenza virus
ERRIENLNKKM

SEQ ID NO: 523082 - protein, 11 aa, Influenza virus
ERRIENLNRKM

SEQ ID NO: 523083 - protein, 11 aa, Influenza virus
ERRIESLNKKM

SEQ ID NO: 523084 - protein, 11 aa, Influenza virus
ERRINMLADRI

SEQ ID NO: 523085 - protein, 11 aa, Influenza virus
ERRLTTTIKTW

SEQ ID NO: 523086 - protein, 11 aa, Influenza virus
ERRNKYLEEHP

SEQ ID NO: 523087 - protein, 11 aa, Influenza virus
ERRNRYLEEHP

SEQ ID NO: 523088 - protein, 11 aa, Influenza virus
ERRNSSDICYP

SEQ ID NO: 523089 - protein, 11 aa, Influenza virus
ERRRKKRGLFG

SEQ ID NO: 523090 - protein, 11 aa, Influenza virus
ERRVENLNKKM

SEQ ID NO: 523091 - protein, 11 aa, Influenza virus
ERSKINEVKLE

SEQ ID NO: 523092 - protein, 11 aa, Influenza virus
ERSKINGVILE

SEQ ID NO: 523093 - protein, 11 aa, Influenza virus
ERSKINGVKLE

SEQ ID NO: 523094 - protein, 11 aa, Influenza virus
ERSKINGVRLE

SEQ ID NO: 523095 - protein, 11 aa, Influenza virus
ERTIWTSGSSI

SEQ ID NO: 523096 - protein, 11 aa, Influenza virus
ERTKEMEGICY

SEQ ID NO: 523097 - protein, 11 aa, Influenza virus
ERTLDFHDFNV

SEQ ID NO: 523098 - protein, 11 aa, Influenza virus
ERTLDFHDSNV

SEQ ID NO: 523099 - protein, 11 aa, Influenza virus
ERTLDFHESNV

SEQ ID NO: 523100 - protein, 11 aa, Influenza virus
ERTLDLHDANV

SEQ ID NO: 523101 - protein, 11 aa, Influenza virus
ERTLDLHDSNV

SEQ ID NO: 523102 - protein, 11 aa, Influenza virus
ERTLDMHDANV

SEQ ID NO: 523103 - protein, 11 aa, Influenza virus
ERTLDQHDANV

SEQ ID NO: 523104 - protein, 11 aa, Influenza virus
ERTLDYHDSNV

SEQ ID NO: 523105 - protein, 11 aa, Influenza virus
ERTLGFHDSNV

SEQ ID NO: 523106 - protein, 11 aa, Influenza virus
ERTLYFHDSNV

SEQ ID NO: 523107 - protein, 11 aa, Influenza virus
ERTNEKFHQIE

SEQ ID NO: 523108 - protein, 11 aa, Influenza virus
ERTNEKYHQIE

SEQ ID NO: 523109 - protein, 11 aa, Influenza virus
ERTNQQFELID

SEQ ID NO: 523110 - protein, 11 aa, Influenza virus
ERTSIWTSSSS

SEQ ID NO: 523111 - protein, 11 aa, Influenza virus
ERTTFESNGGL

SEQ ID NO: 523112 - protein, 11 aa, Influenza virus
ERVKKQLRENA

SEQ ID NO: 523113 - protein, 11 aa, Influenza virus
ERVKMFDFIKW

SEQ ID NO: 523114 - protein, 11 aa, Influenza virus
ERVKMFDFSKW

SEQ ID NO: 523115 - protein, 11 aa, Influenza virus
ERVKMFDFTKW

SEQ ID NO: 523116 - protein, 11 aa, Influenza virus
ERVKRQLRENA

SEQ ID NO: 523117 - protein, 11 aa, Influenza virus
ERVRHQLRENA

SEQ ID NO: 523118 - protein, 11 aa, Influenza virus
ERVRKQLRENA

SEQ ID NO: 523119 - protein, 11 aa, Influenza virus
ERVRKQLRQNA

SEQ ID NO: 523120 - protein, 11 aa, Influenza virus
ERVRNGTYDHK

SEQ ID NO: 523121 - protein, 11 aa, Influenza virus
ERVRRQLRENA

SEQ ID NO: 523122 - protein, 11 aa, Influenza virus
ERYVEDTKIDL

SEQ ID NO: 523123 - protein, 11 aa, Influenza virus
ESADMSIGITV

SEQ ID NO: 523124 - protein, 11 aa, Influenza virus
ESADMSIGVAV

SEQ ID NO: 523125 - protein, 11 aa, Influenza virus
ESADMSIGVTV

SEQ ID NO: 523126 - protein, 11 aa, Influenza virus
ESAVLRGFLII

SEQ ID NO: 523127 - protein, 11 aa, Influenza virus
ESAVLRGFLIL

SEQ ID NO: 523128 - protein, 11 aa, Influenza virus
ESCEGECFYSG

SEQ ID NO: 523129 - protein, 11 aa, Influenza virus
ESDEALKMTIA

SEQ ID NO: 523130 - protein, 11 aa, Influenza virus
ESDGAFLAPRY

SEQ ID NO: 523131 - protein, 11 aa, Influenza virus
ESDGNFIAPEN

SEQ ID NO: 523132 - protein, 11 aa, Influenza virus
ESECACINGSC

SEQ ID NO: 523133 - protein, 11 aa, Influenza virus
ESECACVNGSC

SEQ ID NO: 523134 - protein, 11 aa, Influenza virus
ESECICINGTC

SEQ ID NO: 523135 - protein, 11 aa, Influenza virus
ESECVCHDGVC

SEQ ID NO: 523136 - protein, 11 aa, Influenza virus
ESECVCHKGIC

SEQ ID NO: 523137 - protein, 11 aa, Influenza virus
ESECVCHKGVC

SEQ ID NO: 523138 - protein, 11 aa, Influenza virus
ESECVCHNGIC

SEQ ID NO: 523139 - protein, 11 aa, Influenza virus
ESECVCHNGTC

SEQ ID NO: 523140 - protein, 11 aa, Influenza virus
ESECVCHNGVC

SEQ ID NO: 523141 - protein, 11 aa, Influenza virus
ESECVCHNSTC

SEQ ID NO: 523142 - protein, 11 aa, Influenza virus
ESECVCHSGIC

SEQ ID NO: 523143 - protein, 11 aa, Influenza virus
ESECVCINGIC

SEQ ID NO: 523144 - protein, 11 aa, Influenza virus
ESECVCINGSC

SEQ ID NO: 523145 - protein, 11 aa, Influenza virus
ESECVCINGTC

SEQ ID NO: 523146 - protein, 11 aa, Influenza virus
ESECVCISGTC

SEQ ID NO: 523147 - protein, 11 aa, Influenza virus
ESECVCMNGSC

SEQ ID NO: 523148 - protein, 11 aa, Influenza virus
ESECVCQDEFC

SEQ ID NO: 523149 - protein, 11 aa, Influenza virus
ESECVCVNGSC

SEQ ID NO: 523150 - protein, 11 aa, Influenza virus
ESECVRHNGTC

SEQ ID NO: 523151 - protein, 11 aa, Influenza virus
ESEFNEIEHQI

SEQ ID NO: 523152 - protein, 11 aa, Influenza virus
ESEFNEIEYQI

SEQ ID NO: 523153 - protein, 11 aa, Influenza virus
ESEFSEIEHQI

SEQ ID NO: 523154 - protein, 11 aa, Influenza virus
ESEFSETEHQI

SEQ ID NO: 523155 - protein, 11 aa, Influenza virus
ESEMNKLYERV

SEQ ID NO: 523156 - protein, 11 aa, Influenza virus
ESEQIIVTREP

SEQ ID NO: 523157 - protein, 11 aa, Influenza virus
ESEQIVVTREP

SEQ ID NO: 523158 - protein, 11 aa, Influenza virus
ESEQVIVTREP

SEQ ID NO: 523159 - protein, 11 aa, Influenza virus
ESGGIDKEPMG

SEQ ID NO: 523160 - protein, 11 aa, Influenza virus
ESGGIDKESMG

SEQ ID NO: 523161 - protein, 11 aa, Influenza virus
ESGRLIDFLKD

SEQ ID NO: 523162 - protein, 11 aa, Influenza virus
ESGRLMDFLKD

SEQ ID NO: 523163 - protein, 11 aa, Influenza virus
ESHCRIIQNED

SEQ ID NO: 523164 - protein, 11 aa, Influenza virus
ESHGKIIQNED

SEQ ID NO: 523165 - protein, 11 aa, Influenza virus
ESHGRIIQNED

SEQ ID NO: 523166 - protein, 11 aa, Influenza virus
ESHGRTIQNED

SEQ ID NO: 523167 - protein, 11 aa, Influenza virus
ESIAWSATACH

SEQ ID NO: 523168 - protein, 11 aa, Influenza virus
ESIEECLINDP

SEQ ID NO: 523169 - protein, 11 aa, Influenza virus
ESIESEFNEIE

SEQ ID NO: 523170 - protein, 11 aa, Influenza virus
ESIESEFSEIE

SEQ ID NO: 523171 - protein, 11 aa, Influenza virus
ESIESEFSETE

SEQ ID NO: 523172 - protein, 11 aa, Influenza virus
ESIIEAESSVK

SEQ ID NO: 523173 - protein, 11 aa, Influenza virus
ESIKNGTYDYP

SEQ ID NO: 523174 - protein, 11 aa, Influenza virus
ESIRDNTYDHT

SEQ ID NO: 523175 - protein, 11 aa, Influenza virus
ESIRNGTYDHD

SEQ ID NO: 523176 - protein, 11 aa, Influenza virus
ESIRNGTYDHN

SEQ ID NO: 523177 - protein, 11 aa, Influenza virus
ESIRNGTYNHD

SEQ ID NO: 523178 - protein, 11 aa, Influenza virus
ESIRNGTYNHN

SEQ ID NO: 523179 - protein, 11 aa, Influenza virus
ESIRNNTYDHA

SEQ ID NO: 523180 - protein, 11 aa, Influenza virus
ESIRNNTYDHS

SEQ ID NO: 523181 - protein, 11 aa, Influenza virus
ESIRNNTYDHT

SEQ ID NO: 523182 - protein, 11 aa, Influenza virus
ESIRNNTYNHT

SEQ ID NO: 523183 - protein, 11 aa, Influenza virus
ESKCFWKGGSI

SEQ ID NO: 523184 - protein, 11 aa, Influenza virus
ESKCFWKGGTI

SEQ ID NO: 523185 - protein, 11 aa, Influenza virus
ESKCFWKSGSI

SEQ ID NO: 523186 - protein, 11 aa, Influenza virus
ESKCFWRGGSI

SEQ ID NO: 523187 - protein, 11 aa, Influenza virus
ESKINRQEIEG

SEQ ID NO: 523188 - protein, 11 aa, Influenza virus
ESKLKRNEIKG

SEQ ID NO: 523189 - protein, 11 aa, Influenza virus
ESKLKRQEIDG

SEQ ID NO: 523190 - protein, 11 aa, Influenza virus
ESKLKRQEIEG

SEQ ID NO: 523191 - protein, 11 aa, Influenza virus
ESKLKRQEING

SEQ ID NO: 523192 - protein, 11 aa, Influenza virus
ESKLNRNEIKG

SEQ ID NO: 523193 - protein, 11 aa, Influenza virus
ESKLNRQEIEG

SEQ ID NO: 523194 - protein, 11 aa, Influenza virus
ESKLNRQEIGG

SEQ ID NO: 523195 - protein, 11 aa, Influenza virus
ESKLNRSEIKG

SEQ ID NO: 523196 - protein, 11 aa, Influenza virus
ESKLNRTEIKG

SEQ ID NO: 523197 - protein, 11 aa, Influenza virus
ESLLLATGMKN

SEQ ID NO: 523198 - protein, 11 aa, Influenza virus
ESLLNRLSINP

SEQ ID NO: 523199 - protein, 11 aa, Influenza virus
ESLMLATGMKN

SEQ ID NO: 523200 - protein, 11 aa, Influenza virus
ESLNKKMEDGF

SEQ ID NO: 523201 - protein, 11 aa, Influenza virus
ESLQNRIQIDP

SEQ ID NO: 523202 - protein, 11 aa, Influenza virus
ESLQNRIQIDQ

SEQ ID NO: 523203 - protein, 11 aa, Influenza virus
ESLQNRIQIDS

SEQ ID NO: 523204 - protein, 11 aa, Influenza virus
ESLQNRIQIGP

SEQ ID NO: 523205 - protein, 11 aa, Influenza virus
ESLRLAIGLRN

SEQ ID NO: 523206 - protein, 11 aa, Influenza virus
ESLRLALGLRN

SEQ ID NO: 523207 - protein, 11 aa, Influenza virus
ESLRLAVGLRN

SEQ ID NO: 523208 - protein, 11 aa, Influenza virus
ESLSISVGSST

SEQ ID NO: 523209 - protein, 11 aa, Influenza virus
ESMGFRYSGIR

SEQ ID NO: 523210 - protein, 11 aa, Influenza virus
ESMIEAESSIK

SEQ ID NO: 523211 - protein, 11 aa, Influenza virus
ESMIEAESSVK

SEQ ID NO: 523212 - protein, 11 aa, Influenza virus
ESMIEAESSVR

SEQ ID NO: 523213 - protein, 11 aa, Influenza virus
ESMVEAESSVK

SEQ ID NO: 523214 - protein, 11 aa, Influenza virus
ESNGAFIAPRY

SEQ ID NO: 523215 - protein, 11 aa, Influenza virus
ESNGAFLAPRY

SEQ ID NO: 523216 - protein, 11 aa, Influenza virus
ESNGALLAPRY

SEQ ID NO: 523217 - protein, 11 aa, Influenza virus
ESNGGFLAPRY

SEQ ID NO: 523218 - protein, 11 aa, Influenza virus
ESNGGLIAPRY

SEQ ID NO: 523219 - protein, 11 aa, Influenza virus
ESNGGLLAPKY

SEQ ID NO: 523220 - protein, 11 aa, Influenza virus
ESNGGLLAPRY

SEQ ID NO: 523221 - protein, 11 aa, Influenza virus
ESNGNFIAPEN

SEQ ID NO: 523222 - protein, 11 aa, Influenza virus
ESNGNFIAPEY

SEQ ID NO: 523223 - protein, 11 aa, Influenza virus
ESNGNFITPEY

SEQ ID NO: 523224 - protein, 11 aa, Influenza virus
ESNGNLIAPEY

SEQ ID NO: 523225 - protein, 11 aa, Influenza virus
ESNGNLIAPWY

SEQ ID NO: 523226 - protein, 11 aa, Influenza virus
ESNGNLVAPWY

SEQ ID NO: 523227 - protein, 11 aa, Influenza virus
ESNGVFLAPRY

SEQ ID NO: 523228 - protein, 11 aa, Influenza virus
ESNITVTSSVE

SEQ ID NO: 523229 - protein, 11 aa, Influenza virus
ESNVTVTSSIE

SEQ ID NO: 523230 - protein, 11 aa, Influenza virus
ESNVTVTSSVE

SEQ ID NO: 523231 - protein, 11 aa, Influenza virus
ESQLKKQEIEG

SEQ ID NO: 523232 - protein, 11 aa, Influenza virus
ESQLKRQEIEG

SEQ ID NO: 523233 - protein, 11 aa, Influenza virus
ESRARIKTRLF

SEQ ID NO: 523234 - protein, 11 aa, Influenza virus
ESRGLFGAIAG

SEQ ID NO: 523235 - protein, 11 aa, Influenza virus
ESRINRQEIEG

SEQ ID NO: 523236 - protein, 11 aa, Influenza virus
ESRKLLLIAQA

SEQ ID NO: 523237 - protein, 11 aa, Influenza virus
ESRKLLLITQA

SEQ ID NO: 523238 - protein, 11 aa, Influenza virus
ESRKLLLIVQA

SEQ ID NO: 523239 - protein, 11 aa, Influenza virus
ESRKLLLVVQA

SEQ ID NO: 523240 - protein, 11 aa, Influenza virus
ESRKMLLIVQA

SEQ ID NO: 523241 - protein, 11 aa, Influenza virus
ESRLNRNEIKG

SEQ ID NO: 523242 - protein, 11 aa, Influenza virus
ESRLNRQEIEG

SEQ ID NO: 523243 - protein, 11 aa, Influenza virus
ESRNPGNAEIE

SEQ ID NO: 523244 - protein, 11 aa, Influenza virus
ESRSGFEMIWD

SEQ ID NO: 523245 - protein, 11 aa, Influenza virus
ESRSGFEMVWD

SEQ ID NO: 523246 - protein, 11 aa, Influenza virus
ESRSGYETFKV

SEQ ID NO: 523247 - protein, 11 aa, Influenza virus
ESRSNIFNMER

SEQ ID NO: 523248 - protein, 11 aa, Influenza virus
ESRSPGNAEIE

SEQ ID NO: 523249 - protein, 11 aa, Influenza virus
ESSFEQITFMQ

SEQ ID NO: 523250 - protein, 11 aa, Influenza virus
ESSFYAEMEWL

SEQ ID NO: 523251 - protein, 11 aa, Influenza virus
ESSFYAEMKWL

SEQ ID NO: 523252 - protein, 11 aa, Influenza virus
ESSGGLLAPRY

SEQ ID NO: 523253 - protein, 11 aa, Influenza virus
ESSIGKVCRTL

SEQ ID NO: 523254 - protein, 11 aa, Influenza virus
ESSIKEKDMTK

SEQ ID NO: 523255 - protein, 11 aa, Influenza virus
ESSTYQNNFVP

SEQ ID NO: 523256 - protein, 11 aa, Influenza virus
ESSVKEKDLTK

SEQ ID NO: 523257 - protein, 11 aa, Influenza virus
ESSVKEKDMTK

SEQ ID NO: 523258 - protein, 11 aa, Influenza virus
ESSVKEKDMTR

SEQ ID NO: 523259 - protein, 11 aa, Influenza virus
ESSVREKDMTK

SEQ ID NO: 523260 - protein, 11 aa, Influenza virus
ESTGNFIAPEY

SEQ ID NO: 523261 - protein, 11 aa, Influenza virus
ESTGNLIAPEY

SEQ ID NO: 523262 - protein, 11 aa, Influenza virus
ESTGNLVAPEY

SEQ ID NO: 523263 - protein, 11 aa, Influenza virus
ESTQAAIDQIT

SEQ ID NO: 523264 - protein, 11 aa, Influenza virus
ESTQKAIDQIT

SEQ ID NO: 523265 - protein, 11 aa, Influenza virus
ESTQKAIDRIT

SEQ ID NO: 523266 - protein, 11 aa, Influenza virus
ESVAWSASACH

SEQ ID NO: 523267 - protein, 11 aa, Influenza virus
ESVAWSATACH

SEQ ID NO: 523268 - protein, 11 aa, Influenza virus
ESVAWSATACS

SEQ ID NO: 523269 - protein, 11 aa, Influenza virus
ESVGWSATACH

SEQ ID NO: 523270 - protein, 11 aa, Influenza virus
ESVKNGTYDYP

SEQ ID NO: 523271 - protein, 11 aa, Influenza virus
ESVKNGTYNYP

SEQ ID NO: 523272 - protein, 11 aa, Influenza virus
ESVLINTYQWI

SEQ ID NO: 523273 - protein, 11 aa, Influenza virus
ESVLVNTYQWI

SEQ ID NO: 523274 - protein, 11 aa, Influenza virus
ESVLVNTYQWV

SEQ ID NO: 523275 - protein, 11 aa, Influenza virus
ESVRNGTYDYP

SEQ ID NO: 523276 - protein, 11 aa, Influenza virus
ESYGRIIQNED

SEQ ID NO: 523277 - protein, 11 aa, Influenza virus
ETCSALFVYSL

SEQ ID NO: 523278 - protein, 11 aa, Influenza virus
ETEHQIGNVIN

SEQ ID NO: 523279 - protein, 11 aa, Influenza virus
ETEQTKLYKNT

SEQ ID NO: 523280 - protein, 11 aa, Influenza virus
ETFKVIGGWST

SEQ ID NO: 523281 - protein, 11 aa, Influenza virus
ETFKVIGGWTT

SEQ ID NO: 523282 - protein, 11 aa, Influenza virus
ETFRVIGGWAT

SEQ ID NO: 523283 - protein, 11 aa, Influenza virus
ETFRVIGGWTT

SEQ ID NO: 523284 - protein, 11 aa, Influenza virus
ETFRVIGGWVT

SEQ ID NO: 523285 - protein, 11 aa, Influenza virus
ETFVNMTNVQN

SEQ ID NO: 523286 - protein, 11 aa, Influenza virus
ETFVNVTHVQN

SEQ ID NO: 523287 - protein, 11 aa, Influenza virus
ETFVNVTNVQN

SEQ ID NO: 523288 - protein, 11 aa, Influenza virus
ETGALQLNPID

SEQ ID NO: 523289 - protein, 11 aa, Influenza virus
ETGAPQLNPID

SEQ ID NO: 523290 - protein, 11 aa, Influenza virus
ETGAPQLNPVD

SEQ ID NO: 523291 - protein, 11 aa, Influenza virus
ETGNGCFEFYH

SEQ ID NO: 523292 - protein, 11 aa, Influenza virus
ETGVPVTSSVD

SEQ ID NO: 523293 - protein, 11 aa, Influenza virus
ETGYICSKFHS

SEQ ID NO: 523294 - protein, 11 aa, Influenza virus
ETGYVCGKFHS

SEQ ID NO: 523295 - protein, 11 aa, Influenza virus
ETGYVCSKFHS

SEQ ID NO: 523296 - protein, 11 aa, Influenza virus
ETIIETGYVCS

SEQ ID NO: 523297 - protein, 11 aa, Influenza virus
ETIKNGTYDHK

SEQ ID NO: 523298 - protein, 11 aa, Influenza virus
ETIKNGTYNHK

SEQ ID NO: 523299 - protein, 11 aa, Influenza virus
ETIKNGTYNRK

SEQ ID NO: 523300 - protein, 11 aa, Influenza virus
ETILETGYICS

SEQ ID NO: 523301 - protein, 11 aa, Influenza virus
ETILETGYVCG

SEQ ID NO: 523302 - protein, 11 aa, Influenza virus
ETILETGYVCS

SEQ ID NO: 523303 - protein, 11 aa, Influenza virus
ETILETRYVCS

SEQ ID NO: 523304 - protein, 11 aa, Influenza virus
ETIRNGTYNHE

SEQ ID NO: 523305 - protein, 11 aa, Influenza virus
ETIVETGYVCS

SEQ ID NO: 523306 - protein, 11 aa, Influenza virus
ETKAPQLNPID

SEQ ID NO: 523307 - protein, 11 aa, Influenza virus
ETKCQSPLGAI

SEQ ID NO: 523308 - protein, 11 aa, Influenza virus
ETKCQTPLGAI

SEQ ID NO: 523309 - protein, 11 aa, Influenza virus
ETKCQTPLGAL

SEQ ID NO: 523310 - protein, 11 aa, Influenza virus
ETKGLFGAIAG

SEQ ID NO: 523311 - protein, 11 aa, Influenza virus
ETLKIRTNGNL

SEQ ID NO: 523312 - protein, 11 aa, Influenza virus
ETLKVESNGNL

SEQ ID NO: 523313 - protein, 11 aa, Influenza virus
ETLNIESNGNL

SEQ ID NO: 523314 - protein, 11 aa, Influenza virus
ETLNVESNGNL

SEQ ID NO: 523315 - protein, 11 aa, Influenza virus
ETNGNYGPINV

SEQ ID NO: 523316 - protein, 11 aa, Influenza virus
ETNHTDELCPS

SEQ ID NO: 523317 - protein, 11 aa, Influenza virus
ETNHTGTYCSL

SEQ ID NO: 523318 - protein, 11 aa, Influenza virus
ETNKFAAICTH

SEQ ID NO: 523319 - protein, 11 aa, Influenza virus
ETNKFAAVCTH

SEQ ID NO: 523320 - protein, 11 aa, Influenza virus
ETNKFASICTH

SEQ ID NO: 523321 - protein, 11 aa, Influenza virus
ETNKLAAICTH

SEQ ID NO: 523322 - protein, 11 aa, Influenza virus
ETQCQTPLGAI

SEQ ID NO: 523323 - protein, 11 aa, Influenza virus
ETQTRGIFGAI

SEQ ID NO: 523324 - protein, 11 aa, Influenza virus
ETRGLFGAIAG

SEQ ID NO: 523325 - protein, 11 aa, Influenza virus
ETRVWWTSNSI

SEQ ID NO: 523326 - protein, 11 aa, Influenza virus
ETRVWWTSSSI

SEQ ID NO: 523327 - protein, 11 aa, Influenza virus
ETSHTGTYCSL

SEQ ID NO: 523328 - protein, 11 aa, Influenza virus
ETTGRNCTIPC

SEQ ID NO: 523329 - protein, 11 aa, Influenza virus
ETTGRNCTVPC

SEQ ID NO: 523330 - protein, 11 aa, Influenza virus
ETTHTGTYCSL

SEQ ID NO: 523331 - protein, 11 aa, Influenza virus
ETTVWWTSNSI

SEQ ID NO: 523332 - protein, 11 aa, Influenza virus
ETVEITGIDKV

SEQ ID NO: 523333 - protein, 11 aa, Influenza virus
ETVEITGINKV

SEQ ID NO: 523334 - protein, 11 aa, Influenza virus
ETYKILTIYST

SEQ ID NO: 523335 - protein, 11 aa, Influenza virus
ETYVLSIIPSG

SEQ ID NO: 523336 - protein, 11 aa, Influenza virus
ETYVLSIVPSG

SEQ ID NO: 523337 - protein, 11 aa, Influenza virus
ETYVLSVIPSG

SEQ ID NO: 523338 - protein, 11 aa, Influenza virus
EVCFMYSDFHF

SEQ ID NO: 523339 - protein, 11 aa, Influenza virus
EVCIAWSSSSC

SEQ ID NO: 523340 - protein, 11 aa, Influenza virus
EVDNNGELRHL

SEQ ID NO: 523341 - protein, 11 aa, Influenza virus
EVDQSLIIAAR

SEQ ID NO: 523342 - protein, 11 aa, Influenza virus
EVEGRIQDLEK

SEQ ID NO: 523343 - protein, 11 aa, Influenza virus
EVEGRIQDLER

SEQ ID NO: 523344 - protein, 11 aa, Influenza virus
EVEKQIGNVIN

SEQ ID NO: 523345 - protein, 11 aa, Influenza virus
EVEKQLGNVIN

SEQ ID NO: 523346 - protein, 11 aa, Influenza virus
EVEQQIGNVIN

SEQ ID NO: 523347 - protein, 11 aa, Influenza virus
EVERQIGNVIN

SEQ ID NO: 523348 - protein, 11 aa, Influenza virus
EVETYVLSIIP

SEQ ID NO: 523349 - protein, 11 aa, Influenza virus
EVETYVLSIVP

SEQ ID NO: 523350 - protein, 11 aa, Influenza virus
EVETYVLSVIP

SEQ ID NO: 523351 - protein, 11 aa, Influenza virus
EVEVVNATETV

SEQ ID NO: 523352 - protein, 11 aa, Influenza virus
EVFVIREPCIS

SEQ ID NO: 523353 - protein, 11 aa, Influenza virus
EVFVIREPFIS

SEQ ID NO: 523354 - protein, 11 aa, Influenza virus
EVFVIREPFVS

SEQ ID NO: 523355 - protein, 11 aa, Influenza virus
EVGAKILTSES

SEQ ID NO: 523356 - protein, 11 aa, Influenza virus
EVGARIITSES

SEQ ID NO: 523357 - protein, 11 aa, Influenza virus
EVGARILASES

SEQ ID NO: 523358 - protein, 11 aa, Influenza virus
EVGARILTSES

SEQ ID NO: 523359 - protein, 11 aa, Influenza virus
EVGNGCFEFYH

SEQ ID NO: 523360 - protein, 11 aa, Influenza virus
EVGTRWMKIIR

SEQ ID NO: 523361 - protein, 11 aa, Influenza virus
EVGYLCAGIPT

SEQ ID NO: 523362 - protein, 11 aa, Influenza virus
EVILWFSFGAS

SEQ ID NO: 523363 - protein, 11 aa, Influenza virus
EVITAQELVES

SEQ ID NO: 523364 - protein, 11 aa, Influenza virus
EVKYVWWTSNS

SEQ ID NO: 523365 - protein, 11 aa, Influenza virus
EVLDNKNWSGY

SEQ ID NO: 523366 - protein, 11 aa, Influenza virus
EVLFQGGHIEE

SEQ ID NO: 523367 - protein, 11 aa, Influenza virus
EVLHLTQGACW

SEQ ID NO: 523368 - protein, 11 aa, Influenza virus
EVLHLTQGTCW

SEQ ID NO: 523369 - protein, 11 aa, Influenza virus
EVLNNKHWSGY

SEQ ID NO: 523370 - protein, 11 aa, Influenza virus
EVLNNKNWSGY

SEQ ID NO: 523371 - protein, 11 aa, Influenza virus
EVLNNMNWSGY

SEQ ID NO: 523372 - protein, 11 aa, Influenza virus
EVLRVPNALTD

SEQ ID NO: 523373 - protein, 11 aa, Influenza virus
EVLTGNLQALK

SEQ ID NO: 523374 - protein, 11 aa, Influenza virus
EVLTGNLQTLK

SEQ ID NO: 523375 - protein, 11 aa, Influenza virus
EVLTGNLQTLR

SEQ ID NO: 523376 - protein, 11 aa, Influenza virus
EVLVLMENERT

SEQ ID NO: 523377 - protein, 11 aa, Influenza virus
EVNGPESVLVN

SEQ ID NO: 523378 - protein, 11 aa, Influenza virus
EVNSWHIFSKD

SEQ ID NO: 523379 - protein, 11 aa, Influenza virus
EVNSWHILSKD

SEQ ID NO: 523380 - protein, 11 aa, Influenza virus
EVPGWSWDDGA

SEQ ID NO: 523381 - protein, 11 aa, Influenza virus
EVPGWSWGDGA

SEQ ID NO: 523382 - protein, 11 aa, Influenza virus
EVPSPYNSRFE

SEQ ID NO: 523383 - protein, 11 aa, Influenza virus
EVRHRLKITEN

SEQ ID NO: 523384 - protein, 11 aa, Influenza virus
EVRRDQMAHCR

SEQ ID NO: 523385 - protein, 11 aa, Influenza virus
EVSFQGGHIEE

SEQ ID NO: 523386 - protein, 11 aa, Influenza virus
EVSFQGRGVFE

SEQ ID NO: 523387 - protein, 11 aa, Influenza virus
EVSFRGGHIEE

SEQ ID NO: 523388 - protein, 11 aa, Influenza virus
EVSFRGRGVFE

SEQ ID NO: 523389 - protein, 11 aa, Influenza virus
EVSHCRATEYI

SEQ ID NO: 523390 - protein, 11 aa, Influenza virus
EVSHCRATEYM

SEQ ID NO: 523391 - protein, 11 aa, Influenza virus
EVSSWHILSKD

SEQ ID NO: 523392 - protein, 11 aa, Influenza virus
EVSWTSNSIVT

SEQ ID NO: 523393 - protein, 11 aa, Influenza virus
EVSYCRATEYI

SEQ ID NO: 523394 - protein, 11 aa, Influenza virus
EVTNATELVQG

SEQ ID NO: 523395 - protein, 11 aa, Influenza virus
EVTNATELVQI

SEQ ID NO: 523396 - protein, 11 aa, Influenza virus
EVTNATELVQN

SEQ ID NO: 523397 - protein, 11 aa, Influenza virus
EVTNATELVQS

SEQ ID NO: 523398 - protein, 11 aa, Influenza virus
EVTNATETVEN

SEQ ID NO: 523399 - protein, 11 aa, Influenza virus
EVTNATETVES

SEQ ID NO: 523400 - protein, 11 aa, Influenza virus
EVTNATETVET

SEQ ID NO: 523401 - protein, 11 aa, Influenza virus
EVVAAQELVES

SEQ ID NO: 523402 - protein, 11 aa, Influenza virus
EVVDATETVER

SEQ ID NO: 523403 - protein, 11 aa, Influenza virus
EVVFPNEVGAK

SEQ ID NO: 523404 - protein, 11 aa, Influenza virus
EVVFPNEVGAR

SEQ ID NO: 523405 - protein, 11 aa, Influenza virus
EVVNATETVEI

SEQ ID NO: 523406 - protein, 11 aa, Influenza virus
EVVNATETVEN

SEQ ID NO: 523407 - protein, 11 aa, Influenza virus
EVVNATETVEQ

SEQ ID NO: 523408 - protein, 11 aa, Influenza virus
EVVNATETVER

SEQ ID NO: 523409 - protein, 11 aa, Influenza virus
EVVNATETVET

SEQ ID NO: 523410 - protein, 11 aa, Influenza virus
EVVSAKELVET

SEQ ID NO: 523411 - protein, 11 aa, Influenza virus
EVVTAQELVEA

SEQ ID NO: 523412 - protein, 11 aa, Influenza virus
EVVTAQELVEP

SEQ ID NO: 523413 - protein, 11 aa, Influenza virus
EVVTAQELVES

SEQ ID NO: 523414 - protein, 11 aa, Influenza virus
EVWIGRTKSLE

SEQ ID NO: 523415 - protein, 11 aa, Influenza virus
EVWSYNAEFLV

SEQ ID NO: 523416 - protein, 11 aa, Influenza virus
EVWSYNAELLV

SEQ ID NO: 523417 - protein, 11 aa, Influenza virus
EVWWTSNSIVS

SEQ ID NO: 523418 - protein, 11 aa, Influenza virus
EWGNGCFEFYH

SEQ ID NO: 523419 - protein, 11 aa, Influenza virus
EWIKTRPILSP

SEQ ID NO: 523420 - protein, 11 aa, Influenza virus
EWLKTRPILSP

SEQ ID NO: 523421 - protein, 11 aa, Influenza virus
EWSGYSGSFVQ

SEQ ID NO: 523422 - protein, 11 aa, Influenza virus
EWSKRYELEIG

SEQ ID NO: 523423 - protein, 11 aa, Influenza virus
EWSRRYELEIG

SEQ ID NO: 523424 - protein, 11 aa, Influenza virus
EWSWDDGAILP

SEQ ID NO: 523425 - protein, 11 aa, Influenza virus
EWSYIIEKENP

SEQ ID NO: 523426 - protein, 11 aa, Influenza virus
EWSYIMEKENP

SEQ ID NO: 523427 - protein, 11 aa, Influenza virus
EWSYIVEKENP

SEQ ID NO: 523428 - protein, 11 aa, Influenza virus
EWSYIVERENP

SEQ ID NO: 523429 - protein, 11 aa, Influenza virus
EWSYIVERETP

SEQ ID NO: 523430 - protein, 11 aa, Influenza virus
EWSYIVERPKE

SEQ ID NO: 523431 - protein, 11 aa, Influenza virus
EWSYIVERTKE

SEQ ID NO: 523432 - protein, 11 aa, Influenza virus
EWSYLIEDPAA

SEQ ID NO: 523433 - protein, 11 aa, Influenza virus
EWSYLIEDPGA

SEQ ID NO: 523434 - protein, 11 aa, Influenza virus
EWSYLIEDPNA

SEQ ID NO: 523435 - protein, 11 aa, Influenza virus
EWSYLIEDPSA

SEQ ID NO: 523436 - protein, 11 aa, Influenza virus
EWSYLIEDPTA

SEQ ID NO: 523437 - protein, 11 aa, Influenza virus
EWTSNSLIALC

SEQ ID NO: 523438 - protein, 11 aa, Influenza virus
EYAEESKLKRQ

SEQ ID NO: 523439 - protein, 11 aa, Influenza virus
EYASKTRISEI

SEQ ID NO: 523440 - protein, 11 aa, Influenza virus
EYDAVATTHSW

SEQ ID NO: 523441 - protein, 11 aa, Influenza virus
EYEEEAKLEKS

SEQ ID NO: 523442 - protein, 11 aa, Influenza virus
EYEEEAKLERS

SEQ ID NO: 523443 - protein, 11 aa, Influenza virus
EYEEESKLKRQ

SEQ ID NO: 523444 - protein, 11 aa, Influenza virus
EYGFKISKRGG

SEQ ID NO: 523445 - protein, 11 aa, Influenza virus
EYGFKISKRGN

SEQ ID NO: 523446 - protein, 11 aa, Influenza virus
EYGFKISKRGS

SEQ ID NO: 523447 - protein, 11 aa, Influenza virus
EYGFRISKRGS

SEQ ID NO: 523448 - protein, 11 aa, Influenza virus
EYGHLITGKSH

SEQ ID NO: 523449 - protein, 11 aa, Influenza virus
EYGHLTTGKSH

SEQ ID NO: 523450 - protein, 11 aa, Influenza virus
EYGHLVTGKSH

SEQ ID NO: 523451 - protein, 11 aa, Influenza virus
EYGKGRIFQSH

SEQ ID NO: 523452 - protein, 11 aa, Influenza virus
EYGKGRIFQSP

SEQ ID NO: 523453 - protein, 11 aa, Influenza virus
EYGKGRIFQSR

SEQ ID NO: 523454 - protein, 11 aa, Influenza virus
EYGRGRIFQSR

SEQ ID NO: 523455 - protein, 11 aa, Influenza virus
EYGYLITGKSH

SEQ ID NO: 523456 - protein, 11 aa, Influenza virus
EYKDWILWISF

SEQ ID NO: 523457 - protein, 11 aa, Influenza virus
EYNGKSLGIQS

SEQ ID NO: 523458 - protein, 11 aa, Influenza virus
EYNNTTGRDVL

SEQ ID NO: 523459 - protein, 11 aa, Influenza virus
EYQIGNVINWT

SEQ ID NO: 523460 - protein, 11 aa, Influenza virus
EYQSLRSILAN

SEQ ID NO: 523461 - protein, 11 aa, Influenza virus
EYRQEALQNRI

SEQ ID NO: 523462 - protein, 11 aa, Influenza virus
EYSIDSSYVCS

SEQ ID NO: 523463 - protein, 11 aa, Influenza virus
EYTLDEESRAR

SEQ ID NO: 523464 - protein, 11 aa, Influenza virus
EYYFVKEGKIV

SEQ ID NO: 523465 - protein, 11 aa, Influenza virus
FADQELGDAPF

SEQ ID NO: 523466 - protein, 11 aa, Influenza virus
FAFKFVSSDCS

SEQ ID NO: 523467 - protein, 11 aa, Influenza virus
FAFKQGNSVWA

SEQ ID NO: 523468 - protein, 11 aa, Influenza virus
FAGKNADLEAL

SEQ ID NO: 523469 - protein, 11 aa, Influenza virus
FAGKNSDLEAL

SEQ ID NO: 523470 - protein, 11 aa, Influenza virus
FAGKNTDLEAL

SEQ ID NO: 523471 - protein, 11 aa, Influenza virus
FAGKNTDLEVL

SEQ ID NO: 523472 - protein, 11 aa, Influenza virus
FAGWILGNPMC

SEQ ID NO: 523473 - protein, 11 aa, Influenza virus
FAGWILGNPRC

SEQ ID NO: 523474 - protein, 11 aa, Influenza virus
FAIASKDNGIR

SEQ ID NO: 523475 - protein, 11 aa, Influenza virus
FAIFSKDNGIR

SEQ ID NO: 523476 - protein, 11 aa, Influenza virus
FAIISKDNGIR

SEQ ID NO: 523477 - protein, 11 aa, Influenza virus
FAIVSKDNGIR

SEQ ID NO: 523478 - protein, 11 aa, Influenza virus
FAKDNSIRLSA

SEQ ID NO: 523479 - protein, 11 aa, Influenza virus
FALAQGALLGT

SEQ ID NO: 523480 - protein, 11 aa, Influenza virus
FALAQGALVGT

SEQ ID NO: 523481 - protein, 11 aa, Influenza virus
FALAQGTLLGT

SEQ ID NO: 523482 - protein, 11 aa, Influenza virus
FALAQGVLLGT

SEQ ID NO: 523483 - protein, 11 aa, Influenza virus
FALGQGTTLDN

SEQ ID NO: 523484 - protein, 11 aa, Influenza virus
FALGQGTTLEN

SEQ ID NO: 523485 - protein, 11 aa, Influenza virus
FALGQGTTLKN

SEQ ID NO: 523486 - protein, 11 aa, Influenza virus
FALGQGTTLNN

SEQ ID NO: 523487 - protein, 11 aa, Influenza virus
FALGQGTTLSN

SEQ ID NO: 523488 - protein, 11 aa, Influenza virus
FALGQGTTLYN

SEQ ID NO: 523489 - protein, 11 aa, Influenza virus
FALSGVAIALS

SEQ ID NO: 523490 - protein, 11 aa, Influenza virus
FALSQGALLGT

SEQ ID NO: 523491 - protein, 11 aa, Influenza virus
FALSQGTTLKG

SEQ ID NO: 523492 - protein, 11 aa, Influenza virus
FALSQGTTLRG

SEQ ID NO: 523493 - protein, 11 aa, Influenza virus
FAPFAKDNSIR

SEQ ID NO: 523494 - protein, 11 aa, Influenza virus
FAPFSKDNGIR

SEQ ID NO: 523495 - protein, 11 aa, Influenza virus
FAPFSKDNGVR

SEQ ID NO: 523496 - protein, 11 aa, Influenza virus
FAPFSKDNSIQ

SEQ ID NO: 523497 - protein, 11 aa, Influenza virus
FAPFSKDNSIR

SEQ ID NO: 523498 - protein, 11 aa, Influenza virus
FAPFSKDNSVR

SEQ ID NO: 523499 - protein, 11 aa, Influenza virus
FASSGIAIALG

SEQ ID NO: 523500 - protein, 11 aa, Influenza virus
FASSGIAIVLG

SEQ ID NO: 523501 - protein, 11 aa, Influenza virus
FAVVSKDNGIR

SEQ ID NO: 523502 - protein, 11 aa, Influenza virus
FAYDKICIGYQ

SEQ ID NO: 523503 - protein, 11 aa, Influenza virus
FCGLDNEPGSE

SEQ ID NO: 523504 - protein, 11 aa, Influenza virus
FCGLDNEPGSG

SEQ ID NO: 523505 - protein, 11 aa, Influenza virus
FCGLNNEPGSG

SEQ ID NO: 523506 - protein, 11 aa, Influenza virus
FCGTSGTYGAG

SEQ ID NO: 523507 - protein, 11 aa, Influenza virus
FCGTSGTYGSG

SEQ ID NO: 523508 - protein, 11 aa, Influenza virus
FCGTSGTYGTG

SEQ ID NO: 523509 - protein, 11 aa, Influenza virus
FCGVDSDTTGW

SEQ ID NO: 523510 - protein, 11 aa, Influenza virus
FCGVDSDTTSW

SEQ ID NO: 523511 - protein, 11 aa, Influenza virus
FCGVNSDTTGW

SEQ ID NO: 523512 - protein, 11 aa, Influenza virus
FCGVNSDTTSW

SEQ ID NO: 523513 - protein, 11 aa, Influenza virus
FCGVNSNTTGW

SEQ ID NO: 523514 - protein, 11 aa, Influenza virus
FCGVSGEVPGW

SEQ ID NO: 523515 - protein, 11 aa, Influenza virus
FCGVSSEVPEW

SEQ ID NO: 523516 - protein, 11 aa, Influenza virus
FCGVSSEVPGC

SEQ ID NO: 523517 - protein, 11 aa, Influenza virus
FCGVSSEVPGW

SEQ ID NO: 523518 - protein, 11 aa, Influenza virus
FCLKNGNMRCT

SEQ ID NO: 523519 - protein, 11 aa, Influenza virus
FCLRNGNMRCT

SEQ ID NO: 523520 - protein, 11 aa, Influenza virus
FCSIDGKAPIS

SEQ ID NO: 523521 - protein, 11 aa, Influenza virus
FCSINGKAPIS

SEQ ID NO: 523522 - protein, 11 aa, Influenza virus
FCSINGKEPIS

SEQ ID NO: 523523 - protein, 11 aa, Influenza virus
FCSINGKQPIS

SEQ ID NO: 523524 - protein, 11 aa, Influenza virus
FCSLDGKAPIS

SEQ ID NO: 523525 - protein, 11 aa, Influenza virus
FCYPGELDNNG

SEQ ID NO: 523526 - protein, 11 aa, Influenza virus
FCYTLITDGPS

SEQ ID NO: 523527 - protein, 11 aa, Influenza virus
FCYTLMTDGPS

SEQ ID NO: 523528 - protein, 11 aa, Influenza virus
FCYTLVTDGPS

SEQ ID NO: 523529 - protein, 11 aa, Influenza virus
FDEIGEDVAPI

SEQ ID NO: 523530 - protein, 11 aa, Influenza virus
FDERRNKYLEE

SEQ ID NO: 523531 - protein, 11 aa, Influenza virus
FDERRNRYLEE

SEQ ID NO: 523532 - protein, 11 aa, Influenza virus
FDEVKRRLSAN

SEQ ID NO: 523533 - protein, 11 aa, Influenza virus
FDEVKRRLSTN

SEQ ID NO: 523534 - protein, 11 aa, Influenza virus
FDEVRRRLSAN

SEQ ID NO: 523535 - protein, 11 aa, Influenza virus
FDEVRRRLSTN

SEQ ID NO: 523536 - protein, 11 aa, Influenza virus
FDEVRRRLSVN

SEQ ID NO: 523537 - protein, 11 aa, Influenza virus
FDFIKWNVTYT

SEQ ID NO: 523538 - protein, 11 aa, Influenza virus
FDFSKWNVTYT

SEQ ID NO: 523539 - protein, 11 aa, Influenza virus
FDFTKWNVTHT

SEQ ID NO: 523540 - protein, 11 aa, Influenza virus
FDFTKWNVTYT

SEQ ID NO: 523541 - protein, 11 aa, Influenza virus
FDGGHIEECSC

SEQ ID NO: 523542 - protein, 11 aa, Influenza virus
FDGKEWLHVCI

SEQ ID NO: 523543 - protein, 11 aa, Influenza virus
FDGKEWMHVCI

SEQ ID NO: 523544 - protein, 11 aa, Influenza virus
FDGKEWMHVCM

SEQ ID NO: 523545 - protein, 11 aa, Influenza virus
FDGKEWMHVSM

SEQ ID NO: 523546 - protein, 11 aa, Influenza virus
FDILHKCDNEC

SEQ ID NO: 523547 - protein, 11 aa, Influenza virus
FDILHKCDNKC

SEQ ID NO: 523548 - protein, 11 aa, Influenza virus
FDILHKCNNEC

SEQ ID NO: 523549 - protein, 11 aa, Influenza virus
FDKLYIWGIHH

SEQ ID NO: 523550 - protein, 11 aa, Influenza virus
FDKLYIWGVHH

SEQ ID NO: 523551 - protein, 11 aa, Influenza virus
FDKLYVWGIHH

SEQ ID NO: 523552 - protein, 11 aa, Influenza virus
FDKLYVWGVHH

SEQ ID NO: 523553 - protein, 11 aa, Influenza virus
FDSLNITAASL

SEQ ID NO: 523554 - protein, 11 aa, Influenza virus
FDSNGNFIAPE

SEQ ID NO: 523555 - protein, 11 aa, Influenza virus
FDVPDYQSLRS

SEQ ID NO: 523556 - protein, 11 aa, Influenza virus
FDWTLNRNQPA

SEQ ID NO: 523557 - protein, 11 aa, Influenza virus
FEAVAWSATAC

SEQ ID NO: 523558 - protein, 11 aa, Influenza virus
FECRTFFLTQG

SEQ ID NO: 523559 - protein, 11 aa, Influenza virus
FEECSCYPSGE

SEQ ID NO: 523560 - protein, 11 aa, Influenza virus
FEECSCYPSGT

SEQ ID NO: 523561 - protein, 11 aa, Influenza virus
FEECSCYPSRE

SEQ ID NO: 523562 - protein, 11 aa, Influenza virus
FEFTSFFYRYG

SEQ ID NO: 523563 - protein, 11 aa, Influenza virus
FEFWHKCDDEC

SEQ ID NO: 523564 - protein, 11 aa, Influenza virus
FEFWHKCDNDC

SEQ ID NO: 523565 - protein, 11 aa, Influenza virus
FEFWHKCDNEC

SEQ ID NO: 523566 - protein, 11 aa, Influenza virus
FEFWHKCNNEC

SEQ ID NO: 523567 - protein, 11 aa, Influenza virus
FEFYHKCDDEC

SEQ ID NO: 523568 - protein, 11 aa, Influenza virus
FEFYHKCDNEC

SEQ ID NO: 523569 - protein, 11 aa, Influenza virus
FEFYHKCNDEC

SEQ ID NO: 523570 - protein, 11 aa, Influenza virus
FEGWIGGNPAC

SEQ ID NO: 523571 - protein, 11 aa, Influenza virus
FEGWIVGNPAC

SEQ ID NO: 523572 - protein, 11 aa, Influenza virus
FEGWIVGNPSC

SEQ ID NO: 523573 - protein, 11 aa, Influenza virus
FEIFHKCDDDC

SEQ ID NO: 523574 - protein, 11 aa, Influenza virus
FEIFHKCDDHC

SEQ ID NO: 523575 - protein, 11 aa, Influenza virus
FEIFHKCDDQC

SEQ ID NO: 523576 - protein, 11 aa, Influenza virus
FEIFHKCDDRC

SEQ ID NO: 523577 - protein, 11 aa, Influenza virus
FEIFHKCDNQC

SEQ ID NO: 523578 - protein, 11 aa, Influenza virus
FEIFHQCDNDC

SEQ ID NO: 523579 - protein, 11 aa, Influenza virus
FEIFHQCDNNC

SEQ ID NO: 523580 - protein, 11 aa, Influenza virus
FEIFHRCDDQC

SEQ ID NO: 523581 - protein, 11 aa, Influenza virus
FEIIWDPNGWT

SEQ ID NO: 523582 - protein, 11 aa, Influenza virus
FEKEGYSLVGI

SEQ ID NO: 523583 - protein, 11 aa, Influenza virus
FEKEGYSLVGV

SEQ ID NO: 523584 - protein, 11 aa, Influenza virus
FEKFFPSSSYR

SEQ ID NO: 523585 - protein, 11 aa, Influenza virus
FELFHKCDDDC

SEQ ID NO: 523586 - protein, 11 aa, Influenza virus
FELIDNEFTEV

SEQ ID NO: 523587 - protein, 11 aa, Influenza virus
FELLHKCNDSC

SEQ ID NO: 523588 - protein, 11 aa, Influenza virus
FELLHKCNNSC

SEQ ID NO: 523589 - protein, 11 aa, Influenza virus
FELLHKCNNTC

SEQ ID NO: 523590 - protein, 11 aa, Influenza virus
FEMIWDANGWV

SEQ ID NO: 523591 - protein, 11 aa, Influenza virus
FEMIWDPDGWT

SEQ ID NO: 523592 - protein, 11 aa, Influenza virus
FEMIWDPNGWT

SEQ ID NO: 523593 - protein, 11 aa, Influenza virus
FEMLKIHNAGT

SEQ ID NO: 523594 - protein, 11 aa, Influenza virus
FEMLKIPNAET

SEQ ID NO: 523595 - protein, 11 aa, Influenza virus
FEMLKIPNAGI

SEQ ID NO: 523596 - protein, 11 aa, Influenza virus
FEMLKIPNAGT

SEQ ID NO: 523597 - protein, 11 aa, Influenza virus
FEMLKVPNAGT

SEQ ID NO: 523598 - protein, 11 aa, Influenza virus
FEMLRIPNAGI

SEQ ID NO: 523599 - protein, 11 aa, Influenza virus
FEMVWDANGWV

SEQ ID NO: 523600 - protein, 11 aa, Influenza virus
FEMVWDPNGWT

SEQ ID NO: 523601 - protein, 11 aa, Influenza virus
FEPFQSLIPKA

SEQ ID NO: 523602 - protein, 11 aa, Influenza virus
FEPFQSLVPKA

SEQ ID NO: 523603 - protein, 11 aa, Influenza virus
FEPFQSLVPRA

SEQ ID NO: 523604 - protein, 11 aa, Influenza virus
FEPNGCIEGKL

SEQ ID NO: 523605 - protein, 11 aa, Influenza virus
FEPNGCIESKL

SEQ ID NO: 523606 - protein, 11 aa, Influenza virus
FEPNGSIEGKL

SEQ ID NO: 523607 - protein, 11 aa, Influenza virus
FEPNGYIEGKL

SEQ ID NO: 523608 - protein, 11 aa, Influenza virus
FEQITFIQALQ

SEQ ID NO: 523609 - protein, 11 aa, Influenza virus
FEQITFLQALQ

SEQ ID NO: 523610 - protein, 11 aa, Influenza virus
FEQITFMQALQ

SEQ ID NO: 523611 - protein, 11 aa, Influenza virus
FEQVEGRIQDL

SEQ ID NO: 523612 - protein, 11 aa, Influenza virus
FEQVEGRIQNL

SEQ ID NO: 523613 - protein, 11 aa, Influenza virus
FEQVEGRIQYL

SEQ ID NO: 523614 - protein, 11 aa, Influenza virus
FEQVEGRTQDL

SEQ ID NO: 523615 - protein, 11 aa, Influenza virus
FEREGYSLVGI

SEQ ID NO: 523616 - protein, 11 aa, Influenza virus
FEREGYSLVGV

SEQ ID NO: 523617 - protein, 11 aa, Influenza virus
FERVKRQLREN

SEQ ID NO: 523618 - protein, 11 aa, Influenza virus
FERVRHQLREN

SEQ ID NO: 523619 - protein, 11 aa, Influenza virus
FERVRRQLREN

SEQ ID NO: 523620 - protein, 11 aa, Influenza virus
FESDGAFLAPR

SEQ ID NO: 523621 - protein, 11 aa, Influenza virus
FESIESEFNEI

SEQ ID NO: 523622 - protein, 11 aa, Influenza virus
FESIESEFSEI

SEQ ID NO: 523623 - protein, 11 aa, Influenza virus
FESIESEFSET

SEQ ID NO: 523624 - protein, 11 aa, Influenza virus
FESNGAFIAPR

SEQ ID NO: 523625 - protein, 11 aa, Influenza virus
FESNGAFLAPG

SEQ ID NO: 523626 - protein, 11 aa, Influenza virus
FESNGAFLAPR

SEQ ID NO: 523627 - protein, 11 aa, Influenza virus
FESNGALLAPR

SEQ ID NO: 523628 - protein, 11 aa, Influenza virus
FESNGGFLAPR

SEQ ID NO: 523629 - protein, 11 aa, Influenza virus
FESNGGLIAPR

SEQ ID NO: 523630 - protein, 11 aa, Influenza virus
FESNGGLLAPK

SEQ ID NO: 523631 - protein, 11 aa, Influenza virus
FESNGGLLAPR

SEQ ID NO: 523632 - protein, 11 aa, Influenza virus
FESNGNFIAPE

SEQ ID NO: 523633 - protein, 11 aa, Influenza virus
FESNGNFITPE

SEQ ID NO: 523634 - protein, 11 aa, Influenza virus
FESNGNLIAPE

SEQ ID NO: 523635 - protein, 11 aa, Influenza virus
FESSGGLLAPR

SEQ ID NO: 523636 - protein, 11 aa, Influenza virus
FESTGNFIAPE

SEQ ID NO: 523637 - protein, 11 aa, Influenza virus
FESTGNLIAPE

SEQ ID NO: 523638 - protein, 11 aa, Influenza virus
FESTGNLVAPE

SEQ ID NO: 523639 - protein, 11 aa, Influenza virus
FESVAWSASAC

SEQ ID NO: 523640 - protein, 11 aa, Influenza virus
FESVAWSATAC

SEQ ID NO: 523641 - protein, 11 aa, Influenza virus
FESVEWSATAC

SEQ ID NO: 523642 - protein, 11 aa, Influenza virus
FESVGWSATAC

SEQ ID NO: 523643 - protein, 11 aa, Influenza virus
FFCLKNGNMRC

SEQ ID NO: 523644 - protein, 11 aa, Influenza virus
FFCLRNGNMRC

SEQ ID NO: 523645 - protein, 11 aa, Influenza virus
FFFCLKNGNMR

SEQ ID NO: 523646 - protein, 11 aa, Influenza virus
FFGAIAGFIEG

SEQ ID NO: 523647 - protein, 11 aa, Influenza virus
FFHKCNDSCME

SEQ ID NO: 523648 - protein, 11 aa, Influenza virus
FFLTHGALLND

SEQ ID NO: 523649 - protein, 11 aa, Influenza virus
FFLTHGSLLND

SEQ ID NO: 523650 - protein, 11 aa, Influenza virus
FFLTQGALLND

SEQ ID NO: 523651 - protein, 11 aa, Influenza virus
FFLTQGSLLND

SEQ ID NO: 523652 - protein, 11 aa, Influenza virus
FFLTQGSLVND

SEQ ID NO: 523653 - protein, 11 aa, Influenza virus
FFNNTEPLCEV

SEQ ID NO: 523654 - protein, 11 aa, Influenza virus
FFPDGPQIQYF

SEQ ID NO: 523655 - protein, 11 aa, Influenza virus
FFPFHKDNAIR

SEQ ID NO: 523656 - protein, 11 aa, Influenza virus
FFPFHKDNALR

SEQ ID NO: 523657 - protein, 11 aa, Influenza virus
FFPFHKDNAVR

SEQ ID NO: 523658 - protein, 11 aa, Influenza virus
FFPFHKGNSAR

SEQ ID NO: 523659 - protein, 11 aa, Influenza virus
FFPSSSYRRPI

SEQ ID NO: 523660 - protein, 11 aa, Influenza virus
FFPSSSYRRPV

SEQ ID NO: 523661 - protein, 11 aa, Influenza virus
FFRNIVWLIKK

SEQ ID NO: 523662 - protein, 11 aa, Influenza virus
FFRNVVWLIKK

SEQ ID NO: 523663 - protein, 11 aa, Influenza virus
FFRNVVWLTKK

SEQ ID NO: 523664 - protein, 11 aa, Influenza virus
FFRNVVWLVKK

SEQ ID NO: 523665 - protein, 11 aa, Influenza virus
FFSRLNWLTKA

SEQ ID NO: 523666 - protein, 11 aa, Influenza virus
FFSRLNWLTKE

SEQ ID NO: 523667 - protein, 11 aa, Influenza virus
FFWMCSNGSLQ

SEQ ID NO: 523668 - protein, 11 aa, Influenza virus
FFYRYGFVANF

SEQ ID NO: 523669 - protein, 11 aa, Influenza virus
FGAIAGFIEGG

SEQ ID NO: 523670 - protein, 11 aa, Influenza virus
FGAIAGFIEGR

SEQ ID NO: 523671 - protein, 11 aa, Influenza virus
FGAIAGFIENG

SEQ ID NO: 523672 - protein, 11 aa, Influenza virus
FGAIAGFLENG

SEQ ID NO: 523673 - protein, 11 aa, Influenza virus
FGAKAGFIEGG

SEQ ID NO: 523674 - protein, 11 aa, Influenza virus
FGAKAGFIENG

SEQ ID NO: 523675 - protein, 11 aa, Influenza virus
FGASCFILLAI

SEQ ID NO: 523676 - protein, 11 aa, Influenza virus
FGASCFILLAV

SEQ ID NO: 523677 - protein, 11 aa, Influenza virus
FGASCFLFLAI

SEQ ID NO: 523678 - protein, 11 aa, Influenza virus
FGASCFLLIAI

SEQ ID NO: 523679 - protein, 11 aa, Influenza virus
FGASCFLLLAI

SEQ ID NO: 523680 - protein, 11 aa, Influenza virus
FGASCFLLLAV

SEQ ID NO: 523681 - protein, 11 aa, Influenza virus
FGASCFVLLAA

SEQ ID NO: 523682 - protein, 11 aa, Influenza virus
FGASCFVLLAI

SEQ ID NO: 523683 - protein, 11 aa, Influenza virus
FGASCFVLLAV

SEQ ID NO: 523684 - protein, 11 aa, Influenza virus
FGASCVMLLAI

SEQ ID NO: 523685 - protein, 11 aa, Influenza virus
FGCQNGNIRCT

SEQ ID NO: 523686 - protein, 11 aa, Influenza virus
FGCQNGNVRCT

SEQ ID NO: 523687 - protein, 11 aa, Influenza virus
FGDCPKYVNVK

SEQ ID NO: 523688 - protein, 11 aa, Influenza virus
FGEGEQIIVTR

SEQ ID NO: 523689 - protein, 11 aa, Influenza virus
FGESCFVLLAV

SEQ ID NO: 523690 - protein, 11 aa, Influenza virus
FGESEQIIVTR

SEQ ID NO: 523691 - protein, 11 aa, Influenza virus
FGESEQIVVTR

SEQ ID NO: 523692 - protein, 11 aa, Influenza virus
FGESEQVIVTR

SEQ ID NO: 523693 - protein, 11 aa, Influenza virus
FGFRQGNSVWA

SEQ ID NO: 523694 - protein, 11 aa, Influenza virus
FGFRQGTSVWA

SEQ ID NO: 523695 - protein, 11 aa, Influenza virus
FGGFTFKRTKG

SEQ ID NO: 523696 - protein, 11 aa, Influenza virus
FGGFTFKRTNG

SEQ ID NO: 523697 - protein, 11 aa, Influenza virus
FGGFTFKRTSG

SEQ ID NO: 523698 - protein, 11 aa, Influenza virus
FGKDNAIRIGE

SEQ ID NO: 523699 - protein, 11 aa, Influenza virus
FGKDNAVRIGE

SEQ ID NO: 523700 - protein, 11 aa, Influenza virus
FGLICATCEQI

SEQ ID NO: 523701 - protein, 11 aa, Influenza virus
FGLVCATCEQI

SEQ ID NO: 523702 - protein, 11 aa, Influenza virus
FGNLERRLENL

SEQ ID NO: 523703 - protein, 11 aa, Influenza virus
FGPVHFQNQVK

SEQ ID NO: 523704 - protein, 11 aa, Influenza virus
FGPVHFRNQIK

SEQ ID NO: 523705 - protein, 11 aa, Influenza virus
FGPVHFRNQVK

SEQ ID NO: 523706 - protein, 11 aa, Influenza virus
FGPVHFRSQVK

SEQ ID NO: 523707 - protein, 11 aa, Influenza virus
FGQVEGRIQDL

SEQ ID NO: 523708 - protein, 11 aa, Influenza virus
FGRIDFHWLML

SEQ ID NO: 523709 - protein, 11 aa, Influenza virus
FGVSGINESAD

SEQ ID NO: 523710 - protein, 11 aa, Influenza virus
FGVSGVNESAD

SEQ ID NO: 523711 - protein, 11 aa, Influenza virus
FGYLLKGESHC

SEQ ID NO: 523712 - protein, 11 aa, Influenza virus
FGYLLKGESHG

SEQ ID NO: 523713 - protein, 11 aa, Influenza virus
FGYLLKGESYG

SEQ ID NO: 523714 - protein, 11 aa, Influenza virus
FGYLLRGESHG

SEQ ID NO: 523715 - protein, 11 aa, Influenza virus
FHDSNVKNLYD

SEQ ID NO: 523716 - protein, 11 aa, Influenza virus
FHDSNVKNLYE

SEQ ID NO: 523717 - protein, 11 aa, Influenza virus
FHDSNVKNLYN

SEQ ID NO: 523718 - protein, 11 aa, Influenza virus
FHDSNVKSLYD

SEQ ID NO: 523719 - protein, 11 aa, Influenza virus
FHDSNVRNLYD

SEQ ID NO: 523720 - protein, 11 aa, Influenza virus
FHFEECSCYPS

SEQ ID NO: 523721 - protein, 11 aa, Influenza virus
FHHSNAEGTGM

SEQ ID NO: 523722 - protein, 11 aa, Influenza virus
FHHSNSEGTGM

SEQ ID NO: 523723 - protein, 11 aa, Influenza virus
FHKCDDDCMAS

SEQ ID NO: 523724 - protein, 11 aa, Influenza virus
FHKCDDHCMES

SEQ ID NO: 523725 - protein, 11 aa, Influenza virus
FHKCDDQCMES

SEQ ID NO: 523726 - protein, 11 aa, Influenza virus
FHKCDNQCMES

SEQ ID NO: 523727 - protein, 11 aa, Influenza virus
FHKCNDSCMET

SEQ ID NO: 523728 - protein, 11 aa, Influenza virus
FHKDNAIRLGE

SEQ ID NO: 523729 - protein, 11 aa, Influenza virus
FHKDNALRLAE

SEQ ID NO: 523730 - protein, 11 aa, Influenza virus
FHKDNAVRLGE

SEQ ID NO: 523731 - protein, 11 aa, Influenza virus
FHKGNSARLIH

SEQ ID NO: 523732 - protein, 11 aa, Influenza virus
FHLGTKQVCAA

SEQ ID NO: 523733 - protein, 11 aa, Influenza virus
FHLGTKQVCIA

SEQ ID NO: 523734 - protein, 11 aa, Influenza virus
FHLGTKQVCMA

SEQ ID NO: 523735 - protein, 11 aa, Influenza virus
FHLGTKQVCVA

SEQ ID NO: 523736 - protein, 11 aa, Influenza virus
FHLGTRQVCIA

SEQ ID NO: 523737 - protein, 11 aa, Influenza virus
FHLGTRQVCMA

SEQ ID NO: 523738 - protein, 11 aa, Influenza virus
FHLGTRQVCVA

SEQ ID NO: 523739 - protein, 11 aa, Influenza virus
FHNIHPLAIGE

SEQ ID NO: 523740 - protein, 11 aa, Influenza virus
FHNIHPLTIGE

SEQ ID NO: 523741 - protein, 11 aa, Influenza virus
FHNIHPLTIGK

SEQ ID NO: 523742 - protein, 11 aa, Influenza virus
FHNVHPLAIGE

SEQ ID NO: 523743 - protein, 11 aa, Influenza virus
FHNVHPLTIGE

SEQ ID NO: 523744 - protein, 11 aa, Influenza virus
FHQCDNNCIES

SEQ ID NO: 523745 - protein, 11 aa, Influenza virus
FHQIEKEFSEI

SEQ ID NO: 523746 - protein, 11 aa, Influenza virus
FHQIEKEFSEV

SEQ ID NO: 523747 - protein, 11 aa, Influenza virus
FHQIEKEFTEV

SEQ ID NO: 523748 - protein, 11 aa, Influenza virus
FHRCDDQCMES

SEQ ID NO: 523749 - protein, 11 aa, Influenza virus
FHSDTPRPADP

SEQ ID NO: 523750 - protein, 11 aa, Influenza virus
FHSDTPRPDDP

SEQ ID NO: 523751 - protein, 11 aa, Influenza virus
FHSDTPRPSDP

SEQ ID NO: 523752 - protein, 11 aa, Influenza virus
FHSDTPRPTDP

SEQ ID NO: 523753 - protein, 11 aa, Influenza virus
FHSDTPRPVDP

SEQ ID NO: 523754 - protein, 11 aa, Influenza virus
FHWMLLDPGDT

SEQ ID NO: 523755 - protein, 11 aa, Influenza virus
FIAEQFTWNGV

SEQ ID NO: 523756 - protein, 11 aa, Influenza virus
FIAPDRASFFK

SEQ ID NO: 523757 - protein, 11 aa, Influenza virus
FIAPDRASFFR

SEQ ID NO: 523758 - protein, 11 aa, Influenza virus
FIAPDRASFLR

SEQ ID NO: 523759 - protein, 11 aa, Influenza virus
FIAPDRATFLR

SEQ ID NO: 523760 - protein, 11 aa, Influenza virus
FIAPNRASFFR

SEQ ID NO: 523761 - protein, 11 aa, Influenza virus
FICIKDGNMRC

SEQ ID NO: 523762 - protein, 11 aa, Influenza virus
FICIKNGNMQC

SEQ ID NO: 523763 - protein, 11 aa, Influenza virus
FICIKNGNMRC

SEQ ID NO: 523764 - protein, 11 aa, Influenza virus
FICMKNGNMQC

SEQ ID NO: 523765 - protein, 11 aa, Influenza virus
FICVGWSSTSC

SEQ ID NO: 523766 - protein, 11 aa, Influenza virus
FICVGWSSTTC

SEQ ID NO: 523767 - protein, 11 aa, Influenza virus
FICVKNGNMQC

SEQ ID NO: 523768 - protein, 11 aa, Influenza virus
FICVKNGNMRC

SEQ ID NO: 523769 - protein, 11 aa, Influenza virus
FICVKNGNMRG

SEQ ID NO: 523770 - protein, 11 aa, Influenza virus
FIDIWTYNAEL

SEQ ID NO: 523771 - protein, 11 aa, Influenza virus
FIDVWTYNAEL

SEQ ID NO: 523772 - protein, 11 aa, Influenza virus
FIEGGWCGMID

SEQ ID NO: 523773 - protein, 11 aa, Influenza virus
FIEGGWPGLIN

SEQ ID NO: 523774 - protein, 11 aa, Influenza virus
FIEGGWPGLVA

SEQ ID NO: 523775 - protein, 11 aa, Influenza virus
FIEGGWQGLVD

SEQ ID NO: 523776 - protein, 11 aa, Influenza virus
FIEGGWQGMID

SEQ ID NO: 523777 - protein, 11 aa, Influenza virus
FIEGGWQGMVD

SEQ ID NO: 523778 - protein, 11 aa, Influenza virus
FIEGGWSGLIA

SEQ ID NO: 523779 - protein, 11 aa, Influenza virus
FIEGGWSGLVA

SEQ ID NO: 523780 - protein, 11 aa, Influenza virus
FIEGGWSGLVD

SEQ ID NO: 523781 - protein, 11 aa, Influenza virus
FIEGGWSGMID

SEQ ID NO: 523782 - protein, 11 aa, Influenza virus
FIEGGWTGLID

SEQ ID NO: 523783 - protein, 11 aa, Influenza virus
FIEGGWTGMID

SEQ ID NO: 523784 - protein, 11 aa, Influenza virus
FIEGGWTGMIE

SEQ ID NO: 523785 - protein, 11 aa, Influenza virus
FIEGGWTGMVD

SEQ ID NO: 523786 - protein, 11 aa, Influenza virus
FIEGGWTGMVN

SEQ ID NO: 523787 - protein, 11 aa, Influenza virus
FIEGRWPGLVA

SEQ ID NO: 523788 - protein, 11 aa, Influenza virus
FIENGWEGLID

SEQ ID NO: 523789 - protein, 11 aa, Influenza virus
FIENGWEGLIN

SEQ ID NO: 523790 - protein, 11 aa, Influenza virus
FIENGWEGLVD

SEQ ID NO: 523791 - protein, 11 aa, Influenza virus
FIENGWEGMID

SEQ ID NO: 523792 - protein, 11 aa, Influenza virus
FIENGWEGMMD

SEQ ID NO: 523793 - protein, 11 aa, Influenza virus
FIENGWEGMVD

SEQ ID NO: 523794 - protein, 11 aa, Influenza virus
FIENGWEGMVN

SEQ ID NO: 523795 - protein, 11 aa, Influenza virus
FIENGWQGLID

SEQ ID NO: 523796 - protein, 11 aa, Influenza virus
FIERPTAVDTC

SEQ ID NO: 523797 - protein, 11 aa, Influenza virus
FIFGCQNGNIR

SEQ ID NO: 523798 - protein, 11 aa, Influenza virus
FIFGCQNGNVR

SEQ ID NO: 523799 - protein, 11 aa, Influenza virus
FIFILLTHWAY

SEQ ID NO: 523800 - protein, 11 aa, Influenza virus
FIFLLLTHWAY

SEQ ID NO: 523801 - protein, 11 aa, Influenza virus
FIFNGAFIAPD

SEQ ID NO: 523802 - protein, 11 aa, Influenza virus
FIIKGRSHLRN

SEQ ID NO: 523803 - protein, 11 aa, Influenza virus
FIIREPFISCS

SEQ ID NO: 523804 - protein, 11 aa, Influenza virus
FIIREPFVSCS

SEQ ID NO: 523805 - protein, 11 aa, Influenza virus
FIKDYRYTYRC

SEQ ID NO: 523806 - protein, 11 aa, Influenza virus
FIKWNVTYTGT

SEQ ID NO: 523807 - protein, 11 aa, Influenza virus
FILWACSSGNC

SEQ ID NO: 523808 - protein, 11 aa, Influenza virus
FIMWACNSGNC

SEQ ID NO: 523809 - protein, 11 aa, Influenza virus
FIMWACQKGNI

SEQ ID NO: 523810 - protein, 11 aa, Influenza virus
FIMWACQRGNI

SEQ ID NO: 523811 - protein, 11 aa, Influenza virus
FIMWACSNGNC

SEQ ID NO: 523812 - protein, 11 aa, Influenza virus
FIMWACSNGSC

SEQ ID NO: 523813 - protein, 11 aa, Influenza virus
FIMWACSSGNC

SEQ ID NO: 523814 - protein, 11 aa, Influenza virus
FIMWTCNSGNC

SEQ ID NO: 523815 - protein, 11 aa, Influenza virus
FIMWTCQKGNI

SEQ ID NO: 523816 - protein, 11 aa, Influenza virus
FIQALQLLLEV

SEQ ID NO: 523817 - protein, 11 aa, Influenza virus
FIQHPELTGLN

SEQ ID NO: 523818 - protein, 11 aa, Influenza virus
FIQNALNGNGD

SEQ ID NO: 523819 - protein, 11 aa, Influenza virus
FIVKGRSHLRN

SEQ ID NO: 523820 - protein, 11 aa, Influenza virus
FIVWACQRGNI

SEQ ID NO: 523821 - protein, 11 aa, Influenza virus
FIWAIHHPPTS

SEQ ID NO: 523822 - protein, 11 aa, Influenza virus
FKADLIIERRN

SEQ ID NO: 523823 - protein, 11 aa, Influenza virus
FKGFFPFHKDN

SEQ ID NO: 523824 - protein, 11 aa, Influenza virus
FKHQNAQGEGT

SEQ ID NO: 523825 - protein, 11 aa, Influenza virus
FKISKRGGSGI

SEQ ID NO: 523826 - protein, 11 aa, Influenza virus
FKISKRGNSGI

SEQ ID NO: 523827 - protein, 11 aa, Influenza virus
FKISKRGSSGI

SEQ ID NO: 523828 - protein, 11 aa, Influenza virus
FKISKRGSSGV

SEQ ID NO: 523829 - protein, 11 aa, Influenza virus
FKMNPNKKIIT

SEQ ID NO: 523830 - protein, 11 aa, Influenza virus
FKMNPNQKIII

SEQ ID NO: 523831 - protein, 11 aa, Influenza virus
FKMNPNQKIIT

SEQ ID NO: 523832 - protein, 11 aa, Influenza virus
FKPNGCIEGKL

SEQ ID NO: 523833 - protein, 11 aa, Influenza virus
FKPNIGPRPFV

SEQ ID NO: 523834 - protein, 11 aa, Influenza virus
FKPNIGPRPLV

SEQ ID NO: 523835 - protein, 11 aa, Influenza virus
FKSWKGNIMRT

SEQ ID NO: 523836 - protein, 11 aa, Influenza virus
FKYGDGVWIGR

SEQ ID NO: 523837 - protein, 11 aa, Influenza virus
FKYGNGAWIGR

SEQ ID NO: 523838 - protein, 11 aa, Influenza virus
FKYGNGVWIGR

SEQ ID NO: 523839 - protein, 11 aa, Influenza virus
FLAHALKLVVA

SEQ ID NO: 523840 - protein, 11 aa, Influenza virus
FLAPRYGYIIE

SEQ ID NO: 523841 - protein, 11 aa, Influenza virus
FLARSALILRG

SEQ ID NO: 523842 - protein, 11 aa, Influenza virus
FLCVGWSSTSC

SEQ ID NO: 523843 - protein, 11 aa, Influenza virus
FLDIWTYNAEL

SEQ ID NO: 523844 - protein, 11 aa, Influenza virus
FLDRLRRDQKS

SEQ ID NO: 523845 - protein, 11 aa, Influenza virus
FLDVWTYNAEL

SEQ ID NO: 523846 - protein, 11 aa, Influenza virus
FLENGWEGMVD

SEQ ID NO: 523847 - protein, 11 aa, Influenza virus
FLFSSIKKYER

SEQ ID NO: 523848 - protein, 11 aa, Influenza virus
FLGQWDWPDGA

SEQ ID NO: 523849 - protein, 11 aa, Influenza virus
FLGQWNWPDGA

SEQ ID NO: 523850 - protein, 11 aa, Influenza virus
FLGVWTYNAEL

SEQ ID NO: 523851 - protein, 11 aa, Influenza virus
FLHNGGLIAPS

SEQ ID NO: 523852 - protein, 11 aa, Influenza virus
FLLMDALKLSI

SEQ ID NO: 523853 - protein, 11 aa, Influenza virus
FLLMDSLKLSI

SEQ ID NO: 523854 - protein, 11 aa, Influenza virus
FLNNTEPLCDV

SEQ ID NO: 523855 - protein, 11 aa, Influenza virus
FLNNTEPLCEV

SEQ ID NO: 523856 - protein, 11 aa, Influenza virus
FLNNTEPLCNV

SEQ ID NO: 523857 - protein, 11 aa, Influenza virus
FLNVWTYNAEL

SEQ ID NO: 523858 - protein, 11 aa, Influenza virus
FLQALQLLLEV

SEQ ID NO: 523859 - protein, 11 aa, Influenza virus
FLRSNAPSGIE

SEQ ID NO: 523860 - protein, 11 aa, Influenza virus
FLRSNAPSGVE

SEQ ID NO: 523861 - protein, 11 aa, Influenza virus
FLSMEFSLTDP

SEQ ID NO: 523862 - protein, 11 aa, Influenza virus
FLTHGALLNDK

SEQ ID NO: 523863 - protein, 11 aa, Influenza virus
FLTHGSLLNDK

SEQ ID NO: 523864 - protein, 11 aa, Influenza virus
FLTQGALLNDK

SEQ ID NO: 523865 - protein, 11 aa, Influenza virus
FLTQGALLNDR

SEQ ID NO: 523866 - protein, 11 aa, Influenza virus
FLTQGSLLNDK

SEQ ID NO: 523867 - protein, 11 aa, Influenza virus
FLTQGSLLNDR

SEQ ID NO: 523868 - protein, 11 aa, Influenza virus
FLTQGSLPNDK

SEQ ID NO: 523869 - protein, 11 aa, Influenza virus
FLTSSIVCPGK

SEQ ID NO: 523870 - protein, 11 aa, Influenza virus
FLVALENQHTI

SEQ ID NO: 523871 - protein, 11 aa, Influenza virus
FLVAVENQHTI

SEQ ID NO: 523872 - protein, 11 aa, Influenza virus
FLVCVSLLQSA

SEQ ID NO: 523873 - protein, 11 aa, Influenza virus
FLVLMENERTL

SEQ ID NO: 523874 - protein, 11 aa, Influenza virus
FLWCKIVTTVG

SEQ ID NO: 523875 - protein, 11 aa, Influenza virus
FLWGIHHPPDA

SEQ ID NO: 523876 - protein, 11 aa, Influenza virus
FLWGIHHPPDE

SEQ ID NO: 523877 - protein, 11 aa, Influenza virus
FLWGIHHPPDT

SEQ ID NO: 523878 - protein, 11 aa, Influenza virus
FLWGIHHPPNT

SEQ ID NO: 523879 - protein, 11 aa, Influenza virus
FLWISFAISCF

SEQ ID NO: 523880 - protein, 11 aa, Influenza virus
FLWMCSNGSLQ

SEQ ID NO: 523881 - protein, 11 aa, Influenza virus
FLYIRTNGTSK

SEQ ID NO: 523882 - protein, 11 aa, Influenza virus
FLYVRTNGTSK

SEQ ID NO: 523883 - protein, 11 aa, Influenza virus
FMARSALILRG

SEQ ID NO: 523884 - protein, 11 aa, Influenza virus
FMCVGWSSTTC

SEQ ID NO: 523885 - protein, 11 aa, Influenza virus
FMCVKNGNLRC

SEQ ID NO: 523886 - protein, 11 aa, Influenza virus
FMCVKNGNMRC

SEQ ID NO: 523887 - protein, 11 aa, Influenza virus
FMDVWTYNAEL

SEQ ID NO: 523888 - protein, 11 aa, Influenza virus
FMIIGGFIFGC

SEQ ID NO: 523889 - protein, 11 aa, Influenza virus
FMQALQLLFEV

SEQ ID NO: 523890 - protein, 11 aa, Influenza virus
FMQALQLLLEV

SEQ ID NO: 523891 - protein, 11 aa, Influenza virus
FMWAIHHPPTS

SEQ ID NO: 523892 - protein, 11 aa, Influenza virus
FMYSDFHFIDE

SEQ ID NO: 523893 - protein, 11 aa, Influenza virus
FMYSDFHFINE

SEQ ID NO: 523894 - protein, 11 aa, Influenza virus
FNCLYASPQLE

SEQ ID NO: 523895 - protein, 11 aa, Influenza virus
FNEGHIEECSC

SEQ ID NO: 523896 - protein, 11 aa, Influenza virus
FNEIEHQIGNV

SEQ ID NO: 523897 - protein, 11 aa, Influenza virus
FNEIEQQIGNV

SEQ ID NO: 523898 - protein, 11 aa, Influenza virus
FNEIEYQIGNV

SEQ ID NO: 523899 - protein, 11 aa, Influenza virus
FNEVEQQIGNV

SEQ ID NO: 523900 - protein, 11 aa, Influenza virus
FNFFHKCNDSC

SEQ ID NO: 523901 - protein, 11 aa, Influenza virus
FNFILLTHWAY

SEQ ID NO: 523902 - protein, 11 aa, Influenza virus
FNFNGAFIAPD

SEQ ID NO: 523903 - protein, 11 aa, Influenza virus
FNGAFIAPDRA

SEQ ID NO: 523904 - protein, 11 aa, Influenza virus
FNGAFIAPDRV

SEQ ID NO: 523905 - protein, 11 aa, Influenza virus
FNGAFIAPNRA

SEQ ID NO: 523906 - protein, 11 aa, Influenza virus
FNGAFVAPDRV

SEQ ID NO: 523907 - protein, 11 aa, Influenza virus
FNGGHIEECSC

SEQ ID NO: 523908 - protein, 11 aa, Influenza virus
FNGSLQCRICI

SEQ ID NO: 523909 - protein, 11 aa, Influenza virus
FNKACELTDSI

SEQ ID NO: 523910 - protein, 11 aa, Influenza virus
FNKACELTDSS

SEQ ID NO: 523911 - protein, 11 aa, Influenza virus
FNKACELTDST

SEQ ID NO: 523912 - protein, 11 aa, Influenza virus
FNKACELTDSV

SEQ ID NO: 523913 - protein, 11 aa, Influenza virus
FNKACELTGSS

SEQ ID NO: 523914 - protein, 11 aa, Influenza virus
FNKLYIWGVHH

SEQ ID NO: 523915 - protein, 11 aa, Influenza virus
FNLLHKCNDSC

SEQ ID NO: 523916 - protein, 11 aa, Influenza virus
FNLLIGISNVG

SEQ ID NO: 523917 - protein, 11 aa, Influenza virus
FNMERIKELRD

SEQ ID NO: 523918 - protein, 11 aa, Influenza virus
FNMERIKELRY

SEQ ID NO: 523919 - protein, 11 aa, Influenza virus
FNMLSTVLGVS

SEQ ID NO: 523920 - protein, 11 aa, Influenza virus
FNNLEKRLENL

SEQ ID NO: 523921 - protein, 11 aa, Influenza virus
FNNLERRLENL

SEQ ID NO: 523922 - protein, 11 aa, Influenza virus
FNNLTKGLCII

SEQ ID NO: 523923 - protein, 11 aa, Influenza virus
FNNLTKGLCTI

SEQ ID NO: 523924 - protein, 11 aa, Influenza virus
FNNLTKRLCTI

SEQ ID NO: 523925 - protein, 11 aa, Influenza virus
FNNLTRELCTI

SEQ ID NO: 523926 - protein, 11 aa, Influenza virus
FNNLTRGLCTI

SEQ ID NO: 523927 - protein, 11 aa, Influenza virus
FNNTEPLCEVS

SEQ ID NO: 523928 - protein, 11 aa, Influenza virus
FNPCFYVELIR

SEQ ID NO: 523929 - protein, 11 aa, Influenza virus
FNQVEKRINMI

SEQ ID NO: 523930 - protein, 11 aa, Influenza virus
FNQVEKRINML

SEQ ID NO: 523931 - protein, 11 aa, Influenza virus
FNQVENRINML

SEQ ID NO: 523932 - protein, 11 aa, Influenza virus
FNQVEQRINML

SEQ ID NO: 523933 - protein, 11 aa, Influenza virus
FNSDLDYQIGY

SEQ ID NO: 523934 - protein, 11 aa, Influenza virus
FNSDPDYQIGY

SEQ ID NO: 523935 - protein, 11 aa, Influenza virus
FNSFLAHALKL

SEQ ID NO: 523936 - protein, 11 aa, Influenza virus
FNSFLTHALRF

SEQ ID NO: 523937 - protein, 11 aa, Influenza virus
FNSFLVHALKS

SEQ ID NO: 523938 - protein, 11 aa, Influenza virus
FNSIGNLIAPR

SEQ ID NO: 523939 - protein, 11 aa, Influenza virus
FNSIYASPQLE

SEQ ID NO: 523940 - protein, 11 aa, Influenza virus
FNSLYASPQLE

SEQ ID NO: 523941 - protein, 11 aa, Influenza virus
FNSLYASSQLE

SEQ ID NO: 523942 - protein, 11 aa, Influenza virus
FNSLYSSPQLE

SEQ ID NO: 523943 - protein, 11 aa, Influenza virus
FNSNLDYQIGY

SEQ ID NO: 523944 - protein, 11 aa, Influenza virus
FNSSLTHALRE

SEQ ID NO: 523945 - protein, 11 aa, Influenza virus
FNTIGNLIAPR

SEQ ID NO: 523946 - protein, 11 aa, Influenza virus
FNTIGNLVAPR

SEQ ID NO: 523947 - protein, 11 aa, Influenza virus
FPDGAKIQYFS

SEQ ID NO: 523948 - protein, 11 aa, Influenza virus
FPDGAQIKYFS

SEQ ID NO: 523949 - protein, 11 aa, Influenza virus
FPDGAQIQYFS

SEQ ID NO: 523950 - protein, 11 aa, Influenza virus
FPDGPQIQYFS

SEQ ID NO: 523951 - protein, 11 aa, Influenza virus
FPFHKDNAIRL

SEQ ID NO: 523952 - protein, 11 aa, Influenza virus
FPFHKDNAIRP

SEQ ID NO: 523953 - protein, 11 aa, Influenza virus
FPFHKDNALRL

SEQ ID NO: 523954 - protein, 11 aa, Influenza virus
FPFHKDNAVRL

SEQ ID NO: 523955 - protein, 11 aa, Influenza virus
FPFHKGNSARL

SEQ ID NO: 523956 - protein, 11 aa, Influenza virus
FPGELDNNGEL

SEQ ID NO: 523957 - protein, 11 aa, Influenza virus
FPGEVDNNGEL

SEQ ID NO: 523958 - protein, 11 aa, Influenza virus
FPIGTAPILGN

SEQ ID NO: 523959 - protein, 11 aa, Influenza virus
FPIGTAPVLGN

SEQ ID NO: 523960 - protein, 11 aa, Influenza virus
FPIGVAPVLGN

SEQ ID NO: 523961 - protein, 11 aa, Influenza virus
FPMGTAPVLGN

SEQ ID NO: 523962 - protein, 11 aa, Influenza virus
FPNEVGAKILT

SEQ ID NO: 523963 - protein, 11 aa, Influenza virus
FPNEVGARIIT

SEQ ID NO: 523964 - protein, 11 aa, Influenza virus
FPNEVGARILA

SEQ ID NO: 523965 - protein, 11 aa, Influenza virus
FPNEVGARILT

SEQ ID NO: 523966 - protein, 11 aa, Influenza virus
FPNGAQIQYFS

SEQ ID NO: 523967 - protein, 11 aa, Influenza virus
FPQLNQTYRNN

SEQ ID NO: 523968 - protein, 11 aa, Influenza virus
FPQLNQTYRNT

SEQ ID NO: 523969 - protein, 11 aa, Influenza virus
FPQTANTYRNT

SEQ ID NO: 523970 - protein, 11 aa, Influenza virus
FPQTTNTYRNT

SEQ ID NO: 523971 - protein, 11 aa, Influenza virus
FPRTTNTYRNT

SEQ ID NO: 523972 - protein, 11 aa, Influenza virus
FPSSSYRRPIG

SEQ ID NO: 523973 - protein, 11 aa, Influenza virus
FPSSSYRRPVG

SEQ ID NO: 523974 - protein, 11 aa, Influenza virus
FPSTGNHGSLV

SEQ ID NO: 523975 - protein, 11 aa, Influenza virus
FPVGSGSFPDG

SEQ ID NO: 523976 - protein, 11 aa, Influenza virus
FPVGTAPVLGN

SEQ ID NO: 523977 - protein, 11 aa, Influenza virus
FPVQTDEYKNT

SEQ ID NO: 523978 - protein, 11 aa, Influenza virus
FPYTGDPPYSH

SEQ ID NO: 523979 - protein, 11 aa, Influenza virus
FQGFFPFHKDN

SEQ ID NO: 523980 - protein, 11 aa, Influenza virus
FQGGHIEECSC

SEQ ID NO: 523981 - protein, 11 aa, Influenza virus
FQGRGVFEFSD

SEQ ID NO: 523982 - protein, 11 aa, Influenza virus
FQGRGVFELSD

SEQ ID NO: 523983 - protein, 11 aa, Influenza virus
FQHQNAEGIGI

SEQ ID NO: 523984 - protein, 11 aa, Influenza virus
FQHQNAEGTGI

SEQ ID NO: 523985 - protein, 11 aa, Influenza virus
FQHQNAEGTGM

SEQ ID NO: 523986 - protein, 11 aa, Influenza virus
FQHQNEQGMGM

SEQ ID NO: 523987 - protein, 11 aa, Influenza virus
FQHQNEQGTGI

SEQ ID NO: 523988 - protein, 11 aa, Influenza virus
FQHQNEQGVGI

SEQ ID NO: 523989 - protein, 11 aa, Influenza virus
FQHQNEQGVGM

SEQ ID NO: 523990 - protein, 11 aa, Influenza virus
FQHQNSEGTGI

SEQ ID NO: 523991 - protein, 11 aa, Influenza virus
FQHRDEEGTGI

SEQ ID NO: 523992 - protein, 11 aa, Influenza virus
FQHRNEEGTGI

SEQ ID NO: 523993 - protein, 11 aa, Influenza virus
FQHRNEEGTGV

SEQ ID NO: 523994 - protein, 11 aa, Influenza virus
FQIQGIKLTQG

SEQ ID NO: 523995 - protein, 11 aa, Influenza virus
FQIQGVKLAQG

SEQ ID NO: 523996 - protein, 11 aa, Influenza virus
FQIQGVKLIQG

SEQ ID NO: 523997 - protein, 11 aa, Influenza virus
FQIQGVKLTQG

SEQ ID NO: 523998 - protein, 11 aa, Influenza virus
FQIQGVRLTQG

SEQ ID NO: 523999 - protein, 11 aa, Influenza virus
FQLFLVCVSLL

SEQ ID NO: 524000 - protein, 11 aa, Influenza virus
FQLIPMISKCK

SEQ ID NO: 524001 - protein, 11 aa, Influenza virus
FQLIPMISKCR

SEQ ID NO: 524002 - protein, 11 aa, Influenza virus
FQLIPMISKSR

SEQ ID NO: 524003 - protein, 11 aa, Influenza virus
FQNASRHHMGE

SEQ ID NO: 524004 - protein, 11 aa, Influenza virus
FQNASRHYMGE

SEQ ID NO: 524005 - protein, 11 aa, Influenza virus
FQNASRYYMGE

SEQ ID NO: 524006 - protein, 11 aa, Influenza virus
FQNICKPYIGK

SEQ ID NO: 524007 - protein, 11 aa, Influenza virus
FQNIDKNALGD

SEQ ID NO: 524008 - protein, 11 aa, Influenza virus
FQNIDKNALGE

SEQ ID NO: 524009 - protein, 11 aa, Influenza virus
FQNIDRNAIGD

SEQ ID NO: 524010 - protein, 11 aa, Influenza virus
FQNIDRNALGD

SEQ ID NO: 524011 - protein, 11 aa, Influenza virus
FQNIDSRAVGK

SEQ ID NO: 524012 - protein, 11 aa, Influenza virus
FQNIDSWAVGR

SEQ ID NO: 524013 - protein, 11 aa, Influenza virus
FQNIEKNALGD

SEQ ID NO: 524014 - protein, 11 aa, Influenza virus
FQNIERNALGD

SEQ ID NO: 524015 - protein, 11 aa, Influenza virus
FQNIERNALGN

SEQ ID NO: 524016 - protein, 11 aa, Influenza virus
FQNINRITYGA

SEQ ID NO: 524017 - protein, 11 aa, Influenza virus
FQNLSPRTVGQ

SEQ ID NO: 524018 - protein, 11 aa, Influenza virus
FQNQVKIRRRV

SEQ ID NO: 524019 - protein, 11 aa, Influenza virus
FQNTSKHYIGK

SEQ ID NO: 524020 - protein, 11 aa, Influenza virus
FQNTSRHYIGK

SEQ ID NO: 524021 - protein, 11 aa, Influenza virus
FQNTSRHYMGE

SEQ ID NO: 524022 - protein, 11 aa, Influenza virus
FQNVNKITYGA

SEQ ID NO: 524023 - protein, 11 aa, Influenza virus
FQNVNRITYGA

SEQ ID NO: 524024 - protein, 11 aa, Influenza virus
FQNVNRITYGP

SEQ ID NO: 524025 - protein, 11 aa, Influenza virus
FQNVNRITYGV

SEQ ID NO: 524026 - protein, 11 aa, Influenza virus
FQNVSRIAIGN

SEQ ID NO: 524027 - protein, 11 aa, Influenza virus
FQPCFYIELIR

SEQ ID NO: 524028 - protein, 11 aa, Influenza virus
FQPCFYVELIR

SEQ ID NO: 524029 - protein, 11 aa, Influenza virus
FQPCFYVELTR

SEQ ID NO: 524030 - protein, 11 aa, Influenza virus
FQPNIGPRALV

SEQ ID NO: 524031 - protein, 11 aa, Influenza virus
FQPNIGPRPLV

SEQ ID NO: 524032 - protein, 11 aa, Influenza virus
FQQMRDILGTF

SEQ ID NO: 524033 - protein, 11 aa, Influenza virus
FQQMRDVLGTF

SEQ ID NO: 524034 - protein, 11 aa, Influenza virus
FQSCFYVELIR

SEQ ID NO: 524035 - protein, 11 aa, Influenza virus
FQTAAQKAMMD

SEQ ID NO: 524036 - protein, 11 aa, Influenza virus
FQTAAQRAMMD

SEQ ID NO: 524037 - protein, 11 aa, Influenza virus
FQTAAQRAMVD

SEQ ID NO: 524038 - protein, 11 aa, Influenza virus
FQVDCFIWHIR

SEQ ID NO: 524039 - protein, 11 aa, Influenza virus
FQVDCFLWHIR

SEQ ID NO: 524040 - protein, 11 aa, Influenza virus
FQVDCFLWHVR

SEQ ID NO: 524041 - protein, 11 aa, Influenza virus
FQVDCFLWYVR

SEQ ID NO: 524042 - protein, 11 aa, Influenza virus
FQVDCYLWHIR

SEQ ID NO: 524043 - protein, 11 aa, Influenza virus
FQYLLFQDILM

SEQ ID NO: 524044 - protein, 11 aa, Influenza virus
FRALISWEMGL

SEQ ID NO: 524045 - protein, 11 aa, Influenza virus
FRALISWEMGQ

SEQ ID NO: 524046 - protein, 11 aa, Influenza virus
FRALISWGMGQ

SEQ ID NO: 524047 - protein, 11 aa, Influenza virus
FRALVSWEMGQ

SEQ ID NO: 524048 - protein, 11 aa, Influenza virus
FRAYVDGFEPN

SEQ ID NO: 524049 - protein, 11 aa, Influenza virus
FRAYVDGFKPN

SEQ ID NO: 524050 - protein, 11 aa, Influenza virus
FRDNLEPGTFD

SEQ ID NO: 524051 - protein, 11 aa, Influenza virus
FRDVWTYNAEL

SEQ ID NO: 524052 - protein, 11 aa, Influenza virus
FREQKQEFKMN

SEQ ID NO: 524053 - protein, 11 aa, Influenza virus
FRGFFPFHKDN

SEQ ID NO: 524054 - protein, 11 aa, Influenza virus
FRGGHIEECSC

SEQ ID NO: 524055 - protein, 11 aa, Influenza virus
FRGLISTPLGS

SEQ ID NO: 524056 - protein, 11 aa, Influenza virus
FRGLISTPLGT

SEQ ID NO: 524057 - protein, 11 aa, Influenza virus
FRGLMSTPLGT

SEQ ID NO: 524058 - protein, 11 aa, Influenza virus
FRGRGVFELSD

SEQ ID NO: 524059 - protein, 11 aa, Influenza virus
FRHQNAEGTGT

SEQ ID NO: 524060 - protein, 11 aa, Influenza virus
FRHQNAQGEGI

SEQ ID NO: 524061 - protein, 11 aa, Influenza virus
FRHQNAQGEGT

SEQ ID NO: 524062 - protein, 11 aa, Influenza virus
FRHQNAQGIGQ

SEQ ID NO: 524063 - protein, 11 aa, Influenza virus
FRHQNAQGQGT

SEQ ID NO: 524064 - protein, 11 aa, Influenza virus
FRHQNAQGTGQ

SEQ ID NO: 524065 - protein, 11 aa, Influenza virus
FRHQNSEGTGT

SEQ ID NO: 524066 - protein, 11 aa, Influenza virus
FRHQNTQGEGT

SEQ ID NO: 524067 - protein, 11 aa, Influenza virus
FRISKRGSSGI

SEQ ID NO: 524068 - protein, 11 aa, Influenza virus
FRNALSIAPIM

SEQ ID NO: 524069 - protein, 11 aa, Influenza virus
FRNILSIAPIM

SEQ ID NO: 524070 - protein, 11 aa, Influenza virus
FRNILSMAPIM

SEQ ID NO: 524071 - protein, 11 aa, Influenza virus
FRNQIKIRRRV

SEQ ID NO: 524072 - protein, 11 aa, Influenza virus
FRNQVKIRRRV

SEQ ID NO: 524073 - protein, 11 aa, Influenza virus
FRNVLSIAPIM

SEQ ID NO: 524074 - protein, 11 aa, Influenza virus
FRNVLSVAPIM

SEQ ID NO: 524075 - protein, 11 aa, Influenza virus
FRPNIGPRPLI

SEQ ID NO: 524076 - protein, 11 aa, Influenza virus
FRPNIGPRPLV

SEQ ID NO: 524077 - protein, 11 aa, Influenza virus
FRQGNNVWAGR

SEQ ID NO: 524078 - protein, 11 aa, Influenza virus
FRQGNSVWAGR

SEQ ID NO: 524079 - protein, 11 aa, Influenza virus
FRQGTSVWAGR

SEQ ID NO: 524080 - protein, 11 aa, Influenza virus
FRQSERGEDTI

SEQ ID NO: 524081 - protein, 11 aa, Influenza virus
FRQSERGEETI

SEQ ID NO: 524082 - protein, 11 aa, Influenza virus
FRQSERGEETV

SEQ ID NO: 524083 - protein, 11 aa, Influenza virus
FRRPDSSWLFG

SEQ ID NO: 524084 - protein, 11 aa, Influenza virus
FRTLMSCPIGV

SEQ ID NO: 524085 - protein, 11 aa, Influenza virus
FRTLMSCPMGV

SEQ ID NO: 524086 - protein, 11 aa, Influenza virus
FRTLMSCPVGV

SEQ ID NO: 524087 - protein, 11 aa, Influenza virus
FRTYVDGFEPN

SEQ ID NO: 524088 - protein, 11 aa, Influenza virus
FRTYVDGFKPN

SEQ ID NO: 524089 - protein, 11 aa, Influenza virus
FRVYVDGFEPN

SEQ ID NO: 524090 - protein, 11 aa, Influenza virus
FRYGDGVWIGR

SEQ ID NO: 524091 - protein, 11 aa, Influenza virus
FRYGNGVWIGR

SEQ ID NO: 524092 - protein, 11 aa, Influenza virus
FRYSGIKTDGA

SEQ ID NO: 524093 - protein, 11 aa, Influenza virus
FRYSGIRTDGA

SEQ ID NO: 524094 - protein, 11 aa, Influenza virus
FSAESRKLLLI

SEQ ID NO: 524095 - protein, 11 aa, Influenza virus
FSAESRKLLLV

SEQ ID NO: 524096 - protein, 11 aa, Influenza virus
FSAESRKMLLI

SEQ ID NO: 524097 - protein, 11 aa, Influenza virus
FSARSALILRG

SEQ ID NO: 524098 - protein, 11 aa, Influenza virus
FSEIEGRIQDL

SEQ ID NO: 524099 - protein, 11 aa, Influenza virus
FSEIEHQIGNV

SEQ ID NO: 524100 - protein, 11 aa, Influenza virus
FSEIEHQISNV

SEQ ID NO: 524101 - protein, 11 aa, Influenza virus
FSEIEQQIGNV

SEQ ID NO: 524102 - protein, 11 aa, Influenza virus
FSETEHQIGNV

SEQ ID NO: 524103 - protein, 11 aa, Influenza virus
FSEVEGRIQDL

SEQ ID NO: 524104 - protein, 11 aa, Influenza virus
FSFGASCFIFL

SEQ ID NO: 524105 - protein, 11 aa, Influenza virus
FSFGASCFILL

SEQ ID NO: 524106 - protein, 11 aa, Influenza virus
FSFGASCFLFL

SEQ ID NO: 524107 - protein, 11 aa, Influenza virus
FSFGASCFLLI

SEQ ID NO: 524108 - protein, 11 aa, Influenza virus
FSFGASCFLLL

SEQ ID NO: 524109 - protein, 11 aa, Influenza virus
FSFGASCFVLL

SEQ ID NO: 524110 - protein, 11 aa, Influenza virus
FSFGASCVMLL

SEQ ID NO: 524111 - protein, 11 aa, Influenza virus
FSFGASSFVLL

SEQ ID NO: 524112 - protein, 11 aa, Influenza virus
FSFGGFTFKRT

SEQ ID NO: 524113 - protein, 11 aa, Influenza virus
FSFIGEEMATK

SEQ ID NO: 524114 - protein, 11 aa, Influenza virus
FSFNGAFIAPD

SEQ ID NO: 524115 - protein, 11 aa, Influenza virus
FSFNGAFVAPD

SEQ ID NO: 524116 - protein, 11 aa, Influenza virus
FSFNGEEMATK

SEQ ID NO: 524117 - protein, 11 aa, Influenza virus
FSFQLINNKKP

SEQ ID NO: 524118 - protein, 11 aa, Influenza virus
FSFRYGDGVWI

SEQ ID NO: 524119 - protein, 11 aa, Influenza virus
FSFSISCFLLV

SEQ ID NO: 524120 - protein, 11 aa, Influenza virus
FSFTGEEMASK

SEQ ID NO: 524121 - protein, 11 aa, Influenza virus
FSFTGEEMATK

SEQ ID NO: 524122 - protein, 11 aa, Influenza virus
FSFTGEEMATR

SEQ ID NO: 524123 - protein, 11 aa, Influenza virus
FSGGHIEECSC

SEQ ID NO: 524124 - protein, 11 aa, Influenza virus
FSGIKSFSRTE

SEQ ID NO: 524125 - protein, 11 aa, Influenza virus
FSGIKSFSRTQ

SEQ ID NO: 524126 - protein, 11 aa, Influenza virus
FSGIRSFSRTE

SEQ ID NO: 524127 - protein, 11 aa, Influenza virus
FSGKNTDLEAL

SEQ ID NO: 524128 - protein, 11 aa, Influenza virus
FSGMSANGDIL

SEQ ID NO: 524129 - protein, 11 aa, Influenza virus
FSGSQKQEFKM

SEQ ID NO: 524130 - protein, 11 aa, Influenza virus
FSGVNSFSRTE

SEQ ID NO: 524131 - protein, 11 aa, Influenza virus
FSHNGGLIAPD

SEQ ID NO: 524132 - protein, 11 aa, Influenza virus
FSHNGGLIAPS

SEQ ID NO: 524133 - protein, 11 aa, Influenza virus
FSHNGGLVAPS

SEQ ID NO: 524134 - protein, 11 aa, Influenza virus
FSIAASYKRIR

SEQ ID NO: 524135 - protein, 11 aa, Influenza virus
FSILHKCNDSC

SEQ ID NO: 524136 - protein, 11 aa, Influenza virus
FSIRGETTGRN

SEQ ID NO: 524137 - protein, 11 aa, Influenza virus
FSIRWETTGRN

SEQ ID NO: 524138 - protein, 11 aa, Influenza virus
FSISCFLLAAL

SEQ ID NO: 524139 - protein, 11 aa, Influenza virus
FSISCFLLIAL

SEQ ID NO: 524140 - protein, 11 aa, Influenza virus
FSISCFLLVAL

SEQ ID NO: 524141 - protein, 11 aa, Influenza virus
FSKDNAIRIGE

SEQ ID NO: 524142 - protein, 11 aa, Influenza virus
FSKDNGIRIGS

SEQ ID NO: 524143 - protein, 11 aa, Influenza virus
FSKDNSIQLSA

SEQ ID NO: 524144 - protein, 11 aa, Influenza virus
FSKDNSIRLAA

SEQ ID NO: 524145 - protein, 11 aa, Influenza virus
FSKDNSIRLSA

SEQ ID NO: 524146 - protein, 11 aa, Influenza virus
FSKDNSVRLSA

SEQ ID NO: 524147 - protein, 11 aa, Influenza virus
FSKWNVTYTGT

SEQ ID NO: 524148 - protein, 11 aa, Influenza virus
FSLLHKCNDSC

SEQ ID NO: 524149 - protein, 11 aa, Influenza virus
FSMELPSFGVS

SEQ ID NO: 524150 - protein, 11 aa, Influenza virus
FSMSCFVFVAL

SEQ ID NO: 524151 - protein, 11 aa, Influenza virus
FSNAASYKRIR

SEQ ID NO: 524152 - protein, 11 aa, Influenza virus
FSNKMARLGKG

SEQ ID NO: 524153 - protein, 11 aa, Influenza virus
FSNKMARLGRG

SEQ ID NO: 524154 - protein, 11 aa, Influenza virus
FSNKVARLGKG

SEQ ID NO: 524155 - protein, 11 aa, Influenza virus
FSNLEKRLENL

SEQ ID NO: 524156 - protein, 11 aa, Influenza virus
FSNLERRLENL

SEQ ID NO: 524157 - protein, 11 aa, Influenza virus
FSPSPGARPKV

SEQ ID NO: 524158 - protein, 11 aa, Influenza virus
FSPSPGDRPKV

SEQ ID NO: 524159 - protein, 11 aa, Influenza virus
FSQVEQRINML

SEQ ID NO: 524160 - protein, 11 aa, Influenza virus
FSQVERRINML

SEQ ID NO: 524161 - protein, 11 aa, Influenza virus
FSRLNWLTKAT

SEQ ID NO: 524162 - protein, 11 aa, Influenza virus
FSRLNWLTKET

SEQ ID NO: 524163 - protein, 11 aa, Influenza virus
FSRTELINPNK

SEQ ID NO: 524164 - protein, 11 aa, Influenza virus
FSRTELINPSK

SEQ ID NO: 524165 - protein, 11 aa, Influenza virus
FSRTELIPPSK

SEQ ID NO: 524166 - protein, 11 aa, Influenza virus
FSRTELISPNK

SEQ ID NO: 524167 - protein, 11 aa, Influenza virus
FSRTELISPSK

SEQ ID NO: 524168 - protein, 11 aa, Influenza virus
FSSAASYKRIR

SEQ ID NO: 524169 - protein, 11 aa, Influenza virus
FSSAASYKRVR

SEQ ID NO: 524170 - protein, 11 aa, Influenza virus
FSSIKKYERVK

SEQ ID NO: 524171 - protein, 11 aa, Influenza virus
FSSIKRYERVK

SEQ ID NO: 524172 - protein, 11 aa, Influenza virus
FSSLAVNVRGS

SEQ ID NO: 524173 - protein, 11 aa, Influenza virus
FSSLTVNVRGS

SEQ ID NO: 524174 - protein, 11 aa, Influenza virus
FSSLTVNVRGT

SEQ ID NO: 524175 - protein, 11 aa, Influenza virus
FSSLTVSVRGS

SEQ ID NO: 524176 - protein, 11 aa, Influenza virus
FSVGSGSFPDG

SEQ ID NO: 524177 - protein, 11 aa, Influenza virus
FSVQRNLPFDK

SEQ ID NO: 524178 - protein, 11 aa, Influenza virus
FSVQRNLPFEK

SEQ ID NO: 524179 - protein, 11 aa, Influenza virus
FSVQRNLPFER

SEQ ID NO: 524180 - protein, 11 aa, Influenza virus
FSVQRSLPFER

SEQ ID NO: 524181 - protein, 11 aa, Influenza virus
FTAEISHCRAT

SEQ ID NO: 524182 - protein, 11 aa, Influenza virus
FTAEVSHCRAT

SEQ ID NO: 524183 - protein, 11 aa, Influenza virus
FTAEVSYCRAT

SEQ ID NO: 524184 - protein, 11 aa, Influenza virus
FTDGSATGPAD

SEQ ID NO: 524185 - protein, 11 aa, Influenza virus
FTDGSATGPAE

SEQ ID NO: 524186 - protein, 11 aa, Influenza virus
FTEEVSHCRAT

SEQ ID NO: 524187 - protein, 11 aa, Influenza virus
FTEGHIEECSC

SEQ ID NO: 524188 - protein, 11 aa, Influenza virus
FTEVEGRIQDL

SEQ ID NO: 524189 - protein, 11 aa, Influenza virus
FTEVEKQIGNV

SEQ ID NO: 524190 - protein, 11 aa, Influenza virus
FTEVEQQIGNV

SEQ ID NO: 524191 - protein, 11 aa, Influenza virus
FTFNGAFIAPD

SEQ ID NO: 524192 - protein, 11 aa, Influenza virus
FTFNGAFIAPN

SEQ ID NO: 524193 - protein, 11 aa, Influenza virus
FTGWILGNPMC

SEQ ID NO: 524194 - protein, 11 aa, Influenza virus
FTITGDNTKWN

SEQ ID NO: 524195 - protein, 11 aa, Influenza virus
FTKWNVTHTGT

SEQ ID NO: 524196 - protein, 11 aa, Influenza virus
FTKWNVTYTGI

SEQ ID NO: 524197 - protein, 11 aa, Influenza virus
FTKWNVTYTGT

SEQ ID NO: 524198 - protein, 11 aa, Influenza virus
FTLSGVAIALS

SEQ ID NO: 524199 - protein, 11 aa, Influenza virus
FTLTVPSERGL

SEQ ID NO: 524200 - protein, 11 aa, Influenza virus
FTNEEALRQII

SEQ ID NO: 524201 - protein, 11 aa, Influenza virus
FTSFFYRYGFV

SEQ ID NO: 524202 - protein, 11 aa, Influenza virus
FTTEVSHCRAT

SEQ ID NO: 524203 - protein, 11 aa, Influenza virus
FTWAIHHPPTS

SEQ ID NO: 524204 - protein, 11 aa, Influenza virus
FTWAIHHPPTT

SEQ ID NO: 524205 - protein, 11 aa, Influenza virus
FTWNGVKVDGS

SEQ ID NO: 524206 - protein, 11 aa, Influenza virus
FVACGPAECRT

SEQ ID NO: 524207 - protein, 11 aa, Influenza virus
FVACGPSECRT

SEQ ID NO: 524208 - protein, 11 aa, Influenza virus
FVACGPTECRT

SEQ ID NO: 524209 - protein, 11 aa, Influenza virus
FVACSPSECRT

SEQ ID NO: 524210 - protein, 11 aa, Influenza virus
FVALILGFVLW

SEQ ID NO: 524211 - protein, 11 aa, Influenza virus
FVANFSMELPS

SEQ ID NO: 524212 - protein, 11 aa, Influenza virus
FVENLEELRFV

SEQ ID NO: 524213 - protein, 11 aa, Influenza virus
FVFSIAASYKR

SEQ ID NO: 524214 - protein, 11 aa, Influenza virus
FVFSNAASYKR

SEQ ID NO: 524215 - protein, 11 aa, Influenza virus
FVFSSAASYKR

SEQ ID NO: 524216 - protein, 11 aa, Influenza virus
FVFTLTVPSER

SEQ ID NO: 524217 - protein, 11 aa, Influenza virus
FVFVALILGFV

SEQ ID NO: 524218 - protein, 11 aa, Influenza virus
FVIREPFISCS

SEQ ID NO: 524219 - protein, 11 aa, Influenza virus
FVIREPFVACG

SEQ ID NO: 524220 - protein, 11 aa, Influenza virus
FVIREPFVACS

SEQ ID NO: 524221 - protein, 11 aa, Influenza virus
FVIREPFVSCG

SEQ ID NO: 524222 - protein, 11 aa, Influenza virus
FVIREPFVSCS

SEQ ID NO: 524223 - protein, 11 aa, Influenza virus
FVLMENERTLD

SEQ ID NO: 524224 - protein, 11 aa, Influenza virus
FVLWACQNGNI

SEQ ID NO: 524225 - protein, 11 aa, Influenza virus
FVMREPFISCS

SEQ ID NO: 524226 - protein, 11 aa, Influenza virus
FVMWACQKGNI

SEQ ID NO: 524227 - protein, 11 aa, Influenza virus
FVNITNVQNNY

SEQ ID NO: 524228 - protein, 11 aa, Influenza virus
FVNRANQRLNP

SEQ ID NO: 524229 - protein, 11 aa, Influenza virus
FVNRANQRLNT

SEQ ID NO: 524230 - protein, 11 aa, Influenza virus
FVNVTHVQNNY

SEQ ID NO: 524231 - protein, 11 aa, Influenza virus
FVNVTNVQNDY

SEQ ID NO: 524232 - protein, 11 aa, Influenza virus
FVNVTNVQNNY

SEQ ID NO: 524233 - protein, 11 aa, Influenza virus
FVPVIGARPQV

SEQ ID NO: 524234 - protein, 11 aa, Influenza virus
FVPVMGARPQV

SEQ ID NO: 524235 - protein, 11 aa, Influenza virus
FVPVVGARPQV

SEQ ID NO: 524236 - protein, 11 aa, Influenza virus
FVPVVGDRPLV

SEQ ID NO: 524237 - protein, 11 aa, Influenza virus
FVPVVRARPQV

SEQ ID NO: 524238 - protein, 11 aa, Influenza virus
FVQHPELTGLD

SEQ ID NO: 524239 - protein, 11 aa, Influenza virus
FVQHPELTGLN

SEQ ID NO: 524240 - protein, 11 aa, Influenza virus
FVQHPELTGMD

SEQ ID NO: 524241 - protein, 11 aa, Influenza virus
FVQHPELTGMN

SEQ ID NO: 524242 - protein, 11 aa, Influenza virus
FVQHPELTGVD

SEQ ID NO: 524243 - protein, 11 aa, Influenza virus
FVQHPEMTGLD

SEQ ID NO: 524244 - protein, 11 aa, Influenza virus
FVQNALNGNGD

SEQ ID NO: 524245 - protein, 11 aa, Influenza virus
FVQNALSGNGD

SEQ ID NO: 524246 - protein, 11 aa, Influenza virus
FVQSYFQLFLV

SEQ ID NO: 524247 - protein, 11 aa, Influenza virus
FVRGQQGRMDY

SEQ ID NO: 524248 - protein, 11 aa, Influenza virus
FVRTLFQQMRD

SEQ ID NO: 524249 - protein, 11 aa, Influenza virus
FVSCGPSECRT

SEQ ID NO: 524250 - protein, 11 aa, Influenza virus
FVSMEFSLTDP

SEQ ID NO: 524251 - protein, 11 aa, Influenza virus
FVVREPFISCS

SEQ ID NO: 524252 - protein, 11 aa, Influenza virus
FWIELIRGRPK

SEQ ID NO: 524253 - protein, 11 aa, Influenza virus
FWKGGSIKTKL

SEQ ID NO: 524254 - protein, 11 aa, Influenza virus
FWKGGSINTKL

SEQ ID NO: 524255 - protein, 11 aa, Influenza virus
FWLEMIRGKPE

SEQ ID NO: 524256 - protein, 11 aa, Influenza virus
FWLEMIRGKPK

SEQ ID NO: 524257 - protein, 11 aa, Influenza virus
FWLEMIRGRPE

SEQ ID NO: 524258 - protein, 11 aa, Influenza virus
FWMCPNGSLQC

SEQ ID NO: 524259 - protein, 11 aa, Influenza virus
FWMCSGHSCRI

SEQ ID NO: 524260 - protein, 11 aa, Influenza virus
FWMCSNGPLQC

SEQ ID NO: 524261 - protein, 11 aa, Influenza virus
FWMCSNGSLHG

SEQ ID NO: 524262 - protein, 11 aa, Influenza virus
FWMCSNGSLQC

SEQ ID NO: 524263 - protein, 11 aa, Influenza virus
FWMCSNGSLRC

SEQ ID NO: 524264 - protein, 11 aa, Influenza virus
FWRGDNGRRTR

SEQ ID NO: 524265 - protein, 11 aa, Influenza virus
FWRGENGRKTR

SEQ ID NO: 524266 - protein, 11 aa, Influenza virus
FWRGENGRRTR

SEQ ID NO: 524267 - protein, 11 aa, Influenza virus
FWRGGSINTKL

SEQ ID NO: 524268 - protein, 11 aa, Influenza virus
FWRGGSINTRL

SEQ ID NO: 524269 - protein, 11 aa, Influenza virus
FWTSNSIVALC

SEQ ID NO: 524270 - protein, 11 aa, Influenza virus
FWVELIRGQPK

SEQ ID NO: 524271 - protein, 11 aa, Influenza virus
FWVELIRGRPE

SEQ ID NO: 524272 - protein, 11 aa, Influenza virus
FWVELIRGRPK

SEQ ID NO: 524273 - protein, 11 aa, Influenza virus
FWVELVRGRPK

SEQ ID NO: 524274 - protein, 11 aa, Influenza virus
FWVEMIRGEPE

SEQ ID NO: 524275 - protein, 11 aa, Influenza virus
FWVEMIRGKPE

SEQ ID NO: 524276 - protein, 11 aa, Influenza virus
FWVEMIRGQPK

SEQ ID NO: 524277 - protein, 11 aa, Influenza virus
FWVEMIRGRPE

SEQ ID NO: 524278 - protein, 11 aa, Influenza virus
FYAELKWLISK

SEQ ID NO: 524279 - protein, 11 aa, Influenza virus
FYAELKWLVSK

SEQ ID NO: 524280 - protein, 11 aa, Influenza virus
FYAEMEWLLSN

SEQ ID NO: 524281 - protein, 11 aa, Influenza virus
FYAEMKWLLSD

SEQ ID NO: 524282 - protein, 11 aa, Influenza virus
FYAEMKWLLSN

SEQ ID NO: 524283 - protein, 11 aa, Influenza virus
FYAEMKWLLSS

SEQ ID NO: 524284 - protein, 11 aa, Influenza virus
FYALSQGTTIR

SEQ ID NO: 524285 - protein, 11 aa, Influenza virus
FYHKCDDECIE

SEQ ID NO: 524286 - protein, 11 aa, Influenza virus
FYHKCDDECMD

SEQ ID NO: 524287 - protein, 11 aa, Influenza virus
FYHKCDDECMN

SEQ ID NO: 524288 - protein, 11 aa, Influenza virus
FYHKCDDECMS

SEQ ID NO: 524289 - protein, 11 aa, Influenza virus
FYHKCDNECIE

SEQ ID NO: 524290 - protein, 11 aa, Influenza virus
FYHKCDNECMD

SEQ ID NO: 524291 - protein, 11 aa, Influenza virus
FYHKCDNKCIE

SEQ ID NO: 524292 - protein, 11 aa, Influenza virus
FYHKCNDECMN

SEQ ID NO: 524293 - protein, 11 aa, Influenza virus
FYHKCNNECIE

SEQ ID NO: 524294 - protein, 11 aa, Influenza virus
FYHRCDNECIE

SEQ ID NO: 524295 - protein, 11 aa, Influenza virus
FYIELIRGKPN

SEQ ID NO: 524296 - protein, 11 aa, Influenza virus
FYIELIRGRPN

SEQ ID NO: 524297 - protein, 11 aa, Influenza virus
FYIQMCTELKL

SEQ ID NO: 524298 - protein, 11 aa, Influenza virus
FYIQMCTELQL

SEQ ID NO: 524299 - protein, 11 aa, Influenza virus
FYKILKIKKGK

SEQ ID NO: 524300 - protein, 11 aa, Influenza virus
FYKILKIRKGK

SEQ ID NO: 524301 - protein, 11 aa, Influenza virus
FYRICKLVGIN

SEQ ID NO: 524302 - protein, 11 aa, Influenza virus
FYRNMRWLTLK

SEQ ID NO: 524303 - protein, 11 aa, Influenza virus
FYRNVVWLIKK

SEQ ID NO: 524304 - protein, 11 aa, Influenza virus
FYRSINWLTKK

SEQ ID NO: 524305 - protein, 11 aa, Influenza virus
FYRSIRWLTLK

SEQ ID NO: 524306 - protein, 11 aa, Influenza virus
FYRSMKWLTLK

SEQ ID NO: 524307 - protein, 11 aa, Influenza virus
FYRSMRWLTLK

SEQ ID NO: 524308 - protein, 11 aa, Influenza virus
FYRTCKLLGIN

SEQ ID NO: 524309 - protein, 11 aa, Influenza virus
FYRTCKLVGIN

SEQ ID NO: 524310 - protein, 11 aa, Influenza virus
FYRYGFVANFS

SEQ ID NO: 524311 - protein, 11 aa, Influenza virus
FYSEMKWLLSS

SEQ ID NO: 524312 - protein, 11 aa, Influenza virus
FYSEMKWLSSS

SEQ ID NO: 524313 - protein, 11 aa, Influenza virus
FYSGGTINSPL

SEQ ID NO: 524314 - protein, 11 aa, Influenza virus
FYVELIRGKPK

SEQ ID NO: 524315 - protein, 11 aa, Influenza virus
FYVELIRGMPK

SEQ ID NO: 524316 - protein, 11 aa, Influenza virus
FYVELIRGMPQ

SEQ ID NO: 524317 - protein, 11 aa, Influenza virus
FYVELIRGRKQ

SEQ ID NO: 524318 - protein, 11 aa, Influenza virus
FYVELIRGRLN

SEQ ID NO: 524319 - protein, 11 aa, Influenza virus
FYVELIRGRPE

SEQ ID NO: 524320 - protein, 11 aa, Influenza virus
FYVELIRGRPI

SEQ ID NO: 524321 - protein, 11 aa, Influenza virus
FYVELIRGRPK

SEQ ID NO: 524322 - protein, 11 aa, Influenza virus
FYVELIRGRPN

SEQ ID NO: 524323 - protein, 11 aa, Influenza virus
FYVELIRGRPQ

SEQ ID NO: 524324 - protein, 11 aa, Influenza virus
FYVELIRGRPR

SEQ ID NO: 524325 - protein, 11 aa, Influenza virus
FYVELIRGRQQ

SEQ ID NO: 524326 - protein, 11 aa, Influenza virus
FYVELIRGRSQ

SEQ ID NO: 524327 - protein, 11 aa, Influenza virus
FYVELTRGRPQ

SEQ ID NO: 524328 - protein, 11 aa, Influenza virus
FYVQMCTELKL

SEQ ID NO: 524329 - protein, 11 aa, Influenza virus
GAAGAAIKGVG

SEQ ID NO: 524330 - protein, 11 aa, Influenza virus
GAAGAAVKGIG

SEQ ID NO: 524331 - protein, 11 aa, Influenza virus
GAAGAAVKGVG

SEQ ID NO: 524332 - protein, 11 aa, Influenza virus
GAASLSPGMMM

SEQ ID NO: 524333 - protein, 11 aa, Influenza virus
GACWEQLYTPG

SEQ ID NO: 524334 - protein, 11 aa, Influenza virus
GADDDAYAVIH

SEQ ID NO: 524335 - protein, 11 aa, Influenza virus
GADIKSHAYIS

SEQ ID NO: 524336 - protein, 11 aa, Influenza virus
GADINLHAYIS

SEQ ID NO: 524337 - protein, 11 aa, Influenza virus
GADINLMPIYS

SEQ ID NO: 524338 - protein, 11 aa, Influenza virus
GADLPFTQEQK

SEQ ID NO: 524339 - protein, 11 aa, Influenza virus
GADNDAYAVIH

SEQ ID NO: 524340 - protein, 11 aa, Influenza virus
GAELPFTIDKS

SEQ ID NO: 524341 - protein, 11 aa, Influenza virus
GAELPFTIDKY

SEQ ID NO: 524342 - protein, 11 aa, Influenza virus
GAFGPVHFRNQ

SEQ ID NO: 524343 - protein, 11 aa, Influenza virus
GAFIAPDRAGF

SEQ ID NO: 524344 - protein, 11 aa, Influenza virus
GAFIAPDRASF

SEQ ID NO: 524345 - protein, 11 aa, Influenza virus
GAFIAPDRATF

SEQ ID NO: 524346 - protein, 11 aa, Influenza virus
GAFIAPDRVSF

SEQ ID NO: 524347 - protein, 11 aa, Influenza virus
GAFIAPNRASF

SEQ ID NO: 524348 - protein, 11 aa, Influenza virus
GAFVAPDRVSF

SEQ ID NO: 524349 - protein, 11 aa, Influenza virus
GAGALAEDPDE

SEQ ID NO: 524350 - protein, 11 aa, Influenza virus
GAGNKLITVGS

SEQ ID NO: 524351 - protein, 11 aa, Influenza virus
GAGYAADKEST

SEQ ID NO: 524352 - protein, 11 aa, Influenza virus
GAHILVTREPY

SEQ ID NO: 524353 - protein, 11 aa, Influenza virus
GAIAGFIEGGW

SEQ ID NO: 524354 - protein, 11 aa, Influenza virus
GAIAGFIEGRW

SEQ ID NO: 524355 - protein, 11 aa, Influenza virus
GAIAGFIENGW

SEQ ID NO: 524356 - protein, 11 aa, Influenza virus
GAIEECLINDP

SEQ ID NO: 524357 - protein, 11 aa, Influenza virus
GAIGAIDSSMP

SEQ ID NO: 524358 - protein, 11 aa, Influenza virus
GAIGFWMCSNG

SEQ ID NO: 524359 - protein, 11 aa, Influenza virus
GAILPFDIDKM

SEQ ID NO: 524360 - protein, 11 aa, Influenza virus
GAINSSKPFQN

SEQ ID NO: 524361 - protein, 11 aa, Influenza virus
GAINSSKPLQN

SEQ ID NO: 524362 - protein, 11 aa, Influenza virus
GAINSSMPFHN

SEQ ID NO: 524363 - protein, 11 aa, Influenza virus
GAINSSMPLHN

SEQ ID NO: 524364 - protein, 11 aa, Influenza virus
GAINSSRPFQN

SEQ ID NO: 524365 - protein, 11 aa, Influenza virus
GAINTSMPFHN

SEQ ID NO: 524366 - protein, 11 aa, Influenza virus
GAINTTLPFHN

SEQ ID NO: 524367 - protein, 11 aa, Influenza virus
GAISFWMCSGH

SEQ ID NO: 524368 - protein, 11 aa, Influenza virus
GAISFWMCSNG

SEQ ID NO: 524369 - protein, 11 aa, Influenza virus
GAIWVTREPYV

SEQ ID NO: 524370 - protein, 11 aa, Influenza virus
GAKAGFIEGGW

SEQ ID NO: 524371 - protein, 11 aa, Influenza virus
GAKAGFIENGW

SEQ ID NO: 524372 - protein, 11 aa, Influenza virus
GAKILTSESQL

SEQ ID NO: 524373 - protein, 11 aa, Influenza virus
GALASCMGLIY

SEQ ID NO: 524374 - protein, 11 aa, Influenza virus
GALGSPGCDHL

SEQ ID NO: 524375 - protein, 11 aa, Influenza virus
GALGSPGCDRL

SEQ ID NO: 524376 - protein, 11 aa, Influenza virus
GALLGTKHSNG

SEQ ID NO: 524377 - protein, 11 aa, Influenza virus
GALLGTNHSNG

SEQ ID NO: 524378 - protein, 11 aa, Influenza virus
GALLGTRHSNG

SEQ ID NO: 524379 - protein, 11 aa, Influenza virus
GALLNDKHSNE

SEQ ID NO: 524380 - protein, 11 aa, Influenza virus
GALLNDKHSNG

SEQ ID NO: 524381 - protein, 11 aa, Influenza virus
GALLNDKHSNN

SEQ ID NO: 524382 - protein, 11 aa, Influenza virus
GALLNDRHSNG

SEQ ID NO: 524383 - protein, 11 aa, Influenza virus
GALNTTLPFHN

SEQ ID NO: 524384 - protein, 11 aa, Influenza virus
GALQLNPIDGP

SEQ ID NO: 524385 - protein, 11 aa, Influenza virus
GALRQKIMESG

SEQ ID NO: 524386 - protein, 11 aa, Influenza virus
GALVGTKHSNG

SEQ ID NO: 524387 - protein, 11 aa, Influenza virus
GAMASQGTKRS

SEQ ID NO: 524388 - protein, 11 aa, Influenza virus
GANINFMPYIS

SEQ ID NO: 524389 - protein, 11 aa, Influenza virus
GANRPIIEIDM

SEQ ID NO: 524390 - protein, 11 aa, Influenza virus
GANRPIIEINM

SEQ ID NO: 524391 - protein, 11 aa, Influenza virus
GANRPVIEIDM

SEQ ID NO: 524392 - protein, 11 aa, Influenza virus
GANRPVIEINM

SEQ ID NO: 524393 - protein, 11 aa, Influenza virus
GANRPVIKIDM

SEQ ID NO: 524394 - protein, 11 aa, Influenza virus
GAPACDLHLTG

SEQ ID NO: 524395 - protein, 11 aa, Influenza virus
GAPGVKGFGFL

SEQ ID NO: 524396 - protein, 11 aa, Influenza virus
GAPHGLCYPGE

SEQ ID NO: 524397 - protein, 11 aa, Influenza virus
GAPLELRDCKI

SEQ ID NO: 524398 - protein, 11 aa, Influenza virus
GAPLELRDCKV

SEQ ID NO: 524399 - protein, 11 aa, Influenza virus
GAPLVLDDCSL

SEQ ID NO: 524400 - protein, 11 aa, Influenza virus
GAPQLNPIDGP

SEQ ID NO: 524401 - protein, 11 aa, Influenza virus
GAPQLNPVDGP

SEQ ID NO: 524402 - protein, 11 aa, Influenza virus
GAPSCDLHLTG

SEQ ID NO: 524403 - protein, 11 aa, Influenza virus
GAQHVEECSCY

SEQ ID NO: 524404 - protein, 11 aa, Influenza virus
GAQSFYRSINW

SEQ ID NO: 524405 - protein, 11 aa, Influenza virus
GAQSLSISVGS

SEQ ID NO: 524406 - protein, 11 aa, Influenza virus
GARIGEGQRSW

SEQ ID NO: 524407 - protein, 11 aa, Influenza virus
GARIITSESQL

SEQ ID NO: 524408 - protein, 11 aa, Influenza virus
GARILASESQL

SEQ ID NO: 524409 - protein, 11 aa, Influenza virus
GARILTSESQL

SEQ ID NO: 524410 - protein, 11 aa, Influenza virus
GARILTSESQM

SEQ ID NO: 524411 - protein, 11 aa, Influenza virus
GARPKVNGQAG

SEQ ID NO: 524412 - protein, 11 aa, Influenza virus
GARPKVNGQSG

SEQ ID NO: 524413 - protein, 11 aa, Influenza virus
GARPQVNGQRG

SEQ ID NO: 524414 - protein, 11 aa, Influenza virus
GARPQVNGQSG

SEQ ID NO: 524415 - protein, 11 aa, Influenza virus
GASCFILLAIA

SEQ ID NO: 524416 - protein, 11 aa, Influenza virus
GASCFILLAIV

SEQ ID NO: 524417 - protein, 11 aa, Influenza virus
GASCFLLLAIA

SEQ ID NO: 524418 - protein, 11 aa, Influenza virus
GASCFLLLAIV

SEQ ID NO: 524419 - protein, 11 aa, Influenza virus
GASCFLLLAVV

SEQ ID NO: 524420 - protein, 11 aa, Influenza virus
GASCVMLLAIA

SEQ ID NO: 524421 - protein, 11 aa, Influenza virus
GATINEEALRQ

SEQ ID NO: 524422 - protein, 11 aa, Influenza virus
GATSACKRTVS

SEQ ID NO: 524423 - protein, 11 aa, Influenza virus
GATVNEEALRQ

SEQ ID NO: 524424 - protein, 11 aa, Influenza virus
GATVNEGALRQ

SEQ ID NO: 524425 - protein, 11 aa, Influenza virus
GAVAVLKYKGI

SEQ ID NO: 524426 - protein, 11 aa, Influenza virus
GAVAVLKYNDI

SEQ ID NO: 524427 - protein, 11 aa, Influenza virus
GAVAVLKYNGI

SEQ ID NO: 524428 - protein, 11 aa, Influenza virus
GAVAVLKYNGV

SEQ ID NO: 524429 - protein, 11 aa, Influenza virus
GAVNSSKPFQN

SEQ ID NO: 524430 - protein, 11 aa, Influenza virus
GAVNSSMPFHN

SEQ ID NO: 524431 - protein, 11 aa, Influenza virus
GAVNTTLSTIA

SEQ ID NO: 524432 - protein, 11 aa, Influenza virus
GAVSFWMCSNG

SEQ ID NO: 524433 - protein, 11 aa, Influenza virus
GAYERMCNILK

SEQ ID NO: 524434 - protein, 11 aa, Influenza virus
GAYKILTIYST

SEQ ID NO: 524435 - protein, 11 aa, Influenza virus
GAYNNTTGRDV

SEQ ID NO: 524436 - protein, 11 aa, Influenza virus
GCDHSDNADKI

SEQ ID NO: 524437 - protein, 11 aa, Influenza virus
GCDRLQDTTWD

SEQ ID NO: 524438 - protein, 11 aa, Influenza virus
GCFDILHKCDN

SEQ ID NO: 524439 - protein, 11 aa, Influenza virus
GCFDILHKCNN

SEQ ID NO: 524440 - protein, 11 aa, Influenza virus
GCFEFWHKCDD

SEQ ID NO: 524441 - protein, 11 aa, Influenza virus
GCFEFWHKCDN

SEQ ID NO: 524442 - protein, 11 aa, Influenza virus
GCFEFWHKCNN

SEQ ID NO: 524443 - protein, 11 aa, Influenza virus
GCFEFYHKCDD

SEQ ID NO: 524444 - protein, 11 aa, Influenza virus
GCFEFYHKCDN

SEQ ID NO: 524445 - protein, 11 aa, Influenza virus
GCFEFYHKCND

SEQ ID NO: 524446 - protein, 11 aa, Influenza virus
GCFEFYHKCNN

SEQ ID NO: 524447 - protein, 11 aa, Influenza virus
GCFEFYHRCDD

SEQ ID NO: 524448 - protein, 11 aa, Influenza virus
GCFEFYHRCDN

SEQ ID NO: 524449 - protein, 11 aa, Influenza virus
GCFEIFHKCDD

SEQ ID NO: 524450 - protein, 11 aa, Influenza virus
GCFEIFHKCDN

SEQ ID NO: 524451 - protein, 11 aa, Influenza virus
GCFEIFHQCDN

SEQ ID NO: 524452 - protein, 11 aa, Influenza virus
GCFEIFHQCNN

SEQ ID NO: 524453 - protein, 11 aa, Influenza virus
GCFEIFHRCDD

SEQ ID NO: 524454 - protein, 11 aa, Influenza virus
GCFEIFHRCDN

SEQ ID NO: 524455 - protein, 11 aa, Influenza virus
GCFEILHKCDD

SEQ ID NO: 524456 - protein, 11 aa, Influenza virus
GCFEILHKCDN

SEQ ID NO: 524457 - protein, 11 aa, Influenza virus
GCFEILHKCND

SEQ ID NO: 524458 - protein, 11 aa, Influenza virus
GCFEILHRCDD

SEQ ID NO: 524459 - protein, 11 aa, Influenza virus
GCFEILHRCND

SEQ ID NO: 524460 - protein, 11 aa, Influenza virus
GCFELFHKCDD

SEQ ID NO: 524461 - protein, 11 aa, Influenza virus
GCFELLHKCND

SEQ ID NO: 524462 - protein, 11 aa, Influenza virus
GCFELLHKCNN

SEQ ID NO: 524463 - protein, 11 aa, Influenza virus
GCFKIYHKCDN

SEQ ID NO: 524464 - protein, 11 aa, Influenza virus
GCFKIYHRCDN

SEQ ID NO: 524465 - protein, 11 aa, Influenza virus
GCFNFFHKCND

SEQ ID NO: 524466 - protein, 11 aa, Influenza virus
GCFNLLHKCND

SEQ ID NO: 524467 - protein, 11 aa, Influenza virus
GCFPFYHKCDN

SEQ ID NO: 524468 - protein, 11 aa, Influenza virus
GCFQPCFYIEL

SEQ ID NO: 524469 - protein, 11 aa, Influenza virus
GCFQPCFYVEL

SEQ ID NO: 524470 - protein, 11 aa, Influenza virus
GCFRIYHKCDN

SEQ ID NO: 524471 - protein, 11 aa, Influenza virus
GCFSILHKCND

SEQ ID NO: 524472 - protein, 11 aa, Influenza virus
GCFSLLHKCND

SEQ ID NO: 524473 - protein, 11 aa, Influenza virus
GCFTFYHKCDD

SEQ ID NO: 524474 - protein, 11 aa, Influenza virus
GCFTFYHKCDN

SEQ ID NO: 524475 - protein, 11 aa, Influenza virus
GCFTFYHKCNN

SEQ ID NO: 524476 - protein, 11 aa, Influenza virus
GCFTIYHKCDN

SEQ ID NO: 524477 - protein, 11 aa, Influenza virus
GCIEGKLSQMP

SEQ ID NO: 524478 - protein, 11 aa, Influenza virus
GCIEGKLSQMS

SEQ ID NO: 524479 - protein, 11 aa, Influenza virus
GCIESKLSQMS

SEQ ID NO: 524480 - protein, 11 aa, Influenza virus
GCINRCFYVEL

SEQ ID NO: 524481 - protein, 11 aa, Influenza virus
GCITPNGSIPN

SEQ ID NO: 524482 - protein, 11 aa, Influenza virus
GCKMFALHQGT

SEQ ID NO: 524483 - protein, 11 aa, Influenza virus
GCKMYALHQGT

SEQ ID NO: 524484 - protein, 11 aa, Influenza virus
GCLKIYHKCDN

SEQ ID NO: 524485 - protein, 11 aa, Influenza virus
GCQLNEGVMNT

SEQ ID NO: 524486 - protein, 11 aa, Influenza virus
GCQNGNIRCTF

SEQ ID NO: 524487 - protein, 11 aa, Influenza virus
GCQNGNVRCTF

SEQ ID NO: 524488 - protein, 11 aa, Influenza virus
GCRDNWQGANR

SEQ ID NO: 524489 - protein, 11 aa, Influenza virus
GCRFYALSQGT

SEQ ID NO: 524490 - protein, 11 aa, Influenza virus
GCRMFALSQGT

SEQ ID NO: 524491 - protein, 11 aa, Influenza virus
GCRMYALHQGT

SEQ ID NO: 524492 - protein, 11 aa, Influenza virus
GCRTFFLTQGS

SEQ ID NO: 524493 - protein, 11 aa, Influenza virus
GCVILLNPFVS

SEQ ID NO: 524494 - protein, 11 aa, Influenza virus
GCWSFALAQGA

SEQ ID NO: 524495 - protein, 11 aa, Influenza virus
GDAPFIDRLRR

SEQ ID NO: 524496 - protein, 11 aa, Influenza virus
GDAPFLDRIRR

SEQ ID NO: 524497 - protein, 11 aa, Influenza virus
GDAPFLDRLRR

SEQ ID NO: 524498 - protein, 11 aa, Influenza virus
GDCNFEGWIVG

SEQ ID NO: 524499 - protein, 11 aa, Influenza virus
GDCNNPITGSP

SEQ ID NO: 524500 - protein, 11 aa, Influenza virus
GDCPKYIKQGS

SEQ ID NO: 524501 - protein, 11 aa, Influenza virus
GDCPKYIKSGQ

SEQ ID NO: 524502 - protein, 11 aa, Influenza virus
GDCPKYMNVKS

SEQ ID NO: 524503 - protein, 11 aa, Influenza virus
GDCPKYVKQGS

SEQ ID NO: 524504 - protein, 11 aa, Influenza virus
GDCPKYVNIKS

SEQ ID NO: 524505 - protein, 11 aa, Influenza virus
GDCPKYVNVKS

SEQ ID NO: 524506 - protein, 11 aa, Influenza virus
GDCPKYVNVRS

SEQ ID NO: 524507 - protein, 11 aa, Influenza virus
GDCPRYVKQGS

SEQ ID NO: 524508 - protein, 11 aa, Influenza virus
GDCRFEGWIVG

SEQ ID NO: 524509 - protein, 11 aa, Influenza virus
GDCSFAGWILG

SEQ ID NO: 524510 - protein, 11 aa, Influenza virus
GDCSFAGWLLG

SEQ ID NO: 524511 - protein, 11 aa, Influenza virus
GDCSFEGWIGG

SEQ ID NO: 524512 - protein, 11 aa, Influenza virus
GDCSFEGWIVG

SEQ ID NO: 524513 - protein, 11 aa, Influenza virus
GDCSIAGWLLG

SEQ ID NO: 524514 - protein, 11 aa, Influenza virus
GDCSNPITGSP

SEQ ID NO: 524515 - protein, 11 aa, Influenza virus
GDCYRACFYVE

SEQ ID NO: 524516 - protein, 11 aa, Influenza virus
GDCYWVMTDGP

SEQ ID NO: 524517 - protein, 11 aa, Influenza virus
GDDKNATASFI

SEQ ID NO: 524518 - protein, 11 aa, Influenza virus
GDDRNATASFI

SEQ ID NO: 524519 - protein, 11 aa, Influenza virus
GDDRNATASFV

SEQ ID NO: 524520 - protein, 11 aa, Influenza virus
GDDRNATASLI

SEQ ID NO: 524521 - protein, 11 aa, Influenza virus
GDDVWLGRTVS

SEQ ID NO: 524522 - protein, 11 aa, Influenza virus
GDDVWMGRTIS

SEQ ID NO: 524523 - protein, 11 aa, Influenza virus
GDGCFEILHKC

SEQ ID NO: 524524 - protein, 11 aa, Influenza virus
GDGCFEILHRC

SEQ ID NO: 524525 - protein, 11 aa, Influenza virus
GDGCFNFFHKC

SEQ ID NO: 524526 - protein, 11 aa, Influenza virus
GDGCFNLLHKC

SEQ ID NO: 524527 - protein, 11 aa, Influenza virus
GDGCFSILHKC

SEQ ID NO: 524528 - protein, 11 aa, Influenza virus
GDGCFSLLHKC

SEQ ID NO: 524529 - protein, 11 aa, Influenza virus
GDGQRSWMKIY

SEQ ID NO: 524530 - protein, 11 aa, Influenza virus
GDGQRSWMKLY

SEQ ID NO: 524531 - protein, 11 aa, Influenza virus
GDGVWIGRTKN

SEQ ID NO: 524532 - protein, 11 aa, Influenza virus
GDGVWIGRTKS

SEQ ID NO: 524533 - protein, 11 aa, Influenza virus
GDHGVKGWAFD

SEQ ID NO: 524534 - protein, 11 aa, Influenza virus
GDHITFSHNGG

SEQ ID NO: 524535 - protein, 11 aa, Influenza virus
GDIFVIREPFI

SEQ ID NO: 524536 - protein, 11 aa, Influenza virus
GDIFVMREPFI

SEQ ID NO: 524537 - protein, 11 aa, Influenza virus
GDIIFLWGIHH

SEQ ID NO: 524538 - protein, 11 aa, Influenza virus
GDIIVFNTIGN

SEQ ID NO: 524539 - protein, 11 aa, Influenza virus
GDILDGVTASC

SEQ ID NO: 524540 - protein, 11 aa, Influenza virus
GDILEGTTASC

SEQ ID NO: 524541 - protein, 11 aa, Influenza virus
GDILRTQEFSC

SEQ ID NO: 524542 - protein, 11 aa, Influenza virus
GDILRTQESSC

SEQ ID NO: 524543 - protein, 11 aa, Influenza virus
GDIMRTQESSC

SEQ ID NO: 524544 - protein, 11 aa, Influenza virus
GDIVLVMKRKR

SEQ ID NO: 524545 - protein, 11 aa, Influenza virus
GDIWITREPYV

SEQ ID NO: 524546 - protein, 11 aa, Influenza virus
GDIWVTREHYV

SEQ ID NO: 524547 - protein, 11 aa, Influenza virus
GDIWVTRELYV

SEQ ID NO: 524548 - protein, 11 aa, Influenza virus
GDIWVTREPYV

SEQ ID NO: 524549 - protein, 11 aa, Influenza virus
GDIWVTRKPYV

SEQ ID NO: 524550 - protein, 11 aa, Influenza virus
GDKICLGHHAV

SEQ ID NO: 524551 - protein, 11 aa, Influenza virus
GDLILFNTIGN

SEQ ID NO: 524552 - protein, 11 aa, Influenza virus
GDLIVFNTIGN

SEQ ID NO: 524553 - protein, 11 aa, Influenza virus
GDLNFVNRANQ

SEQ ID NO: 524554 - protein, 11 aa, Influenza virus
GDNAEEYRRLR

SEQ ID NO: 524555 - protein, 11 aa, Influenza virus
GDNENATATVY

SEQ ID NO: 524556 - protein, 11 aa, Influenza virus
GDNIIFSHNGG

SEQ ID NO: 524557 - protein, 11 aa, Influenza virus
GDNITFLHNGG

SEQ ID NO: 524558 - protein, 11 aa, Influenza virus
GDNITFSDNGG

SEQ ID NO: 524559 - protein, 11 aa, Influenza virus
GDNITFSHNGG

SEQ ID NO: 524560 - protein, 11 aa, Influenza virus
GDNTKWNENQN

SEQ ID NO: 524561 - protein, 11 aa, Influenza virus
GDPNNMARAVK

SEQ ID NO: 524562 - protein, 11 aa, Influenza virus
GDPNNMDKAVK

SEQ ID NO: 524563 - protein, 11 aa, Influenza virus
GDPNNMDRAVK

SEQ ID NO: 524564 - protein, 11 aa, Influenza virus
GDPPYSHGTGT

SEQ ID NO: 524565 - protein, 11 aa, Influenza virus
GDPSNMDRAVK

SEQ ID NO: 524566 - protein, 11 aa, Influenza virus
GDQICIGYHAN

SEQ ID NO: 524567 - protein, 11 aa, Influenza virus
GDQICIGYHSN

SEQ ID NO: 524568 - protein, 11 aa, Influenza virus
GDQICVGYHAN

SEQ ID NO: 524569 - protein, 11 aa, Influenza virus
GDQICVGYHSN

SEQ ID NO: 524570 - protein, 11 aa, Influenza virus
GDRICIGYHAN

SEQ ID NO: 524571 - protein, 11 aa, Influenza virus
GDRPKVNGQAG

SEQ ID NO: 524572 - protein, 11 aa, Influenza virus
GDSEMLNLYER

SEQ ID NO: 524573 - protein, 11 aa, Influenza virus
GDSFYAELKWL

SEQ ID NO: 524574 - protein, 11 aa, Influenza virus
GDSIIFNSIGN

SEQ ID NO: 524575 - protein, 11 aa, Influenza virus
GDSITFSHNGG

SEQ ID NO: 524576 - protein, 11 aa, Influenza virus
GDTPRNDDRFS

SEQ ID NO: 524577 - protein, 11 aa, Influenza virus
GDTPRNDDRSS

SEQ ID NO: 524578 - protein, 11 aa, Influenza virus
GDTPRNDDSSS

SEQ ID NO: 524579 - protein, 11 aa, Influenza virus
GDTPRNEDGSS

SEQ ID NO: 524580 - protein, 11 aa, Influenza virus
GDTPRNEDSSS

SEQ ID NO: 524581 - protein, 11 aa, Influenza virus
GDTPRNGDSSS

SEQ ID NO: 524582 - protein, 11 aa, Influenza virus
GDTPRSDDSSS

SEQ ID NO: 524583 - protein, 11 aa, Influenza virus
GDTVTFTFNGA

SEQ ID NO: 524584 - protein, 11 aa, Influenza virus
GDVFVIREPFI

SEQ ID NO: 524585 - protein, 11 aa, Influenza virus
GDVIVFNTIGN

SEQ ID NO: 524586 - protein, 11 aa, Influenza virus
GDVLDGVTASC

SEQ ID NO: 524587 - protein, 11 aa, Influenza virus
GDVVLVMKRKR

SEQ ID NO: 524588 - protein, 11 aa, Influenza virus
GDVWVTREPYV

SEQ ID NO: 524589 - protein, 11 aa, Influenza virus
GDVYKILSIYS

SEQ ID NO: 524590 - protein, 11 aa, Influenza virus
GDYARLYIWGV

SEQ ID NO: 524591 - protein, 11 aa, Influenza virus
GDYNNTTGRDV

SEQ ID NO: 524592 - protein, 11 aa, Influenza virus
GDYTRLYIWGV

SEQ ID NO: 524593 - protein, 11 aa, Influenza virus
GEAMVSRARID

SEQ ID NO: 524594 - protein, 11 aa, Influenza virus
GEAPSPYNSKF

SEQ ID NO: 524595 - protein, 11 aa, Influenza virus
GEAPSPYNSRF

SEQ ID NO: 524596 - protein, 11 aa, Influenza virus
GECFNPITGSP

SEQ ID NO: 524597 - protein, 11 aa, Influenza virus
GECFWVMTDGP

SEQ ID NO: 524598 - protein, 11 aa, Influenza virus
GECFYSGGTIN

SEQ ID NO: 524599 - protein, 11 aa, Influenza virus
GECPKYIKSDQ

SEQ ID NO: 524600 - protein, 11 aa, Influenza virus
GECPKYVKQGS

SEQ ID NO: 524601 - protein, 11 aa, Influenza virus
GECPKYVKSDR

SEQ ID NO: 524602 - protein, 11 aa, Influenza virus
GECPKYVKSEK

SEQ ID NO: 524603 - protein, 11 aa, Influenza virus
GECPKYVKSER

SEQ ID NO: 524604 - protein, 11 aa, Influenza virus
GECPKYVRSEK

SEQ ID NO: 524605 - protein, 11 aa, Influenza virus
GECPRYVKSEK

SEQ ID NO: 524606 - protein, 11 aa, Influenza virus
GECYRACFYVE

SEQ ID NO: 524607 - protein, 11 aa, Influenza virus
GECYWVMTDGP

SEQ ID NO: 524608 - protein, 11 aa, Influenza virus
GEDSDILVTRE

SEQ ID NO: 524609 - protein, 11 aa, Influenza virus
GEDSDVLVTRE

SEQ ID NO: 524610 - protein, 11 aa, Influenza virus
GEDTIEERFEI

SEQ ID NO: 524611 - protein, 11 aa, Influenza virus
GEETIEEKFEI

SEQ ID NO: 524612 - protein, 11 aa, Influenza virus
GEETIEERFAI

SEQ ID NO: 524613 - protein, 11 aa, Influenza virus
GEETIEERFEI

SEQ ID NO: 524614 - protein, 11 aa, Influenza virus
GEETVEERFEI

SEQ ID NO: 524615 - protein, 11 aa, Influenza virus
GEFNQVEKRIN

SEQ ID NO: 524616 - protein, 11 aa, Influenza virus
GEFNQVENRIN

SEQ ID NO: 524617 - protein, 11 aa, Influenza virus
GEFNQVEQRIN

SEQ ID NO: 524618 - protein, 11 aa, Influenza virus
GEFSQVEQRIN

SEQ ID NO: 524619 - protein, 11 aa, Influenza virus
GEFSQVERRIN

SEQ ID NO: 524620 - protein, 11 aa, Influenza virus
GEGEQIIVTRE

SEQ ID NO: 524621 - protein, 11 aa, Influenza virus
GEGIAADYKST

SEQ ID NO: 524622 - protein, 11 aa, Influenza virus
GEGIPLHDAIK

SEQ ID NO: 524623 - protein, 11 aa, Influenza virus
GEGIPLYDAIK

SEQ ID NO: 524624 - protein, 11 aa, Influenza virus
GEGIPLYDAVK

SEQ ID NO: 524625 - protein, 11 aa, Influenza virus
GEGIPLYDAVR

SEQ ID NO: 524626 - protein, 11 aa, Influenza virus
GEGQRSWMKIY

SEQ ID NO: 524627 - protein, 11 aa, Influenza virus
GEGTAADYKST

SEQ ID NO: 524628 - protein, 11 aa, Influenza virus
GEHAKAIGNCP

SEQ ID NO: 524629 - protein, 11 aa, Influenza virus
GEKANVLIGQG

SEQ ID NO: 524630 - protein, 11 aa, Influenza virus
GEKSDVLVTRE

SEQ ID NO: 524631 - protein, 11 aa, Influenza virus
GELDNNGELRH

SEQ ID NO: 524632 - protein, 11 aa, Influenza virus
GELNNNGELRH

SEQ ID NO: 524633 - protein, 11 aa, Influenza virus
GELRHLFSGIK

SEQ ID NO: 524634 - protein, 11 aa, Influenza virus
GELRHLFSGIR

SEQ ID NO: 524635 - protein, 11 aa, Influenza virus
GELRHLFSGVN

SEQ ID NO: 524636 - protein, 11 aa, Influenza virus
GENIAPEKVDF

SEQ ID NO: 524637 - protein, 11 aa, Influenza virus
GENMAPEKIDF

SEQ ID NO: 524638 - protein, 11 aa, Influenza virus
GENMAPEKMDF

SEQ ID NO: 524639 - protein, 11 aa, Influenza virus
GENMAPEKVDF

SEQ ID NO: 524640 - protein, 11 aa, Influenza virus
GENSDVLVTRE

SEQ ID NO: 524641 - protein, 11 aa, Influenza virus
GENSFYAELKW

SEQ ID NO: 524642 - protein, 11 aa, Influenza virus
GENSGVLVTRE

SEQ ID NO: 524643 - protein, 11 aa, Influenza virus
GEPGVKGFGFK

SEQ ID NO: 524644 - protein, 11 aa, Influenza virus
GEQIIVTREPY

SEQ ID NO: 524645 - protein, 11 aa, Influenza virus
GERGLFGAIAG

SEQ ID NO: 524646 - protein, 11 aa, Influenza virus
GERIMFESNGG

SEQ ID NO: 524647 - protein, 11 aa, Influenza virus
GERITFESNGG

SEQ ID NO: 524648 - protein, 11 aa, Influenza virus
GERITFESSGG

SEQ ID NO: 524649 - protein, 11 aa, Influenza virus
GERTTFESNGG

SEQ ID NO: 524650 - protein, 11 aa, Influenza virus
GESEQIIVTRE

SEQ ID NO: 524651 - protein, 11 aa, Influenza virus
GESEQIVVTRE

SEQ ID NO: 524652 - protein, 11 aa, Influenza virus
GESEQVIVTRE

SEQ ID NO: 524653 - protein, 11 aa, Influenza virus
GESHCRIIQNE

SEQ ID NO: 524654 - protein, 11 aa, Influenza virus
GESHGKIIQNE

SEQ ID NO: 524655 - protein, 11 aa, Influenza virus
GESHGRIIQNE

SEQ ID NO: 524656 - protein, 11 aa, Influenza virus
GESHGRTIQNE

SEQ ID NO: 524657 - protein, 11 aa, Influenza virus
GESPSPYNSRF

SEQ ID NO: 524658 - protein, 11 aa, Influenza virus
GESYGRIIQNE

SEQ ID NO: 524659 - protein, 11 aa, Influenza virus
GETLKIRTNGN

SEQ ID NO: 524660 - protein, 11 aa, Influenza virus
GETLKVESNGN

SEQ ID NO: 524661 - protein, 11 aa, Influenza virus
GETLNIESNGN

SEQ ID NO: 524662 - protein, 11 aa, Influenza virus
GETLNVESNGN

SEQ ID NO: 524663 - protein, 11 aa, Influenza virus
GETTGRNCTIP

SEQ ID NO: 524664 - protein, 11 aa, Influenza virus
GETTGRNCTVP

SEQ ID NO: 524665 - protein, 11 aa, Influenza virus
GEVDNNGELRH

SEQ ID NO: 524666 - protein, 11 aa, Influenza virus
GEVFVIREPFI

SEQ ID NO: 524667 - protein, 11 aa, Influenza virus
GEVFVIREPFV

SEQ ID NO: 524668 - protein, 11 aa, Influenza virus
GEVPGWSWDDG

SEQ ID NO: 524669 - protein, 11 aa, Influenza virus
GEVPSPYNSRF

SEQ ID NO: 524670 - protein, 11 aa, Influenza virus
GEVSVIREPFI

SEQ ID NO: 524671 - protein, 11 aa, Influenza virus
GEYNNTTGRDV

SEQ ID NO: 524672 - protein, 11 aa, Influenza virus
GFAIASKDNGI

SEQ ID NO: 524673 - protein, 11 aa, Influenza virus
GFAIFSKDNGI

SEQ ID NO: 524674 - protein, 11 aa, Influenza virus
GFAIISKDNGI

SEQ ID NO: 524675 - protein, 11 aa, Influenza virus
GFAIVSKDNGI

SEQ ID NO: 524676 - protein, 11 aa, Influenza virus
GFAPFAKDNSI

SEQ ID NO: 524677 - protein, 11 aa, Influenza virus
GFAPFSKDNGI

SEQ ID NO: 524678 - protein, 11 aa, Influenza virus
GFAPFSKDNSI

SEQ ID NO: 524679 - protein, 11 aa, Influenza virus
GFAPFSKDNSV

SEQ ID NO: 524680 - protein, 11 aa, Influenza virus
GFCFTVMTDGP

SEQ ID NO: 524681 - protein, 11 aa, Influenza virus
GFEILLIEDGW

SEQ ID NO: 524682 - protein, 11 aa, Influenza virus
GFEILLIEEGW

SEQ ID NO: 524683 - protein, 11 aa, Influenza virus
GFEMIWDANGW

SEQ ID NO: 524684 - protein, 11 aa, Influenza virus
GFEMIWDPDGW

SEQ ID NO: 524685 - protein, 11 aa, Influenza virus
GFEMIWDPNGW

SEQ ID NO: 524686 - protein, 11 aa, Influenza virus
GFEMLKIHNAG

SEQ ID NO: 524687 - protein, 11 aa, Influenza virus
GFEMLKIPNAE

SEQ ID NO: 524688 - protein, 11 aa, Influenza virus
GFEMLKIPNAG

SEQ ID NO: 524689 - protein, 11 aa, Influenza virus
GFEMLKVPNAE

SEQ ID NO: 524690 - protein, 11 aa, Influenza virus
GFEMLKVPNAG

SEQ ID NO: 524691 - protein, 11 aa, Influenza virus
GFEMLRIPNAG

SEQ ID NO: 524692 - protein, 11 aa, Influenza virus
GFEMVWDANGW

SEQ ID NO: 524693 - protein, 11 aa, Influenza virus
GFEMVWDPNGW

SEQ ID NO: 524694 - protein, 11 aa, Influenza virus
GFEVLFIEDGW

SEQ ID NO: 524695 - protein, 11 aa, Influenza virus
GFEVLLIEDGW

SEQ ID NO: 524696 - protein, 11 aa, Influenza virus
GFFGAIAGFIE

SEQ ID NO: 524697 - protein, 11 aa, Influenza virus
GFFPDGPQIQY

SEQ ID NO: 524698 - protein, 11 aa, Influenza virus
GFFPFHKDNAI

SEQ ID NO: 524699 - protein, 11 aa, Influenza virus
GFFPFHKDNAL

SEQ ID NO: 524700 - protein, 11 aa, Influenza virus
GFFPFHKDNAV

SEQ ID NO: 524701 - protein, 11 aa, Influenza virus
GFGFRQGDDVW

SEQ ID NO: 524702 - protein, 11 aa, Influenza virus
GFGFRQGNDVW

SEQ ID NO: 524703 - protein, 11 aa, Influenza virus
GFGFRQGNNVW

SEQ ID NO: 524704 - protein, 11 aa, Influenza virus
GFGFRQGNSVW

SEQ ID NO: 524705 - protein, 11 aa, Influenza virus
GFGFRQGSDVW

SEQ ID NO: 524706 - protein, 11 aa, Influenza virus
GFGFRQGTDVW

SEQ ID NO: 524707 - protein, 11 aa, Influenza virus
GFGFRQGTSVW

SEQ ID NO: 524708 - protein, 11 aa, Influenza virus
GFHDSNVKNLY

SEQ ID NO: 524709 - protein, 11 aa, Influenza virus
GFHFEECSCYP

SEQ ID NO: 524710 - protein, 11 aa, Influenza virus
GFHHSNAEGTG

SEQ ID NO: 524711 - protein, 11 aa, Influenza virus
GFHHSNSEGTG

SEQ ID NO: 524712 - protein, 11 aa, Influenza virus
GFIDIWTYNAE

SEQ ID NO: 524713 - protein, 11 aa, Influenza virus
GFIDVWTYNAE

SEQ ID NO: 524714 - protein, 11 aa, Influenza virus
GFIEGGWCGMI

SEQ ID NO: 524715 - protein, 11 aa, Influenza virus
GFIEGGWPGLI

SEQ ID NO: 524716 - protein, 11 aa, Influenza virus
GFIEGGWPGLV

SEQ ID NO: 524717 - protein, 11 aa, Influenza virus
GFIEGGWQGLV

SEQ ID NO: 524718 - protein, 11 aa, Influenza virus
GFIEGGWQGMI

SEQ ID NO: 524719 - protein, 11 aa, Influenza virus
GFIEGGWQGMV

SEQ ID NO: 524720 - protein, 11 aa, Influenza virus
GFIEGGWSGLI

SEQ ID NO: 524721 - protein, 11 aa, Influenza virus
GFIEGGWSGLV

SEQ ID NO: 524722 - protein, 11 aa, Influenza virus
GFIEGGWSGMI

SEQ ID NO: 524723 - protein, 11 aa, Influenza virus
GFIEGGWTGLI

SEQ ID NO: 524724 - protein, 11 aa, Influenza virus
GFIEGGWTGMI

SEQ ID NO: 524725 - protein, 11 aa, Influenza virus
GFIEGGWTGMV

SEQ ID NO: 524726 - protein, 11 aa, Influenza virus
GFIEGRWPGLV

SEQ ID NO: 524727 - protein, 11 aa, Influenza virus
GFIENGWEGLI

SEQ ID NO: 524728 - protein, 11 aa, Influenza virus
GFIENGWEGLV

SEQ ID NO: 524729 - protein, 11 aa, Influenza virus
GFIENGWEGMI

SEQ ID NO: 524730 - protein, 11 aa, Influenza virus
GFIENGWEGMM

SEQ ID NO: 524731 - protein, 11 aa, Influenza virus
GFIENGWEGMV

SEQ ID NO: 524732 - protein, 11 aa, Influenza virus
GFIENGWQGLI

SEQ ID NO: 524733 - protein, 11 aa, Influenza virus
GFIFGCQNGNI

SEQ ID NO: 524734 - protein, 11 aa, Influenza virus
GFIFGCQNGNV

SEQ ID NO: 524735 - protein, 11 aa, Influenza virus
GFIIKGRSHLR

SEQ ID NO: 524736 - protein, 11 aa, Influenza virus
GFIMWACQKGN

SEQ ID NO: 524737 - protein, 11 aa, Influenza virus
GFIMWACQRGN

SEQ ID NO: 524738 - protein, 11 aa, Influenza virus
GFIMWTCQKGN

SEQ ID NO: 524739 - protein, 11 aa, Influenza virus
GFIVKGRSHLR

SEQ ID NO: 524740 - protein, 11 aa, Influenza virus
GFIVWACQRGN

SEQ ID NO: 524741 - protein, 11 aa, Influenza virus
GFIYSGIRTNG

SEQ ID NO: 524742 - protein, 11 aa, Influenza virus
GFKHQNAQGEG

SEQ ID NO: 524743 - protein, 11 aa, Influenza virus
GFKISKRGGSG

SEQ ID NO: 524744 - protein, 11 aa, Influenza virus
GFKISKRGNSG

SEQ ID NO: 524745 - protein, 11 aa, Influenza virus
GFKISKRGSSG

SEQ ID NO: 524746 - protein, 11 aa, Influenza virus
GFKISRRGNSG

SEQ ID NO: 524747 - protein, 11 aa, Influenza virus
GFLAPRYGYII

SEQ ID NO: 524748 - protein, 11 aa, Influenza virus
GFLDIWTYNAE

SEQ ID NO: 524749 - protein, 11 aa, Influenza virus
GFLDVWTYNAE

SEQ ID NO: 524750 - protein, 11 aa, Influenza virus
GFLDVWTYNTE

SEQ ID NO: 524751 - protein, 11 aa, Influenza virus
GFLGVWTYNAE

SEQ ID NO: 524752 - protein, 11 aa, Influenza virus
GFLNVWTYNAE

SEQ ID NO: 524753 - protein, 11 aa, Influenza virus
GFMDVWTYNAE

SEQ ID NO: 524754 - protein, 11 aa, Influenza virus
GFQHQNAEGIG

SEQ ID NO: 524755 - protein, 11 aa, Influenza virus
GFQHQNAEGTG

SEQ ID NO: 524756 - protein, 11 aa, Influenza virus
GFQHQNEQGMG

SEQ ID NO: 524757 - protein, 11 aa, Influenza virus
GFQHQNEQGTG

SEQ ID NO: 524758 - protein, 11 aa, Influenza virus
GFQHQNEQGVG

SEQ ID NO: 524759 - protein, 11 aa, Influenza virus
GFQHQNSEGTG

SEQ ID NO: 524760 - protein, 11 aa, Influenza virus
GFQHRNDEGTG

SEQ ID NO: 524761 - protein, 11 aa, Influenza virus
GFQHRNEEGTG

SEQ ID NO: 524762 - protein, 11 aa, Influenza virus
GFRDVWTYNAE

SEQ ID NO: 524763 - protein, 11 aa, Influenza virus
GFRHQKAQGEG

SEQ ID NO: 524764 - protein, 11 aa, Influenza virus
GFRHQNAEGTG

SEQ ID NO: 524765 - protein, 11 aa, Influenza virus
GFRHQNAQGEG

SEQ ID NO: 524766 - protein, 11 aa, Influenza virus
GFRHQNAQGIG

SEQ ID NO: 524767 - protein, 11 aa, Influenza virus
GFRHQNAQGQG

SEQ ID NO: 524768 - protein, 11 aa, Influenza virus
GFRHQNAQGTG

SEQ ID NO: 524769 - protein, 11 aa, Influenza virus
GFRHQNSEGTG

SEQ ID NO: 524770 - protein, 11 aa, Influenza virus
GFRHQNSQGEG

SEQ ID NO: 524771 - protein, 11 aa, Influenza virus
GFRHQNTQGEG

SEQ ID NO: 524772 - protein, 11 aa, Influenza virus
GFRISKRGSSG

SEQ ID NO: 524773 - protein, 11 aa, Influenza virus
GFRQGNSVWAG

SEQ ID NO: 524774 - protein, 11 aa, Influenza virus
GFRQGTSVWAG

SEQ ID NO: 524775 - protein, 11 aa, Influenza virus
GFRYSGIKTDG

SEQ ID NO: 524776 - protein, 11 aa, Influenza virus
GFRYSGIRTDG

SEQ ID NO: 524777 - protein, 11 aa, Influenza virus
GFSAESRKLLL

SEQ ID NO: 524778 - protein, 11 aa, Influenza virus
GFSAESRKMLL

SEQ ID NO: 524779 - protein, 11 aa, Influenza virus
GFSFKYGNGVW

SEQ ID NO: 524780 - protein, 11 aa, Influenza virus
GFSFRYGDGVW

SEQ ID NO: 524781 - protein, 11 aa, Influenza virus
GFSFRYGNGVW

SEQ ID NO: 524782 - protein, 11 aa, Influenza virus
GFSYKYDNGVW

SEQ ID NO: 524783 - protein, 11 aa, Influenza virus
GFSYKYGNGVW

SEQ ID NO: 524784 - protein, 11 aa, Influenza virus
GFSYRYGNGVW

SEQ ID NO: 524785 - protein, 11 aa, Influenza virus
GFTYNGIRTNG

SEQ ID NO: 524786 - protein, 11 aa, Influenza virus
GFTYSEIRTNG

SEQ ID NO: 524787 - protein, 11 aa, Influenza virus
GFTYSGIRTDG

SEQ ID NO: 524788 - protein, 11 aa, Influenza virus
GFTYSGIRTNG

SEQ ID NO: 524789 - protein, 11 aa, Influenza virus
GFTYTGVRTDG

SEQ ID NO: 524790 - protein, 11 aa, Influenza virus
GFTYTGVRTNG

SEQ ID NO: 524791 - protein, 11 aa, Influenza virus
GFVANFSMELP

SEQ ID NO: 524792 - protein, 11 aa, Influenza virus
GFVENLEELRF

SEQ ID NO: 524793 - protein, 11 aa, Influenza virus
GFVFTLTVPSE

SEQ ID NO: 524794 - protein, 11 aa, Influenza virus
GFVIVSKDNGI

SEQ ID NO: 524795 - protein, 11 aa, Influenza virus
GFVLWACQNGN

SEQ ID NO: 524796 - protein, 11 aa, Influenza virus
GFVMWACQKGN

SEQ ID NO: 524797 - protein, 11 aa, Influenza virus
GFVRTLFQQMR

SEQ ID NO: 524798 - protein, 11 aa, Influenza virus
GFWMCSNGSLQ

SEQ ID NO: 524799 - protein, 11 aa, Influenza virus
GGAIWVTREPY

SEQ ID NO: 524800 - protein, 11 aa, Influenza virus
GGAQHVEECSC

SEQ ID NO: 524801 - protein, 11 aa, Influenza virus
GGAVWVTREPY

SEQ ID NO: 524802 - protein, 11 aa, Influenza virus
GGCSFAGWILG

SEQ ID NO: 524803 - protein, 11 aa, Influenza virus
GGDIWITREPY

SEQ ID NO: 524804 - protein, 11 aa, Influenza virus
GGDIWVTREHY

SEQ ID NO: 524805 - protein, 11 aa, Influenza virus
GGDIWVTRELY

SEQ ID NO: 524806 - protein, 11 aa, Influenza virus
GGDIWVTREPY

SEQ ID NO: 524807 - protein, 11 aa, Influenza virus
GGDIWVTRKPY

SEQ ID NO: 524808 - protein, 11 aa, Influenza virus
GGDSFYAELKW

SEQ ID NO: 524809 - protein, 11 aa, Influenza virus
GGFIFGCQNGN

SEQ ID NO: 524810 - protein, 11 aa, Influenza virus
GGFLAPRYGYI

SEQ ID NO: 524811 - protein, 11 aa, Influenza virus
GGGPDPGVKGF

SEQ ID NO: 524812 - protein, 11 aa, Influenza virus
GGGYAADKEST

SEQ ID NO: 524813 - protein, 11 aa, Influenza virus
GGHGVKGWAFD

SEQ ID NO: 524814 - protein, 11 aa, Influenza virus
GGHIEECSCYP

SEQ ID NO: 524815 - protein, 11 aa, Influenza virus
GGHIWVTREPY

SEQ ID NO: 524816 - protein, 11 aa, Influenza virus
GGIDKEPMGFR

SEQ ID NO: 524817 - protein, 11 aa, Influenza virus
GGIDKESMGFR

SEQ ID NO: 524818 - protein, 11 aa, Influenza virus
GGIDTNKTFQN

SEQ ID NO: 524819 - protein, 11 aa, Influenza virus
GGINTNKTFQN

SEQ ID NO: 524820 - protein, 11 aa, Influenza virus
GGINTNRTFQN

SEQ ID NO: 524821 - protein, 11 aa, Influenza virus
GGIPTDVIRSW

SEQ ID NO: 524822 - protein, 11 aa, Influenza virus
GGIPTDVVRSW

SEQ ID NO: 524823 - protein, 11 aa, Influenza virus
GGLGVKGFGFK

SEQ ID NO: 524824 - protein, 11 aa, Influenza virus
GGLIAPRYGYI

SEQ ID NO: 524825 - protein, 11 aa, Influenza virus
GGLIAPSRVSK

SEQ ID NO: 524826 - protein, 11 aa, Influenza virus
GGLIAPSRVTK

SEQ ID NO: 524827 - protein, 11 aa, Influenza virus
GGLILGMQNGS

SEQ ID NO: 524828 - protein, 11 aa, Influenza virus
GGLLAPKYGYI

SEQ ID NO: 524829 - protein, 11 aa, Influenza virus
GGLLAPRYGYI

SEQ ID NO: 524830 - protein, 11 aa, Influenza virus
GGLVAPSRVSK

SEQ ID NO: 524831 - protein, 11 aa, Influenza virus
GGMPTDVVRSW

SEQ ID NO: 524832 - protein, 11 aa, Influenza virus
GGNEKKAKLAN

SEQ ID NO: 524833 - protein, 11 aa, Influenza virus
GGNIWITREPY

SEQ ID NO: 524834 - protein, 11 aa, Influenza virus
GGNPDPGVKGF

SEQ ID NO: 524835 - protein, 11 aa, Influenza virus
GGNSFYAELKW

SEQ ID NO: 524836 - protein, 11 aa, Influenza virus
GGPDPGVKGFA

SEQ ID NO: 524837 - protein, 11 aa, Influenza virus
GGPGVKGFGFK

SEQ ID NO: 524838 - protein, 11 aa, Influenza virus
GGPNLYNIRNL

SEQ ID NO: 524839 - protein, 11 aa, Influenza virus
GGQAFYRSINW

SEQ ID NO: 524840 - protein, 11 aa, Influenza virus
GGQSFYRSINW

SEQ ID NO: 524841 - protein, 11 aa, Influenza virus
GGRNSFFSRLN

SEQ ID NO: 524842 - protein, 11 aa, Influenza virus
GGSGTDNYGVK

SEQ ID NO: 524843 - protein, 11 aa, Influenza virus
GGSGTNNYGVK

SEQ ID NO: 524844 - protein, 11 aa, Influenza virus
GGSIITELPFQ

SEQ ID NO: 524845 - protein, 11 aa, Influenza virus
GGSIKTKLPFQ

SEQ ID NO: 524846 - protein, 11 aa, Influenza virus
GGSINTKLPFQ

SEQ ID NO: 524847 - protein, 11 aa, Influenza virus
GGSINTRLPFQ

SEQ ID NO: 524848 - protein, 11 aa, Influenza virus
GGSPDPGVKGF

SEQ ID NO: 524849 - protein, 11 aa, Influenza virus
GGTGSIYIEVL

SEQ ID NO: 524850 - protein, 11 aa, Influenza virus
GGTGSVYIEVL

SEQ ID NO: 524851 - protein, 11 aa, Influenza virus
GGTIASNLPFQ

SEQ ID NO: 524852 - protein, 11 aa, Influenza virus
GGTIASSLPFQ

SEQ ID NO: 524853 - protein, 11 aa, Influenza virus
GGTIISNLPFQ

SEQ ID NO: 524854 - protein, 11 aa, Influenza virus
GGTIISSLPFQ

SEQ ID NO: 524855 - protein, 11 aa, Influenza virus
GGTINSPLPFQ

SEQ ID NO: 524856 - protein, 11 aa, Influenza virus
GGTISPRSRSG

SEQ ID NO: 524857 - protein, 11 aa, Influenza virus
GGTITSNLPFQ

SEQ ID NO: 524858 - protein, 11 aa, Influenza virus
GGTITSPLPFQ

SEQ ID NO: 524859 - protein, 11 aa, Influenza virus
GGTIVSSLPFQ

SEQ ID NO: 524860 - protein, 11 aa, Influenza virus
GGTPDPGVKGF

SEQ ID NO: 524861 - protein, 11 aa, Influenza virus
GGTSSIYIEVL

SEQ ID NO: 524862 - protein, 11 aa, Influenza virus
GGTSSVYIEVL

SEQ ID NO: 524863 - protein, 11 aa, Influenza virus
GGTSSVYVEVL

SEQ ID NO: 524864 - protein, 11 aa, Influenza virus
GGVESAVLRGF

SEQ ID NO: 524865 - protein, 11 aa, Influenza virus
GGVNTNKTFQN

SEQ ID NO: 524866 - protein, 11 aa, Influenza virus
GGVPTDVIRSW

SEQ ID NO: 524867 - protein, 11 aa, Influenza virus
GGVPTDVVRSW

SEQ ID NO: 524868 - protein, 11 aa, Influenza virus
GGWCGMIDGWY

SEQ ID NO: 524869 - protein, 11 aa, Influenza virus
GGWPGLINGWY

SEQ ID NO: 524870 - protein, 11 aa, Influenza virus
GGWPGLVAGWY

SEQ ID NO: 524871 - protein, 11 aa, Influenza virus
GGWQGLVDGWY

SEQ ID NO: 524872 - protein, 11 aa, Influenza virus
GGWQGMIDGWY

SEQ ID NO: 524873 - protein, 11 aa, Influenza virus
GGWQGMVDGWY

SEQ ID NO: 524874 - protein, 11 aa, Influenza virus
GGWSGLIAGWY

SEQ ID NO: 524875 - protein, 11 aa, Influenza virus
GGWSGLVAGWY

SEQ ID NO: 524876 - protein, 11 aa, Influenza virus
GGWSGMIDGWY

SEQ ID NO: 524877 - protein, 11 aa, Influenza virus
GGWTGLIDGWY

SEQ ID NO: 524878 - protein, 11 aa, Influenza virus
GGWTGMIDGWY

SEQ ID NO: 524879 - protein, 11 aa, Influenza virus
GGWTGMVDGWY

SEQ ID NO: 524880 - protein, 11 aa, Influenza virus
GGWTGMVNGWY

SEQ ID NO: 524881 - protein, 11 aa, Influenza virus
GGYKDIILWFS

SEQ ID NO: 524882 - protein, 11 aa, Influenza virus
GGYKDVILWFS

SEQ ID NO: 524883 - protein, 11 aa, Influenza virus
GGYPVIKKTYN

SEQ ID NO: 524884 - protein, 11 aa, Influenza virus
GHDFEREGYSL

SEQ ID NO: 524885 - protein, 11 aa, Influenza virus
GHHANNSTEQV

SEQ ID NO: 524886 - protein, 11 aa, Influenza virus
GHHAVANGTKV

SEQ ID NO: 524887 - protein, 11 aa, Influenza virus
GHHAVANGTRV

SEQ ID NO: 524888 - protein, 11 aa, Influenza virus
GHHAVENGTSV

SEQ ID NO: 524889 - protein, 11 aa, Influenza virus
GHHAVPNGTIV

SEQ ID NO: 524890 - protein, 11 aa, Influenza virus
GHHAVPNGTKV

SEQ ID NO: 524891 - protein, 11 aa, Influenza virus
GHHAVPNGTLV

SEQ ID NO: 524892 - protein, 11 aa, Influenza virus
GHHAVPNGTVV

SEQ ID NO: 524893 - protein, 11 aa, Influenza virus
GHHAVSNGTKV

SEQ ID NO: 524894 - protein, 11 aa, Influenza virus
GHHAVTNGTKV

SEQ ID NO: 524895 - protein, 11 aa, Influenza virus
GHIEECSCYPN

SEQ ID NO: 524896 - protein, 11 aa, Influenza virus
GHIFVIREPFV

SEQ ID NO: 524897 - protein, 11 aa, Influenza virus
GHIWVTREPYV

SEQ ID NO: 524898 - protein, 11 aa, Influenza virus
GHLITGKSHGR

SEQ ID NO: 524899 - protein, 11 aa, Influenza virus
GHLTTGKSHGR

SEQ ID NO: 524900 - protein, 11 aa, Influenza virus
GHLVTGKSHGR

SEQ ID NO: 524901 - protein, 11 aa, Influenza virus
GHNQEYTSGRQ

SEQ ID NO: 524902 - protein, 11 aa, Influenza virus
GHVFIIREPFV

SEQ ID NO: 524903 - protein, 11 aa, Influenza virus
GHVFVIREPFV

SEQ ID NO: 524904 - protein, 11 aa, Influenza virus
GHWPDGSNIGF

SEQ ID NO: 524905 - protein, 11 aa, Influenza virus
GHYKISKSTKS

SEQ ID NO: 524906 - protein, 11 aa, Influenza virus
GIAADKASTQK

SEQ ID NO: 524907 - protein, 11 aa, Influenza virus
GIAADKESTQE

SEQ ID NO: 524908 - protein, 11 aa, Influenza virus
GIAADKESTQK

SEQ ID NO: 524909 - protein, 11 aa, Influenza virus
GIAADKESTQT

SEQ ID NO: 524910 - protein, 11 aa, Influenza virus
GIAADKTSTQK

SEQ ID NO: 524911 - protein, 11 aa, Influenza virus
GIAADKVSTQK

SEQ ID NO: 524912 - protein, 11 aa, Influenza virus
GIAADRESTQK

SEQ ID NO: 524913 - protein, 11 aa, Influenza virus
GIAADYKSTQS

SEQ ID NO: 524914 - protein, 11 aa, Influenza virus
GIAAEKESTQK

SEQ ID NO: 524915 - protein, 11 aa, Influenza virus
GIAIALGIINL

SEQ ID NO: 524916 - protein, 11 aa, Influenza virus
GIAIVLGIINL

SEQ ID NO: 524917 - protein, 11 aa, Influenza virus
GICAVATTHSW

SEQ ID NO: 524918 - protein, 11 aa, Influenza virus
GICPVVFTDGS

SEQ ID NO: 524919 - protein, 11 aa, Influenza virus
GICPVVMTDGP

SEQ ID NO: 524920 - protein, 11 aa, Influenza virus
GICTVVMTDGS

SEQ ID NO: 524921 - protein, 11 aa, Influenza virus
GICVVAVTDGP

SEQ ID NO: 524922 - protein, 11 aa, Influenza virus
GICYPGSIENQ

SEQ ID NO: 524923 - protein, 11 aa, Influenza virus
GICYPGSVENQ

SEQ ID NO: 524924 - protein, 11 aa, Influenza virus
GIDKEPMGFRY

SEQ ID NO: 524925 - protein, 11 aa, Influenza virus
GIDKESMGFRY

SEQ ID NO: 524926 - protein, 11 aa, Influenza virus
GIDKICLGHHA

SEQ ID NO: 524927 - protein, 11 aa, Influenza virus
GIDKVCTKGKK

SEQ ID NO: 524928 - protein, 11 aa, Influenza virus
GIDTNKTFQNI

SEQ ID NO: 524929 - protein, 11 aa, Influenza virus
GIEVVNATETV

SEQ ID NO: 524930 - protein, 11 aa, Influenza virus
GIEYNGKSLGI

SEQ ID NO: 524931 - protein, 11 aa, Influenza virus
GIFFWMCSNGS

SEQ ID NO: 524932 - protein, 11 aa, Influenza virus
GIFGAIAGFIE

SEQ ID NO: 524933 - protein, 11 aa, Influenza virus
GIFGPVHFRNQ

SEQ ID NO: 524934 - protein, 11 aa, Influenza virus
GIFLWMCSNGS

SEQ ID NO: 524935 - protein, 11 aa, Influenza virus
GIGIAADRDST

SEQ ID NO: 524936 - protein, 11 aa, Influenza virus
GIGKFYIQMCT

SEQ ID NO: 524937 - protein, 11 aa, Influenza virus
GIGNLAFNAVI

SEQ ID NO: 524938 - protein, 11 aa, Influenza virus
GIGNLIFNTVI

SEQ ID NO: 524939 - protein, 11 aa, Influenza virus
GIGNLVFNTVI

SEQ ID NO: 524940 - protein, 11 aa, Influenza virus
GIGQAADLKST

SEQ ID NO: 524941 - protein, 11 aa, Influenza virus
GIGQAADYKST

SEQ ID NO: 524942 - protein, 11 aa, Influenza virus
GIGRFYIQMCT

SEQ ID NO: 524943 - protein, 11 aa, Influenza virus
GIGRFYVQMCT

SEQ ID NO: 524944 - protein, 11 aa, Influenza virus
GIGRMTICIQG

SEQ ID NO: 524945 - protein, 11 aa, Influenza virus
GIGRMTICVQG

SEQ ID NO: 524946 - protein, 11 aa, Influenza virus
GIHHPDSETTA

SEQ ID NO: 524947 - protein, 11 aa, Influenza virus
GIHHPDTEATA

SEQ ID NO: 524948 - protein, 11 aa, Influenza virus
GIHHPDTEAVA

SEQ ID NO: 524949 - protein, 11 aa, Influenza virus
GIHHPDTEEVA

SEQ ID NO: 524950 - protein, 11 aa, Influenza virus
GIHHPDTETTA

SEQ ID NO: 524951 - protein, 11 aa, Influenza virus
GIHHPPDAKEQ

SEQ ID NO: 524952 - protein, 11 aa, Influenza virus
GIHHPPDETEQ

SEQ ID NO: 524953 - protein, 11 aa, Influenza virus
GIHHPPDTKEQ

SEQ ID NO: 524954 - protein, 11 aa, Influenza virus
GIHHPPNTKEQ

SEQ ID NO: 524955 - protein, 11 aa, Influenza virus
GIHHPSSAQEK

SEQ ID NO: 524956 - protein, 11 aa, Influenza virus
GIHHPSSTKEK

SEQ ID NO: 524957 - protein, 11 aa, Influenza virus
GIHHPSSTQEK

SEQ ID NO: 524958 - protein, 11 aa, Influenza virus
GIILGNPKCDL

SEQ ID NO: 524959 - protein, 11 aa, Influenza virus
GIINLLIGISN

SEQ ID NO: 524960 - protein, 11 aa, Influenza virus
GIITDTFKSWK

SEQ ID NO: 524961 - protein, 11 aa, Influenza virus
GIITDTLKSWK

SEQ ID NO: 524962 - protein, 11 aa, Influenza virus
GIKLKSEDNVY

SEQ ID NO: 524963 - protein, 11 aa, Influenza virus
GIKLKTEDNIY

SEQ ID NO: 524964 - protein, 11 aa, Influenza virus
GIKLKTEDNVY

SEQ ID NO: 524965 - protein, 11 aa, Influenza virus
GIKSFSRTELI

SEQ ID NO: 524966 - protein, 11 aa, Influenza virus
GIKSFSRTQLI

SEQ ID NO: 524967 - protein, 11 aa, Influenza virus
GIKTDGATSAC

SEQ ID NO: 524968 - protein, 11 aa, Influenza virus
GILEDEQMYQK

SEQ ID NO: 524969 - protein, 11 aa, Influenza virus
GILEDEQMYQR

SEQ ID NO: 524970 - protein, 11 aa, Influenza virus
GILEDERMYQK

SEQ ID NO: 524971 - protein, 11 aa, Influenza virus
GILGFVFTLTV

SEQ ID NO: 524972 - protein, 11 aa, Influenza virus
GILGILTGPPQ

SEQ ID NO: 524973 - protein, 11 aa, Influenza virus
GILGTIIGPPQ

SEQ ID NO: 524974 - protein, 11 aa, Influenza virus
GILKRGETLKI

SEQ ID NO: 524975 - protein, 11 aa, Influenza virus
GILTDTSRPGD

SEQ ID NO: 524976 - protein, 11 aa, Influenza virus
GILTDTSRPSD

SEQ ID NO: 524977 - protein, 11 aa, Influenza virus
GILTKTTVDHM

SEQ ID NO: 524978 - protein, 11 aa, Influenza virus
GIMNTSKPFQN

SEQ ID NO: 524979 - protein, 11 aa, Influenza virus
GINDRNFWRGD

SEQ ID NO: 524980 - protein, 11 aa, Influenza virus
GINDRNFWRGE

SEQ ID NO: 524981 - protein, 11 aa, Influenza virus
GINESADMSIG

SEQ ID NO: 524982 - protein, 11 aa, Influenza virus
GINKVCTKGKK

SEQ ID NO: 524983 - protein, 11 aa, Influenza virus
GINMSKKKSYI

SEQ ID NO: 524984 - protein, 11 aa, Influenza virus
GINMSKRKSYI

SEQ ID NO: 524985 - protein, 11 aa, Influenza virus
GINTNKTFQNI

SEQ ID NO: 524986 - protein, 11 aa, Influenza virus
GINTNRTFQNI

SEQ ID NO: 524987 - protein, 11 aa, Influenza virus
GIPFHLGTKQV

SEQ ID NO: 524988 - protein, 11 aa, Influenza virus
GIPPLELGDCS

SEQ ID NO: 524989 - protein, 11 aa, Influenza virus
GIPPLELGNCS

SEQ ID NO: 524990 - protein, 11 aa, Influenza virus
GIPPLELRDCS

SEQ ID NO: 524991 - protein, 11 aa, Influenza virus
GIPPLVLGDCS

SEQ ID NO: 524992 - protein, 11 aa, Influenza virus
GIPSDTPRGED

SEQ ID NO: 524993 - protein, 11 aa, Influenza virus
GIPTDTPRGED

SEQ ID NO: 524994 - protein, 11 aa, Influenza virus
GIPTDTPRIQD

SEQ ID NO: 524995 - protein, 11 aa, Influenza virus
GIPTDTPRVQD

SEQ ID NO: 524996 - protein, 11 aa, Influenza virus
GIQAGVDRFYR

SEQ ID NO: 524997 - protein, 11 aa, Influenza virus
GIQAGVNRFYR

SEQ ID NO: 524998 - protein, 11 aa, Influenza virus
GIQSDAQIDES

SEQ ID NO: 524999 - protein, 11 aa, Influenza virus
GIREWSYLIED

SEQ ID NO: 525000 - protein, 11 aa, Influenza virus
GIRIGSKGDVF

SEQ ID NO: 525001 - protein, 11 aa, Influenza virus
GIRIGSKGHVF

SEQ ID NO: 525002 - protein, 11 aa, Influenza virus
GIRIGSRGEVF

SEQ ID NO: 525003 - protein, 11 aa, Influenza virus
GIRIGSRGHIF

SEQ ID NO: 525004 - protein, 11 aa, Influenza virus
GIRIGSRGHVF

SEQ ID NO: 525005 - protein, 11 aa, Influenza virus
GIRPGYNGQKS

SEQ ID NO: 525006 - protein, 11 aa, Influenza virus
GIRSFSRTELI

SEQ ID NO: 525007 - protein, 11 aa, Influenza virus
GIRTDGATSAC

SEQ ID NO: 525008 - protein, 11 aa, Influenza virus
GIRVGSRGHVF

SEQ ID NO: 525009 - protein, 11 aa, Influenza virus
GISFWMCSNGS

SEQ ID NO: 525010 - protein, 11 aa, Influenza virus
GISGADDDAYA

SEQ ID NO: 525011 - protein, 11 aa, Influenza virus
GISGPDDGAVA

SEQ ID NO: 525012 - protein, 11 aa, Influenza virus
GISGPDNEAVA

SEQ ID NO: 525013 - protein, 11 aa, Influenza virus
GISGPDNGAVA

SEQ ID NO: 525014 - protein, 11 aa, Influenza virus
GISGPDSGAVA

SEQ ID NO: 525015 - protein, 11 aa, Influenza virus
GISIWMCSNGS

SEQ ID NO: 525016 - protein, 11 aa, Influenza virus
GISLWMCSNGS

SEQ ID NO: 525017 - protein, 11 aa, Influenza virus
GISNVGLKVSL

SEQ ID NO: 525018 - protein, 11 aa, Influenza virus
GISNVGLNVSL

SEQ ID NO: 525019 - protein, 11 aa, Influenza virus
GISPIHLGDCS

SEQ ID NO: 525020 - protein, 11 aa, Influenza virus
GISPVHLGDCS

SEQ ID NO: 525021 - protein, 11 aa, Influenza virus
GISSMGEAMVS

SEQ ID NO: 525022 - protein, 11 aa, Influenza virus
GISSMMEAMVS

SEQ ID NO: 525023 - protein, 11 aa, Influenza virus
GISSMVEAMIS

SEQ ID NO: 525024 - protein, 11 aa, Influenza virus
GISSMVEAMMS

SEQ ID NO: 525025 - protein, 11 aa, Influenza virus
GISSMVEAMVS

SEQ ID NO: 525026 - protein, 11 aa, Influenza virus
GITGPDATAVA

SEQ ID NO: 525027 - protein, 11 aa, Influenza virus
GITGPDSTAVA

SEQ ID NO: 525028 - protein, 11 aa, Influenza virus
GITGPDTTAVA

SEQ ID NO: 525029 - protein, 11 aa, Influenza virus
GITNKINSIID

SEQ ID NO: 525030 - protein, 11 aa, Influenza virus
GITNKVNSIID

SEQ ID NO: 525031 - protein, 11 aa, Influenza virus
GITVIKNNMIN

SEQ ID NO: 525032 - protein, 11 aa, Influenza virus
GIVNTTLSTIA

SEQ ID NO: 525033 - protein, 11 aa, Influenza virus
GIWDTLIERDN

SEQ ID NO: 525034 - protein, 11 aa, Influenza virus
GIYKILSIYST

SEQ ID NO: 525035 - protein, 11 aa, Influenza virus
GIYKILTIYST

SEQ ID NO: 525036 - protein, 11 aa, Influenza virus
GIYQILAIYAT

SEQ ID NO: 525037 - protein, 11 aa, Influenza virus
GIYQILAIYST

SEQ ID NO: 525038 - protein, 11 aa, Influenza virus
GIYQILSIYST

SEQ ID NO: 525039 - protein, 11 aa, Influenza virus
GKAPISLGDCS

SEQ ID NO: 525040 - protein, 11 aa, Influenza virus
GKAPISLGGCS

SEQ ID NO: 525041 - protein, 11 aa, Influenza virus
GKAQHIEECSC

SEQ ID NO: 525042 - protein, 11 aa, Influenza virus
GKAWLHICVTG

SEQ ID NO: 525043 - protein, 11 aa, Influenza virus
GKAWLHVCITG

SEQ ID NO: 525044 - protein, 11 aa, Influenza virus
GKAWLHVCVTG

SEQ ID NO: 525045 - protein, 11 aa, Influenza virus
GKCNDPYPGNN

SEQ ID NO: 525046 - protein, 11 aa, Influenza virus
GKCNEPYPGNN

SEQ ID NO: 525047 - protein, 11 aa, Influenza virus
GKCPKYIPSGS

SEQ ID NO: 525048 - protein, 11 aa, Influenza virus
GKCPKYIPSNS

SEQ ID NO: 525049 - protein, 11 aa, Influenza virus
GKCPKYIPSRS

SEQ ID NO: 525050 - protein, 11 aa, Influenza virus
GKCPKYISSGS

SEQ ID NO: 525051 - protein, 11 aa, Influenza virus
GKCPRYIPSGS

SEQ ID NO: 525052 - protein, 11 aa, Influenza virus
GKCPRYVKQSS

SEQ ID NO: 525053 - protein, 11 aa, Influenza virus
GKCYQFALGQG

SEQ ID NO: 525054 - protein, 11 aa, Influenza virus
GKDNAIRIGED

SEQ ID NO: 525055 - protein, 11 aa, Influenza virus
GKDNAIRIGEN

SEQ ID NO: 525056 - protein, 11 aa, Influenza virus
GKDNAIRIGGN

SEQ ID NO: 525057 - protein, 11 aa, Influenza virus
GKDNAVRIGED

SEQ ID NO: 525058 - protein, 11 aa, Influenza virus
GKDNAVRIGEN

SEQ ID NO: 525059 - protein, 11 aa, Influenza virus
GKDPKKTGGPI

SEQ ID NO: 525060 - protein, 11 aa, Influenza virus
GKEPISLGDCS

SEQ ID NO: 525061 - protein, 11 aa, Influenza virus
GKEWLHVCITG

SEQ ID NO: 525062 - protein, 11 aa, Influenza virus
GKEWMHICMTG

SEQ ID NO: 525063 - protein, 11 aa, Influenza virus
GKEWMHVCITG

SEQ ID NO: 525064 - protein, 11 aa, Influenza virus
GKEWMHVCMAG

SEQ ID NO: 525065 - protein, 11 aa, Influenza virus
GKEWMHVCMTG

SEQ ID NO: 525066 - protein, 11 aa, Influenza virus
GKFQTAAQKAM

SEQ ID NO: 525067 - protein, 11 aa, Influenza virus
GKFQTAAQRAM

SEQ ID NO: 525068 - protein, 11 aa, Influenza virus
GKFTNEEALRQ

SEQ ID NO: 525069 - protein, 11 aa, Influenza virus
GKFYIQMCTEL

SEQ ID NO: 525070 - protein, 11 aa, Influenza virus
GKGCFDILHKC

SEQ ID NO: 525071 - protein, 11 aa, Influenza virus
GKGCFDLYHKC

SEQ ID NO: 525072 - protein, 11 aa, Influenza virus
GKGCFEIYHAC

SEQ ID NO: 525073 - protein, 11 aa, Influenza virus
GKGCFEIYHKC

SEQ ID NO: 525074 - protein, 11 aa, Influenza virus
GKGCFEIYHNC

SEQ ID NO: 525075 - protein, 11 aa, Influenza virus
GKGCFEIYHTC

SEQ ID NO: 525076 - protein, 11 aa, Influenza virus
GKGCFELYHEC

SEQ ID NO: 525077 - protein, 11 aa, Influenza virus
GKGCFELYHKC

SEQ ID NO: 525078 - protein, 11 aa, Influenza virus
GKGCFELYHRC

SEQ ID NO: 525079 - protein, 11 aa, Influenza virus
GKGRIFQSHIR

SEQ ID NO: 525080 - protein, 11 aa, Influenza virus
GKGRIFQSPIR

SEQ ID NO: 525081 - protein, 11 aa, Influenza virus
GKGRIFQSRII

SEQ ID NO: 525082 - protein, 11 aa, Influenza virus
GKGRIFQSRIR

SEQ ID NO: 525083 - protein, 11 aa, Influenza virus
GKGRYGVKGFS

SEQ ID NO: 525084 - protein, 11 aa, Influenza virus
GKGSWPDGANI

SEQ ID NO: 525085 - protein, 11 aa, Influenza virus
GKGVWIGRTKS

SEQ ID NO: 525086 - protein, 11 aa, Influenza virus
GKHIVERILEE

SEQ ID NO: 525087 - protein, 11 aa, Influenza virus
GKHSNGTIHDR

SEQ ID NO: 525088 - protein, 11 aa, Influenza virus
GKIAHISPLSG

SEQ ID NO: 525089 - protein, 11 aa, Influenza virus
GKIIHISPLSG

SEQ ID NO: 525090 - protein, 11 aa, Influenza virus
GKIIQNEDIPI

SEQ ID NO: 525091 - protein, 11 aa, Influenza virus
GKILRTQESEC

SEQ ID NO: 525092 - protein, 11 aa, Influenza virus
GKISHISPLSG

SEQ ID NO: 525093 - protein, 11 aa, Influenza virus
GKITNKVNNIV

SEQ ID NO: 525094 - protein, 11 aa, Influenza virus
GKIVHISPLSG

SEQ ID NO: 525095 - protein, 11 aa, Influenza virus
GKKAVDLGSCG

SEQ ID NO: 525096 - protein, 11 aa, Influenza virus
GKKEEFSEIMK

SEQ ID NO: 525097 - protein, 11 aa, Influenza virus
GKKEEFSEIMR

SEQ ID NO: 525098 - protein, 11 aa, Influenza virus
GKKEFSEIMKI

SEQ ID NO: 525099 - protein, 11 aa, Influenza virus
GKKGKWLNQSK

SEQ ID NO: 525100 - protein, 11 aa, Influenza virus
GKLCKLNGIPP

SEQ ID NO: 525101 - protein, 11 aa, Influenza virus
GKLCRLRGIPP

SEQ ID NO: 525102 - protein, 11 aa, Influenza virus
GKLCRLSGIPP

SEQ ID NO: 525103 - protein, 11 aa, Influenza virus
GKLKRRAIATP

SEQ ID NO: 525104 - protein, 11 aa, Influenza virus
GKLNRFIEKTN

SEQ ID NO: 525105 - protein, 11 aa, Influenza virus
GKLNRIIEKTN

SEQ ID NO: 525106 - protein, 11 aa, Influenza virus
GKLNRLIDKTN

SEQ ID NO: 525107 - protein, 11 aa, Influenza virus
GKLNRLIDRTN

SEQ ID NO: 525108 - protein, 11 aa, Influenza virus
GKLNRLIEKTN

SEQ ID NO: 525109 - protein, 11 aa, Influenza virus
GKLNRLIERTN

SEQ ID NO: 525110 - protein, 11 aa, Influenza virus
GKLNRLIGKTN

SEQ ID NO: 525111 - protein, 11 aa, Influenza virus
GKLNRLISKTN

SEQ ID NO: 525112 - protein, 11 aa, Influenza virus
GKMRDSIKSWR

SEQ ID NO: 525113 - protein, 11 aa, Influenza virus
GKMTDSIKSWR

SEQ ID NO: 525114 - protein, 11 aa, Influenza virus
GKNADLEALME

SEQ ID NO: 525115 - protein, 11 aa, Influenza virus
GKNSDLEALME

SEQ ID NO: 525116 - protein, 11 aa, Influenza virus
GKNSFYAELKW

SEQ ID NO: 525117 - protein, 11 aa, Influenza virus
GKNTDLEALME

SEQ ID NO: 525118 - protein, 11 aa, Influenza virus
GKNTDLEVLME

SEQ ID NO: 525119 - protein, 11 aa, Influenza virus
GKQAKGLFGAI

SEQ ID NO: 525120 - protein, 11 aa, Influenza virus
GKQPISLGDCS

SEQ ID NO: 525121 - protein, 11 aa, Influenza virus
GKRGKWVKSVQ

SEQ ID NO: 525122 - protein, 11 aa, Influenza virus
GKSHGRILKND

SEQ ID NO: 525123 - protein, 11 aa, Influenza virus
GKSHGRILKNN

SEQ ID NO: 525124 - protein, 11 aa, Influenza virus
GKSHGRVLKNN

SEQ ID NO: 525125 - protein, 11 aa, Influenza virus
GKSLGIQSDAQ

SEQ ID NO: 525126 - protein, 11 aa, Influenza virus
GKTKATKMEAI

SEQ ID NO: 525127 - protein, 11 aa, Influenza virus
GKTKATKMKAI

SEQ ID NO: 525128 - protein, 11 aa, Influenza virus
GKTNEKFHQIE

SEQ ID NO: 525129 - protein, 11 aa, Influenza virus
GKTSWSYIVEK

SEQ ID NO: 525130 - protein, 11 aa, Influenza virus
GKTSWSYIVER

SEQ ID NO: 525131 - protein, 11 aa, Influenza virus
GKVCRALLAKS

SEQ ID NO: 525132 - protein, 11 aa, Influenza virus
GKVCRTLLAKS

SEQ ID NO: 525133 - protein, 11 aa, Influenza virus
GKVECICRDNW

SEQ ID NO: 525134 - protein, 11 aa, Influenza virus
GKVECVCRDNW

SEQ ID NO: 525135 - protein, 11 aa, Influenza virus
GKVVHISPLSG

SEQ ID NO: 525136 - protein, 11 aa, Influenza virus
GKWDTLIEREN

SEQ ID NO: 525137 - protein, 11 aa, Influenza virus
GKWREQLSQKF

SEQ ID NO: 525138 - protein, 11 aa, Influenza virus
GLAPFSKDNGI

SEQ ID NO: 525139 - protein, 11 aa, Influenza virus
GLCKINSWHIF

SEQ ID NO: 525140 - protein, 11 aa, Influenza virus
GLCTINSWHIF

SEQ ID NO: 525141 - protein, 11 aa, Influenza virus
GLCTINSWHIY

SEQ ID NO: 525142 - protein, 11 aa, Influenza virus
GLCYPGELDNN

SEQ ID NO: 525143 - protein, 11 aa, Influenza virus
GLCYPGELNNN

SEQ ID NO: 525144 - protein, 11 aa, Influenza virus
GLDIRTATREG

SEQ ID NO: 525145 - protein, 11 aa, Influenza virus
GLDKICLGHHA

SEQ ID NO: 525146 - protein, 11 aa, Influenza virus
GLDNEPGSGHW

SEQ ID NO: 525147 - protein, 11 aa, Influenza virus
GLDNEPGSGNW

SEQ ID NO: 525148 - protein, 11 aa, Influenza virus
GLDRICLGHHA

SEQ ID NO: 525149 - protein, 11 aa, Influenza virus
GLFFFCLKNGN

SEQ ID NO: 525150 - protein, 11 aa, Influenza virus
GLFFWMCSNGS

SEQ ID NO: 525151 - protein, 11 aa, Influenza virus
GLFGAIAGFIE

SEQ ID NO: 525152 - protein, 11 aa, Influenza virus
GLFGAIAGFLE

SEQ ID NO: 525153 - protein, 11 aa, Influenza virus
GLFGAKAGFIE

SEQ ID NO: 525154 - protein, 11 aa, Influenza virus
GLFLWMCSNGS

SEQ ID NO: 525155 - protein, 11 aa, Influenza virus
GLHDANVRNLH

SEQ ID NO: 525156 - protein, 11 aa, Influenza virus
GLIAGWYGFQH

SEQ ID NO: 525157 - protein, 11 aa, Influenza virus
GLIAPDRVSKL

SEQ ID NO: 525158 - protein, 11 aa, Influenza virus
GLIAPRYGYII

SEQ ID NO: 525159 - protein, 11 aa, Influenza virus
GLIAPSRVSKL

SEQ ID NO: 525160 - protein, 11 aa, Influenza virus
GLIAPSRVTKL

SEQ ID NO: 525161 - protein, 11 aa, Influenza virus
GLICATCEQIA

SEQ ID NO: 525162 - protein, 11 aa, Influenza virus
GLIDGWYGFKH

SEQ ID NO: 525163 - protein, 11 aa, Influenza virus
GLIDGWYGFRH

SEQ ID NO: 525164 - protein, 11 aa, Influenza virus
GLIDGWYGYHH

SEQ ID NO: 525165 - protein, 11 aa, Influenza virus
GLIDGWYGYKH

SEQ ID NO: 525166 - protein, 11 aa, Influenza virus
GLIDGWYGYRH

SEQ ID NO: 525167 - protein, 11 aa, Influenza virus
GLIFMCVKNGN

SEQ ID NO: 525168 - protein, 11 aa, Influenza virus
GLILAFILWAC

SEQ ID NO: 525169 - protein, 11 aa, Influenza virus
GLILAFIMWAC

SEQ ID NO: 525170 - protein, 11 aa, Influenza virus
GLILAFIMWTC

SEQ ID NO: 525171 - protein, 11 aa, Influenza virus
GLILGMQNGSC

SEQ ID NO: 525172 - protein, 11 aa, Influenza virus
GLILGMQNGSY

SEQ ID NO: 525173 - protein, 11 aa, Influenza virus
GLILGNPKCDL

SEQ ID NO: 525174 - protein, 11 aa, Influenza virus
GLILGNPKCDP

SEQ ID NO: 525175 - protein, 11 aa, Influenza virus
GLILSFIMWAC

SEQ ID NO: 525176 - protein, 11 aa, Influenza virus
GLILSNPKCDL

SEQ ID NO: 525177 - protein, 11 aa, Influenza virus
GLILTFIMWAC

SEQ ID NO: 525178 - protein, 11 aa, Influenza virus
GLINGWYGFQH

SEQ ID NO: 525179 - protein, 11 aa, Influenza virus
GLINGWYGFRH

SEQ ID NO: 525180 - protein, 11 aa, Influenza virus
GLISTPLGSPP

SEQ ID NO: 525181 - protein, 11 aa, Influenza virus
GLISTPLGTPP

SEQ ID NO: 525182 - protein, 11 aa, Influenza virus
GLIYNRMGAVT

SEQ ID NO: 525183 - protein, 11 aa, Influenza virus
GLIYNRMGTIT

SEQ ID NO: 525184 - protein, 11 aa, Influenza virus
GLIYNRMGTVA

SEQ ID NO: 525185 - protein, 11 aa, Influenza virus
GLIYNRMGTVN

SEQ ID NO: 525186 - protein, 11 aa, Influenza virus
GLIYNRMGTVT

SEQ ID NO: 525187 - protein, 11 aa, Influenza virus
GLKISSSFSFG

SEQ ID NO: 525188 - protein, 11 aa, Influenza virus
GLLAPKYGYII

SEQ ID NO: 525189 - protein, 11 aa, Influenza virus
GLLAPRYGYII

SEQ ID NO: 525190 - protein, 11 aa, Influenza virus
GLLDVWTYNAE

SEQ ID NO: 525191 - protein, 11 aa, Influenza virus
GLLEVGTRWMK

SEQ ID NO: 525192 - protein, 11 aa, Influenza virus
GLLGAIAGFIE

SEQ ID NO: 525193 - protein, 11 aa, Influenza virus
GLLGIITGPPQ

SEQ ID NO: 525194 - protein, 11 aa, Influenza virus
GLLGTITGPPQ

SEQ ID NO: 525195 - protein, 11 aa, Influenza virus
GLLGTLIGPPQ

SEQ ID NO: 525196 - protein, 11 aa, Influenza virus
GLLGTVTGPPQ

SEQ ID NO: 525197 - protein, 11 aa, Influenza virus
GLLISDGGPNL

SEQ ID NO: 525198 - protein, 11 aa, Influenza virus
GLLLQIISLCS

SEQ ID NO: 525199 - protein, 11 aa, Influenza virus
GLLLQITSLCS

SEQ ID NO: 525200 - protein, 11 aa, Influenza virus
GLLLWMCSNGS

SEQ ID NO: 525201 - protein, 11 aa, Influenza virus
GLLVADGGPNL

SEQ ID NO: 525202 - protein, 11 aa, Influenza virus
GLLVSDGGPNL

SEQ ID NO: 525203 - protein, 11 aa, Influenza virus
GLMSTPLGSPP

SEQ ID NO: 525204 - protein, 11 aa, Influenza virus
GLNNEPGSGNW

SEQ ID NO: 525205 - protein, 11 aa, Influenza virus
GLPQSGRIVVD

SEQ ID NO: 525206 - protein, 11 aa, Influenza virus
GLPSDTPRGED

SEQ ID NO: 525207 - protein, 11 aa, Influenza virus
GLPVGGNEKKA

SEQ ID NO: 525208 - protein, 11 aa, Influenza virus
GLQRRRFIQNA

SEQ ID NO: 525209 - protein, 11 aa, Influenza virus
GLQRRRFVQNA

SEQ ID NO: 525210 - protein, 11 aa, Influenza virus
GLQSSDDFALI

SEQ ID NO: 525211 - protein, 11 aa, Influenza virus
GLREQKQEFKM

SEQ ID NO: 525212 - protein, 11 aa, Influenza virus
GLRILIRGNSP

SEQ ID NO: 525213 - protein, 11 aa, Influenza virus
GLRILVRGNSP

SEQ ID NO: 525214 - protein, 11 aa, Influenza virus
GLRISSSFSFG

SEQ ID NO: 525215 - protein, 11 aa, Influenza virus
GLRNIPSIQSR

SEQ ID NO: 525216 - protein, 11 aa, Influenza virus
GLRNIPSVQSR

SEQ ID NO: 525217 - protein, 11 aa, Influenza virus
GLRNTPSIDPK

SEQ ID NO: 525218 - protein, 11 aa, Influenza virus
GLRNTPSIEPK

SEQ ID NO: 525219 - protein, 11 aa, Influenza virus
GLRNTPSIEPR

SEQ ID NO: 525220 - protein, 11 aa, Influenza virus
GLRNTPSVEPK

SEQ ID NO: 525221 - protein, 11 aa, Influenza virus
GLRNTPSVEPR

SEQ ID NO: 525222 - protein, 11 aa, Influenza virus
GLRNVPSIQSR

SEQ ID NO: 525223 - protein, 11 aa, Influenza virus
GLSFWMCSNGS

SEQ ID NO: 525224 - protein, 11 aa, Influenza virus
GLSLWMCFNGS

SEQ ID NO: 525225 - protein, 11 aa, Influenza virus
GLSLWMCSNGS

SEQ ID NO: 525226 - protein, 11 aa, Influenza virus
GLSMVKSDKIC

SEQ ID NO: 525227 - protein, 11 aa, Influenza virus
GLSMVRSDKIC

SEQ ID NO: 525228 - protein, 11 aa, Influenza virus
GLSPNVYQARF

SEQ ID NO: 525229 - protein, 11 aa, Influenza virus
GLSSRISFYWT

SEQ ID NO: 525230 - protein, 11 aa, Influenza virus
GLTHIMIWHSN

SEQ ID NO: 525231 - protein, 11 aa, Influenza virus
GLTHLMIWHSN

SEQ ID NO: 525232 - protein, 11 aa, Influenza virus
GLTHMMIWHSN

SEQ ID NO: 525233 - protein, 11 aa, Influenza virus
GLVAGWYGFQH

SEQ ID NO: 525234 - protein, 11 aa, Influenza virus
GLVCATCEQIA

SEQ ID NO: 525235 - protein, 11 aa, Influenza virus
GLVDGWYGFRH

SEQ ID NO: 525236 - protein, 11 aa, Influenza virus
GLVDGWYGYHH

SEQ ID NO: 525237 - protein, 11 aa, Influenza virus
GLVFFCLKNGN

SEQ ID NO: 525238 - protein, 11 aa, Influenza virus
GLVFFCLRNGN

SEQ ID NO: 525239 - protein, 11 aa, Influenza virus
GLVFICIKNGN

SEQ ID NO: 525240 - protein, 11 aa, Influenza virus
GLVFICMKNGN

SEQ ID NO: 525241 - protein, 11 aa, Influenza virus
GLVFICVKNGN

SEQ ID NO: 525242 - protein, 11 aa, Influenza virus
GLVFMCVKNGN

SEQ ID NO: 525243 - protein, 11 aa, Influenza virus
GLVGDTPRNDD

SEQ ID NO: 525244 - protein, 11 aa, Influenza virus
GLVGDTPRNED

SEQ ID NO: 525245 - protein, 11 aa, Influenza virus
GLVGDTPRNGD

SEQ ID NO: 525246 - protein, 11 aa, Influenza virus
GLVGDTPRNND

SEQ ID NO: 525247 - protein, 11 aa, Influenza virus
GLVLGNPKCDL

SEQ ID NO: 525248 - protein, 11 aa, Influenza virus
GLWAYNAELLV

SEQ ID NO: 525249 - protein, 11 aa, Influenza virus
GLWDPFRQSER

SEQ ID NO: 525250 - protein, 11 aa, Influenza virus
GLWDSFRQSER

SEQ ID NO: 525251 - protein, 11 aa, Influenza virus
GLYDAIEECLI

SEQ ID NO: 525252 - protein, 11 aa, Influenza virus
GLYEAIEECLI

SEQ ID NO: 525253 - protein, 11 aa, Influenza virus
GLYEAVEECLI

SEQ ID NO: 525254 - protein, 11 aa, Influenza virus
GLYESIEECLI

SEQ ID NO: 525255 - protein, 11 aa, Influenza virus
GLYGAIEECLI

SEQ ID NO: 525256 - protein, 11 aa, Influenza virus
GMAADKESTQK

SEQ ID NO: 525257 - protein, 11 aa, Influenza virus
GMAADQKSTQE

SEQ ID NO: 525258 - protein, 11 aa, Influenza virus
GMCYPGFVENL

SEQ ID NO: 525259 - protein, 11 aa, Influenza virus
GMCYPGSIENL

SEQ ID NO: 525260 - protein, 11 aa, Influenza virus
GMCYPGSVENL

SEQ ID NO: 525261 - protein, 11 aa, Influenza virus
GMDPRMCSLMQ

SEQ ID NO: 525262 - protein, 11 aa, Influenza virus
GMELRRCLLQS

SEQ ID NO: 525263 - protein, 11 aa, Influenza virus
GMEMRRCLLQS

SEQ ID NO: 525264 - protein, 11 aa, Influenza virus
GMFNMLSTVLG

SEQ ID NO: 525265 - protein, 11 aa, Influenza virus
GMGMAADKEST

SEQ ID NO: 525266 - protein, 11 aa, Influenza virus
GMGQAADLKST

SEQ ID NO: 525267 - protein, 11 aa, Influenza virus
GMIDGWYGFHH

SEQ ID NO: 525268 - protein, 11 aa, Influenza virus
GMIDGWYGFRH

SEQ ID NO: 525269 - protein, 11 aa, Influenza virus
GMIDGWYGYHH

SEQ ID NO: 525270 - protein, 11 aa, Influenza virus
GMKNVPEKIHT

SEQ ID NO: 525271 - protein, 11 aa, Influenza virus
GMKNVPEKIRT

SEQ ID NO: 525272 - protein, 11 aa, Influenza virus
GMKNVPEKIRV

SEQ ID NO: 525273 - protein, 11 aa, Influenza virus
GMLGFVFTLTV

SEQ ID NO: 525274 - protein, 11 aa, Influenza virus
GMMDGWYGFRH

SEQ ID NO: 525275 - protein, 11 aa, Influenza virus
GMMMGMFNMLS

SEQ ID NO: 525276 - protein, 11 aa, Influenza virus
GMQIRGFVHFV

SEQ ID NO: 525277 - protein, 11 aa, Influenza virus
GMQIRGFVYFV

SEQ ID NO: 525278 - protein, 11 aa, Influenza virus
GMQNGSCRCMF

SEQ ID NO: 525279 - protein, 11 aa, Influenza virus
GMQNGSYRCMF

SEQ ID NO: 525280 - protein, 11 aa, Influenza virus
GMRILIRGNSP

SEQ ID NO: 525281 - protein, 11 aa, Influenza virus
GMRILVRGNSP

SEQ ID NO: 525282 - protein, 11 aa, Influenza virus
GMRNIPEKQTR

SEQ ID NO: 525283 - protein, 11 aa, Influenza virus
GMRNIPERQTR

SEQ ID NO: 525284 - protein, 11 aa, Influenza virus
GMRNIPGKQAK

SEQ ID NO: 525285 - protein, 11 aa, Influenza virus
GMRNVPEKQTR

SEQ ID NO: 525286 - protein, 11 aa, Influenza virus
GMRNVPERQTR

SEQ ID NO: 525287 - protein, 11 aa, Influenza virus
GMRNVPETQTR

SEQ ID NO: 525288 - protein, 11 aa, Influenza virus
GMRVLIRGNSP

SEQ ID NO: 525289 - protein, 11 aa, Influenza virus
GMSANGDILMR

SEQ ID NO: 525290 - protein, 11 aa, Influenza virus
GMVDGWYGFHH

SEQ ID NO: 525291 - protein, 11 aa, Influenza virus
GMVDGWYGFRH

SEQ ID NO: 525292 - protein, 11 aa, Influenza virus
GMVDGWYGFRY

SEQ ID NO: 525293 - protein, 11 aa, Influenza virus
GMVDGWYGYHH

SEQ ID NO: 525294 - protein, 11 aa, Influenza virus
GMVNGWYGFRH

SEQ ID NO: 525295 - protein, 11 aa, Influenza virus
GNAEIEDLIFL

SEQ ID NO: 525296 - protein, 11 aa, Influenza virus
GNAEIEDLIFM

SEQ ID NO: 525297 - protein, 11 aa, Influenza virus
GNAEIEDLIFS

SEQ ID NO: 525298 - protein, 11 aa, Influenza virus
GNAEIEDLTFL

SEQ ID NO: 525299 - protein, 11 aa, Influenza virus
GNAKDEGNGCF

SEQ ID NO: 525300 - protein, 11 aa, Influenza virus
GNAQHIEECSC

SEQ ID NO: 525301 - protein, 11 aa, Influenza virus
GNAQHVEECSC

SEQ ID NO: 525302 - protein, 11 aa, Influenza virus
GNCPKYIKSGQ

SEQ ID NO: 525303 - protein, 11 aa, Influenza virus
GNCPKYVKQGS

SEQ ID NO: 525304 - protein, 11 aa, Influenza virus
GNCSIAGWLLG

SEQ ID NO: 525305 - protein, 11 aa, Influenza virus
GNCYWVMTDGP

SEQ ID NO: 525306 - protein, 11 aa, Influenza virus
GNDNWSGYSGS

SEQ ID NO: 525307 - protein, 11 aa, Influenza virus
GNDVWLGRTVS

SEQ ID NO: 525308 - protein, 11 aa, Influenza virus
GNDVWMGRTIS

SEQ ID NO: 525309 - protein, 11 aa, Influenza virus
GNEKKAKLANV

SEQ ID NO: 525310 - protein, 11 aa, Influenza virus
GNFIAPENAYK

SEQ ID NO: 525311 - protein, 11 aa, Influenza virus
GNFIAPEYAFK

SEQ ID NO: 525312 - protein, 11 aa, Influenza virus
GNFIAPEYAYI

SEQ ID NO: 525313 - protein, 11 aa, Influenza virus
GNFIAPEYAYK

SEQ ID NO: 525314 - protein, 11 aa, Influenza virus
GNFIAPEYAYR

SEQ ID NO: 525315 - protein, 11 aa, Influenza virus
GNFITPEYAYK

SEQ ID NO: 525316 - protein, 11 aa, Influenza virus
GNGAWIGRTKS

SEQ ID NO: 525317 - protein, 11 aa, Influenza virus
GNGCFDILHKC

SEQ ID NO: 525318 - protein, 11 aa, Influenza virus
GNGCFEFWHKC

SEQ ID NO: 525319 - protein, 11 aa, Influenza virus
GNGCFEFYHKC

SEQ ID NO: 525320 - protein, 11 aa, Influenza virus
GNGCFEFYHRC

SEQ ID NO: 525321 - protein, 11 aa, Influenza virus
GNGCFEIFHKC

SEQ ID NO: 525322 - protein, 11 aa, Influenza virus
GNGCFEIFHQC

SEQ ID NO: 525323 - protein, 11 aa, Influenza virus
GNGCFEIFHRC

SEQ ID NO: 525324 - protein, 11 aa, Influenza virus
GNGCFELLHKC

SEQ ID NO: 525325 - protein, 11 aa, Influenza virus
GNGCFELYHKC

SEQ ID NO: 525326 - protein, 11 aa, Influenza virus
GNGCFKIYHKC

SEQ ID NO: 525327 - protein, 11 aa, Influenza virus
GNGCFTFYHKC

SEQ ID NO: 525328 - protein, 11 aa, Influenza virus
GNGCFTFYHRC

SEQ ID NO: 525329 - protein, 11 aa, Influenza virus
GNGCFTIYHKC

SEQ ID NO: 525330 - protein, 11 aa, Influenza virus
GNGCLKIYHKC

SEQ ID NO: 525331 - protein, 11 aa, Influenza virus
GNGDPNNMDKA

SEQ ID NO: 525332 - protein, 11 aa, Influenza virus
GNGDPNNMDRA

SEQ ID NO: 525333 - protein, 11 aa, Influenza virus
GNGDPSNMDRA

SEQ ID NO: 525334 - protein, 11 aa, Influenza virus
GNGSCRCTICI

SEQ ID NO: 525335 - protein, 11 aa, Influenza virus
GNGVWIGRTKS

SEQ ID NO: 525336 - protein, 11 aa, Influenza virus
GNGVWMGRTKS

SEQ ID NO: 525337 - protein, 11 aa, Influenza virus
GNHGSLVLSLW

SEQ ID NO: 525338 - protein, 11 aa, Influenza virus
GNHGVKGWAFD

SEQ ID NO: 525339 - protein, 11 aa, Influenza virus
GNIIFLWGIHH

SEQ ID NO: 525340 - protein, 11 aa, Influenza virus
GNILLSPEEVS

SEQ ID NO: 525341 - protein, 11 aa, Influenza virus
GNILRTQESEC

SEQ ID NO: 525342 - protein, 11 aa, Influenza virus
GNILRTQESSC

SEQ ID NO: 525343 - protein, 11 aa, Influenza virus
GNIMRTQESEC

SEQ ID NO: 525344 - protein, 11 aa, Influenza virus
GNIWITREPYV

SEQ ID NO: 525345 - protein, 11 aa, Influenza virus
GNIYKILSIYS

SEQ ID NO: 525346 - protein, 11 aa, Influenza virus
GNKLITVGSSK

SEQ ID NO: 525347 - protein, 11 aa, Influenza virus
GNLAFNAVIHG

SEQ ID NO: 525348 - protein, 11 aa, Influenza virus
GNLIAPEFGYL

SEQ ID NO: 525349 - protein, 11 aa, Influenza virus
GNLIAPEYGFK

SEQ ID NO: 525350 - protein, 11 aa, Influenza virus
GNLIAPEYGFR

SEQ ID NO: 525351 - protein, 11 aa, Influenza virus
GNLIAPEYGHL

SEQ ID NO: 525352 - protein, 11 aa, Influenza virus
GNLIAPEYGYL

SEQ ID NO: 525353 - protein, 11 aa, Influenza virus
GNLIAPRGHYK

SEQ ID NO: 525354 - protein, 11 aa, Influenza virus
GNLIAPRGHYR

SEQ ID NO: 525355 - protein, 11 aa, Influenza virus
GNLIAPRGYFK

SEQ ID NO: 525356 - protein, 11 aa, Influenza virus
GNLIAPRGYFR

SEQ ID NO: 525357 - protein, 11 aa, Influenza virus
GNLIAPRGYYK

SEQ ID NO: 525358 - protein, 11 aa, Influenza virus
GNLIAPWYAFR

SEQ ID NO: 525359 - protein, 11 aa, Influenza virus
GNLIAPWYAYK

SEQ ID NO: 525360 - protein, 11 aa, Influenza virus
GNLIAPWYAYR

SEQ ID NO: 525361 - protein, 11 aa, Influenza virus
GNLIFNTVIHE

SEQ ID NO: 525362 - protein, 11 aa, Influenza virus
GNLIFNTVIHG

SEQ ID NO: 525363 - protein, 11 aa, Influenza virus
GNLIVFNTIGN

SEQ ID NO: 525364 - protein, 11 aa, Influenza virus
GNLNKKMEDGF

SEQ ID NO: 525365 - protein, 11 aa, Influenza virus
GNLVAPEYGFK

SEQ ID NO: 525366 - protein, 11 aa, Influenza virus
GNLVAPRGHYK

SEQ ID NO: 525367 - protein, 11 aa, Influenza virus
GNLVAPRGYFK

SEQ ID NO: 525368 - protein, 11 aa, Influenza virus
GNLVAPWYAYK

SEQ ID NO: 525369 - protein, 11 aa, Influenza virus
GNLVAPWYAYR

SEQ ID NO: 525370 - protein, 11 aa, Influenza virus
GNLVFNTVIHE

SEQ ID NO: 525371 - protein, 11 aa, Influenza virus
GNLVFNTVIHG

SEQ ID NO: 525372 - protein, 11 aa, Influenza virus
GNMRCTISLVK

SEQ ID NO: 525373 - protein, 11 aa, Influenza virus
GNNBNGVKGFS

SEQ ID NO: 525374 - protein, 11 aa, Influenza virus
GNNDNATATVY

SEQ ID NO: 525375 - protein, 11 aa, Influenza virus
GNNENATATVY

SEQ ID NO: 525376 - protein, 11 aa, Influenza virus
GNNKNATATVY

SEQ ID NO: 525377 - protein, 11 aa, Influenza virus
GNNNNATATVY

SEQ ID NO: 525378 - protein, 11 aa, Influenza virus
GNNNNGVKGFA

SEQ ID NO: 525379 - protein, 11 aa, Influenza virus
GNNNNGVKGFS

SEQ ID NO: 525380 - protein, 11 aa, Influenza virus
GNNQVFPQLNQ

SEQ ID NO: 525381 - protein, 11 aa, Influenza virus
GNPDPGVKGFA

SEQ ID NO: 525382 - protein, 11 aa, Influenza virus
GNPGVKGWAFD

SEQ ID NO: 525383 - protein, 11 aa, Influenza virus
GNPIICLGHHA

SEQ ID NO: 525384 - protein, 11 aa, Influenza virus
GNPKCDIHLKD

SEQ ID NO: 525385 - protein, 11 aa, Influenza virus
GNPKCDIHLRD

SEQ ID NO: 525386 - protein, 11 aa, Influenza virus
GNPKCDLYLNG

SEQ ID NO: 525387 - protein, 11 aa, Influenza virus
GNPKCDLYLSG

SEQ ID NO: 525388 - protein, 11 aa, Influenza virus
GNPKCDPYLNG

SEQ ID NO: 525389 - protein, 11 aa, Influenza virus
GNPKCDTHLKD

SEQ ID NO: 525390 - protein, 11 aa, Influenza virus
GNPKCDVHLKD

SEQ ID NO: 525391 - protein, 11 aa, Influenza virus
GNPMCDDLIGK

SEQ ID NO: 525392 - protein, 11 aa, Influenza virus
GNPMCDELIGK

SEQ ID NO: 525393 - protein, 11 aa, Influenza virus
GNPMCDNLIGK

SEQ ID NO: 525394 - protein, 11 aa, Influenza virus
GNPMCDYLIGK

SEQ ID NO: 525395 - protein, 11 aa, Influenza virus
GNPRCDDLIGK

SEQ ID NO: 525396 - protein, 11 aa, Influenza virus
GNPSCASNINI

SEQ ID NO: 525397 - protein, 11 aa, Influenza virus
GNPSCATNINI

SEQ ID NO: 525398 - protein, 11 aa, Influenza virus
GNPVICLGHHA

SEQ ID NO: 525399 - protein, 11 aa, Influenza virus
GNPVICLGHHS

SEQ ID NO: 525400 - protein, 11 aa, Influenza virus
GNPVICMGHHA

SEQ ID NO: 525401 - protein, 11 aa, Influenza virus
GNQGVKGWAFD

SEQ ID NO: 525402 - protein, 11 aa, Influenza virus
GNQHTIDLADS

SEQ ID NO: 525403 - protein, 11 aa, Influenza virus
GNSFYAELKWL

SEQ ID NO: 525404 - protein, 11 aa, Influenza virus
GNSGVKGWAFD

SEQ ID NO: 525405 - protein, 11 aa, Influenza virus
GNSNNGVKGFS

SEQ ID NO: 525406 - protein, 11 aa, Influenza virus
GNTWLGRTISP

SEQ ID NO: 525407 - protein, 11 aa, Influenza virus
GNTYVNNTTVI

SEQ ID NO: 525408 - protein, 11 aa, Influenza virus
GNVIDWTRDSV

SEQ ID NO: 525409 - protein, 11 aa, Influenza virus
GNVINWTKDSI

SEQ ID NO: 525410 - protein, 11 aa, Influenza virus
GNVINWTQDAM

SEQ ID NO: 525411 - protein, 11 aa, Influenza virus
GNVINWTRDAM

SEQ ID NO: 525412 - protein, 11 aa, Influenza virus
GNVINWTRDSI

SEQ ID NO: 525413 - protein, 11 aa, Influenza virus
GNVINWTRDSL

SEQ ID NO: 525414 - protein, 11 aa, Influenza virus
GNVINWTRDSM

SEQ ID NO: 525415 - protein, 11 aa, Influenza virus
GNVINWTRDSV

SEQ ID NO: 525416 - protein, 11 aa, Influenza virus
GNVLDGVTASC

SEQ ID NO: 525417 - protein, 11 aa, Influenza virus
GNVLLSPEEVS

SEQ ID NO: 525418 - protein, 11 aa, Influenza virus
GNVYKILSICS

SEQ ID NO: 525419 - protein, 11 aa, Influenza virus
GNVYKILSIYS

SEQ ID NO: 525420 - protein, 11 aa, Influenza virus
GNWPDGANIGF

SEQ ID NO: 525421 - protein, 11 aa, Influenza virus
GNWPDGSNIGF

SEQ ID NO: 525422 - protein, 11 aa, Influenza virus
GNYARLYIWGV

SEQ ID NO: 525423 - protein, 11 aa, Influenza virus
GNYDSIRGEFN

SEQ ID NO: 525424 - protein, 11 aa, Influenza virus
GNYDSIRGEFS

SEQ ID NO: 525425 - protein, 11 aa, Influenza virus
GNYGPINVTKE

SEQ ID NO: 525426 - protein, 11 aa, Influenza virus
GNYKEICIAWS

SEQ ID NO: 525427 - protein, 11 aa, Influenza virus
GNYKEICVAWS

SEQ ID NO: 525428 - protein, 11 aa, Influenza virus
GNYKEIRIAWS

SEQ ID NO: 525429 - protein, 11 aa, Influenza virus
GNYKEMCAAWS

SEQ ID NO: 525430 - protein, 11 aa, Influenza virus
GNYREICIAWS

SEQ ID NO: 525431 - protein, 11 aa, Influenza virus
GPAANNADHRI

SEQ ID NO: 525432 - protein, 11 aa, Influenza virus
GPAANSADHRI

SEQ ID NO: 525433 - protein, 11 aa, Influenza virus
GPAANSADHRV

SEQ ID NO: 525434 - protein, 11 aa, Influenza virus
GPAANSAHHRV

SEQ ID NO: 525435 - protein, 11 aa, Influenza virus
GPADNKADHRI

SEQ ID NO: 525436 - protein, 11 aa, Influenza virus
GPAECRTFFLT

SEQ ID NO: 525437 - protein, 11 aa, Influenza virus
GPANKQASYKI

SEQ ID NO: 525438 - protein, 11 aa, Influenza virus
GPANNQASYKI

SEQ ID NO: 525439 - protein, 11 aa, Influenza virus
GPANNQASYRI

SEQ ID NO: 525440 - protein, 11 aa, Influenza virus
GPANSQASYKI

SEQ ID NO: 525441 - protein, 11 aa, Influenza virus
GPASNQASYKI

SEQ ID NO: 525442 - protein, 11 aa, Influenza virus
GPATAQMALQL

SEQ ID NO: 525443 - protein, 11 aa, Influenza virus
GPDATAVAVIK

SEQ ID NO: 525444 - protein, 11 aa, Influenza virus
GPDATAVAVLK

SEQ ID NO: 525445 - protein, 11 aa, Influenza virus
GPDDGAVAVLK

SEQ ID NO: 525446 - protein, 11 aa, Influenza virus
GPDNEAVAVLK

SEQ ID NO: 525447 - protein, 11 aa, Influenza virus
GPDNGAVAVLK

SEQ ID NO: 525448 - protein, 11 aa, Influenza virus
GPDNGAVAVVK

SEQ ID NO: 525449 - protein, 11 aa, Influenza virus
GPDPGVKGFAF

SEQ ID NO: 525450 - protein, 11 aa, Influenza virus
GPDSGAVAVLK

SEQ ID NO: 525451 - protein, 11 aa, Influenza virus
GPDSTAVAVIK

SEQ ID NO: 525452 - protein, 11 aa, Influenza virus
GPDSVLVNTYQ

SEQ ID NO: 525453 - protein, 11 aa, Influenza virus
GPDTTAVAVLK

SEQ ID NO: 525454 - protein, 11 aa, Influenza virus
GPESVLINTYQ

SEQ ID NO: 525455 - protein, 11 aa, Influenza virus
GPESVLVNTYQ

SEQ ID NO: 525456 - protein, 11 aa, Influenza virus
GPGSFPDGAQI

SEQ ID NO: 525457 - protein, 11 aa, Influenza virus
GPGWLTIGITG

SEQ ID NO: 525458 - protein, 11 aa, Influenza virus
GPGWLTLGITG

SEQ ID NO: 525459 - protein, 11 aa, Influenza virus
GPILSFIMWAG

SEQ ID NO: 525460 - protein, 11 aa, Influenza virus
GPINNGKGRYG

SEQ ID NO: 525461 - protein, 11 aa, Influenza virus
GPINVTKENTG

SEQ ID NO: 525462 - protein, 11 aa, Influenza virus
GPLKAEIAQKL

SEQ ID NO: 525463 - protein, 11 aa, Influenza virus
GPLKAEIAQRL

SEQ ID NO: 525464 - protein, 11 aa, Influenza virus
GPLLQITSLCS

SEQ ID NO: 525465 - protein, 11 aa, Influenza virus
GPLSGSAQHIE

SEQ ID NO: 525466 - protein, 11 aa, Influenza virus
GPNDNASAVVW

SEQ ID NO: 525467 - protein, 11 aa, Influenza virus
GPNLYNIRNLH

SEQ ID NO: 525468 - protein, 11 aa, Influenza virus
GPNNNASAIIW

SEQ ID NO: 525469 - protein, 11 aa, Influenza virus
GPNNNASAIVW

SEQ ID NO: 525470 - protein, 11 aa, Influenza virus
GPNNNASAVIW

SEQ ID NO: 525471 - protein, 11 aa, Influenza virus
GPNNNASAVVW

SEQ ID NO: 525472 - protein, 11 aa, Influenza virus
GPPHCDQFLEF

SEQ ID NO: 525473 - protein, 11 aa, Influenza virus
GPPQCDKFLEF

SEQ ID NO: 525474 - protein, 11 aa, Influenza virus
GPPQCDLFLEF

SEQ ID NO: 525475 - protein, 11 aa, Influenza virus
GPPQCDLHLEF

SEQ ID NO: 525476 - protein, 11 aa, Influenza virus
GPPQCDQFLEF

SEQ ID NO: 525477 - protein, 11 aa, Influenza virus
GPPQCDRFLEF

SEQ ID NO: 525478 - protein, 11 aa, Influenza virus
GPPQCDSHLKF

SEQ ID NO: 525479 - protein, 11 aa, Influenza virus
GPRALVRGQQG

SEQ ID NO: 525480 - protein, 11 aa, Influenza virus
GPRPFVRGQQG

SEQ ID NO: 525481 - protein, 11 aa, Influenza virus
GPRPLIRGQQG

SEQ ID NO: 525482 - protein, 11 aa, Influenza virus
GPRPLVMGQQG

SEQ ID NO: 525483 - protein, 11 aa, Influenza virus
GPRPLVREQQG

SEQ ID NO: 525484 - protein, 11 aa, Influenza virus
GPRPLVRGQQG

SEQ ID NO: 525485 - protein, 11 aa, Influenza virus
GPSDAQAFYKI

SEQ ID NO: 525486 - protein, 11 aa, Influenza virus
GPSDGQAFYKI

SEQ ID NO: 525487 - protein, 11 aa, Influenza virus
GPSECRTFFLT

SEQ ID NO: 525488 - protein, 11 aa, Influenza virus
GPSFYAEMKWL

SEQ ID NO: 525489 - protein, 11 aa, Influenza virus
GPSHSIHTGNQ

SEQ ID NO: 525490 - protein, 11 aa, Influenza virus
GPSNAQAFYKI

SEQ ID NO: 525491 - protein, 11 aa, Influenza virus
GPTECRTFFLT

SEQ ID NO: 525492 - protein, 11 aa, Influenza virus
GPVHFQNQVKI

SEQ ID NO: 525493 - protein, 11 aa, Influenza virus
GPVHFRNQIKI

SEQ ID NO: 525494 - protein, 11 aa, Influenza virus
GPVHFRNQVKI

SEQ ID NO: 525495 - protein, 11 aa, Influenza virus
GPVHFRSQVKI

SEQ ID NO: 525496 - protein, 11 aa, Influenza virus
GPVKLSSGYKD

SEQ ID NO: 525497 - protein, 11 aa, Influenza virus
GQAADLKSTQA

SEQ ID NO: 525498 - protein, 11 aa, Influenza virus
GQAADLKSTQT

SEQ ID NO: 525499 - protein, 11 aa, Influenza virus
GQAADYESTQA

SEQ ID NO: 525500 - protein, 11 aa, Influenza virus
GQAADYKSTQA

SEQ ID NO: 525501 - protein, 11 aa, Influenza virus
GQAADYKSTQK

SEQ ID NO: 525502 - protein, 11 aa, Influenza virus
GQAADYKSTQT

SEQ ID NO: 525503 - protein, 11 aa, Influenza virus
GQAFYKILKIK

SEQ ID NO: 525504 - protein, 11 aa, Influenza virus
GQAFYRSINWL

SEQ ID NO: 525505 - protein, 11 aa, Influenza virus
GQAGRIDFHWM

SEQ ID NO: 525506 - protein, 11 aa, Influenza virus
GQAGRMTFYWA

SEQ ID NO: 525507 - protein, 11 aa, Influenza virus
GQAGRMTFYWI

SEQ ID NO: 525508 - protein, 11 aa, Influenza virus
GQAGRMTFYWK

SEQ ID NO: 525509 - protein, 11 aa, Influenza virus
GQAGRMTFYWT

SEQ ID NO: 525510 - protein, 11 aa, Influenza virus
GQDCDLINGAL

SEQ ID NO: 525511 - protein, 11 aa, Influenza virus
GQFGRIDFHWL

SEQ ID NO: 525512 - protein, 11 aa, Influenza virus
GQFGRINFHWL

SEQ ID NO: 525513 - protein, 11 aa, Influenza virus
GQFPVQTDEYK

SEQ ID NO: 525514 - protein, 11 aa, Influenza virus
GQGDIVLVMKR

SEQ ID NO: 525515 - protein, 11 aa, Influenza virus
GQGDVVLVMKR

SEQ ID NO: 525516 - protein, 11 aa, Influenza virus
GQGSGYAADQK

SEQ ID NO: 525517 - protein, 11 aa, Influenza virus
GQGTAADYKST

SEQ ID NO: 525518 - protein, 11 aa, Influenza virus
GQGTTLDNEHS

SEQ ID NO: 525519 - protein, 11 aa, Influenza virus
GQGTTLDNKHS

SEQ ID NO: 525520 - protein, 11 aa, Influenza virus
GQGTTLENKHS

SEQ ID NO: 525521 - protein, 11 aa, Influenza virus
GQGTTLNNKHS

SEQ ID NO: 525522 - protein, 11 aa, Influenza virus
GQGTTLYNKHS

SEQ ID NO: 525523 - protein, 11 aa, Influenza virus
GQHANGTIHDR

SEQ ID NO: 525524 - protein, 11 aa, Influenza virus
GQLKLATGLKN

SEQ ID NO: 525525 - protein, 11 aa, Influenza virus
GQLKLATGLRN

SEQ ID NO: 525526 - protein, 11 aa, Influenza virus
GQNHGICAVAT

SEQ ID NO: 525527 - protein, 11 aa, Influenza virus
GQPKEKAIWTS

SEQ ID NO: 525528 - protein, 11 aa, Influenza virus
GQPKEKTIWTS

SEQ ID NO: 525529 - protein, 11 aa, Influenza virus
GQPNERTIWTS

SEQ ID NO: 525530 - protein, 11 aa, Influenza virus
GQQGRMDYYWA

SEQ ID NO: 525531 - protein, 11 aa, Influenza virus
GQQGRMDYYWG

SEQ ID NO: 525532 - protein, 11 aa, Influenza virus
GQQGTMDYYWG

SEQ ID NO: 525533 - protein, 11 aa, Influenza virus
GQQGWMDYYWG

SEQ ID NO: 525534 - protein, 11 aa, Influenza virus
GQRSWMKIYWH

SEQ ID NO: 525535 - protein, 11 aa, Influenza virus
GQRSWMKLYWH

SEQ ID NO: 525536 - protein, 11 aa, Influenza virus
GQSFYRSINWL

SEQ ID NO: 525537 - protein, 11 aa, Influenza virus
GQSGRIDFHWA

SEQ ID NO: 525538 - protein, 11 aa, Influenza virus
GQSGRIDFHWL

SEQ ID NO: 525539 - protein, 11 aa, Influenza virus
GQSGRIDFHWM

SEQ ID NO: 525540 - protein, 11 aa, Influenza virus
GQSGRIDFHWT

SEQ ID NO: 525541 - protein, 11 aa, Influenza virus
GQSGRIDFYWL

SEQ ID NO: 525542 - protein, 11 aa, Influenza virus
GQSGRINFHWL

SEQ ID NO: 525543 - protein, 11 aa, Influenza virus
GQSGRINFHWT

SEQ ID NO: 525544 - protein, 11 aa, Influenza virus
GQSGRISFYWT

SEQ ID NO: 525545 - protein, 11 aa, Influenza virus
GQSGRVSFYWT

SEQ ID NO: 525546 - protein, 11 aa, Influenza virus
GQSPNVYQAKF

SEQ ID NO: 525547 - protein, 11 aa, Influenza virus
GQSPNVYQARF

SEQ ID NO: 525548 - protein, 11 aa, Influenza virus
GQSPNVYQSRF

SEQ ID NO: 525549 - protein, 11 aa, Influenza virus
GQTGRIDFHWL

SEQ ID NO: 525550 - protein, 11 aa, Influenza virus
GQTIVLDTDWS

SEQ ID NO: 525551 - protein, 11 aa, Influenza virus
GQTIVLNTDWS

SEQ ID NO: 525552 - protein, 11 aa, Influenza virus
GQTIVLTTDWS

SEQ ID NO: 525553 - protein, 11 aa, Influenza virus
GQTVKIKTNGN

SEQ ID NO: 525554 - protein, 11 aa, Influenza virus
GQTVKIQTNGN

SEQ ID NO: 525555 - protein, 11 aa, Influenza virus
GQTVKIQTSGN

SEQ ID NO: 525556 - protein, 11 aa, Influenza virus
GQTVVLNTDWS

SEQ ID NO: 525557 - protein, 11 aa, Influenza virus
GQVECVCRDNW

SEQ ID NO: 525558 - protein, 11 aa, Influenza virus
GQWDWPDGAKI

SEQ ID NO: 525559 - protein, 11 aa, Influenza virus
GQWNWPDGAEI

SEQ ID NO: 525560 - protein, 11 aa, Influenza virus
GQWNWPDGAKI

SEQ ID NO: 525561 - protein, 11 aa, Influenza virus
GRAWLHVCVTG

SEQ ID NO: 525562 - protein, 11 aa, Influenza virus
GRCPRYVKQSS

SEQ ID NO: 525563 - protein, 11 aa, Influenza virus
GRDVLVIWGIH

SEQ ID NO: 525564 - protein, 11 aa, Influenza virus
GRDVLVLWGIH

SEQ ID NO: 525565 - protein, 11 aa, Influenza virus
GRDVLVMWGIH

SEQ ID NO: 525566 - protein, 11 aa, Influenza virus
GRDVLVMWGLH

SEQ ID NO: 525567 - protein, 11 aa, Influenza virus
GREWSYIVERP

SEQ ID NO: 525568 - protein, 11 aa, Influenza virus
GREWSYIVERT

SEQ ID NO: 525569 - protein, 11 aa, Influenza virus
GRFTNEEALRQ

SEQ ID NO: 525570 - protein, 11 aa, Influenza virus
GRFYIQMCTEL

SEQ ID NO: 525571 - protein, 11 aa, Influenza virus
GRFYVQMCTEL

SEQ ID NO: 525572 - protein, 11 aa, Influenza virus
GRGCFEIYHKC

SEQ ID NO: 525573 - protein, 11 aa, Influenza virus
GRGIEVVNATE

SEQ ID NO: 525574 - protein, 11 aa, Influenza virus
GRGLFGAIAGF

SEQ ID NO: 525575 - protein, 11 aa, Influenza virus
GRGLFGAKAGF

SEQ ID NO: 525576 - protein, 11 aa, Influenza virus
GRGQAADLKST

SEQ ID NO: 525577 - protein, 11 aa, Influenza virus
GRGRIFQSRIR

SEQ ID NO: 525578 - protein, 11 aa, Influenza virus
GRGSTLGLDIR

SEQ ID NO: 525579 - protein, 11 aa, Influenza virus
GRGVFEFSDER

SEQ ID NO: 525580 - protein, 11 aa, Influenza virus
GRGVFELSDEK

SEQ ID NO: 525581 - protein, 11 aa, Influenza virus
GRGVFELSDER

SEQ ID NO: 525582 - protein, 11 aa, Influenza virus
GRHANGTIHDR

SEQ ID NO: 525583 - protein, 11 aa, Influenza virus
GRHANGTINDR

SEQ ID NO: 525584 - protein, 11 aa, Influenza virus
GRHANGTMHDR

SEQ ID NO: 525585 - protein, 11 aa, Influenza virus
GRHSNGTIHDR

SEQ ID NO: 525586 - protein, 11 aa, Influenza virus
GRIDFHWLILN

SEQ ID NO: 525587 - protein, 11 aa, Influenza virus
GRIDFHWLILS

SEQ ID NO: 525588 - protein, 11 aa, Influenza virus
GRIDFHWLLLD

SEQ ID NO: 525589 - protein, 11 aa, Influenza virus
GRIDFHWLMLN

SEQ ID NO: 525590 - protein, 11 aa, Influenza virus
GRIDFHWLVLN

SEQ ID NO: 525591 - protein, 11 aa, Influenza virus
GRIDFHWMLLD

SEQ ID NO: 525592 - protein, 11 aa, Influenza virus
GRIFQSGIRMA

SEQ ID NO: 525593 - protein, 11 aa, Influenza virus
GRIFQSGVRLA

SEQ ID NO: 525594 - protein, 11 aa, Influenza virus
GRIFQSGVRMA

SEQ ID NO: 525595 - protein, 11 aa, Influenza virus
GRIFQSGVRVA

SEQ ID NO: 525596 - protein, 11 aa, Influenza virus
GRIFQSRIRMG

SEQ ID NO: 525597 - protein, 11 aa, Influenza virus
GRIIQNEDIPI

SEQ ID NO: 525598 - protein, 11 aa, Influenza virus
GRIQDLEKYIE

SEQ ID NO: 525599 - protein, 11 aa, Influenza virus
GRIQDLEKYVE

SEQ ID NO: 525600 - protein, 11 aa, Influenza virus
GRIQDLERYVE

SEQ ID NO: 525601 - protein, 11 aa, Influenza virus
GRISFYWTIVD

SEQ ID NO: 525602 - protein, 11 aa, Influenza virus
GRISFYWTIVE

SEQ ID NO: 525603 - protein, 11 aa, Influenza virus
GRISIYWTLVN

SEQ ID NO: 525604 - protein, 11 aa, Influenza virus
GRISVYWTIVE

SEQ ID NO: 525605 - protein, 11 aa, Influenza virus
GRLCNPLNPFV

SEQ ID NO: 525606 - protein, 11 aa, Influenza virus
GRLCNPMNPFV

SEQ ID NO: 525607 - protein, 11 aa, Influenza virus
GRLIDFLKDVI

SEQ ID NO: 525608 - protein, 11 aa, Influenza virus
GRLIDFLKDVM

SEQ ID NO: 525609 - protein, 11 aa, Influenza virus
GRLIDFLKDVT

SEQ ID NO: 525610 - protein, 11 aa, Influenza virus
GRLIDFLKDVV

SEQ ID NO: 525611 - protein, 11 aa, Influenza virus
GRLIQNSITIE

SEQ ID NO: 525612 - protein, 11 aa, Influenza virus
GRLIQNSITVE

SEQ ID NO: 525613 - protein, 11 aa, Influenza virus
GRLIQNSLTIE

SEQ ID NO: 525614 - protein, 11 aa, Influenza virus
GRLIQNSMTIE

SEQ ID NO: 525615 - protein, 11 aa, Influenza virus
GRLMDFLKDVM

SEQ ID NO: 525616 - protein, 11 aa, Influenza virus
GRLTTTIKTWA

SEQ ID NO: 525617 - protein, 11 aa, Influenza virus
GRLVQNSITIE

SEQ ID NO: 525618 - protein, 11 aa, Influenza virus
GRLVRFRHQNS

SEQ ID NO: 525619 - protein, 11 aa, Influenza virus
GRMADSIKSWR

SEQ ID NO: 525620 - protein, 11 aa, Influenza virus
GRMDYYWAILK

SEQ ID NO: 525621 - protein, 11 aa, Influenza virus
GRMDYYWAVLK

SEQ ID NO: 525622 - protein, 11 aa, Influenza virus
GRMDYYWGILK

SEQ ID NO: 525623 - protein, 11 aa, Influenza virus
GRMSDSIKSWR

SEQ ID NO: 525624 - protein, 11 aa, Influenza virus
GRMTDSIKSWR

SEQ ID NO: 525625 - protein, 11 aa, Influenza virus
GRMTICIQGNN

SEQ ID NO: 525626 - protein, 11 aa, Influenza virus
GRMTICVQGKN

SEQ ID NO: 525627 - protein, 11 aa, Influenza virus
GRMTICVQGNN

SEQ ID NO: 525628 - protein, 11 aa, Influenza virus
GRNCTIPCFWV

SEQ ID NO: 525629 - protein, 11 aa, Influenza virus
GRNCTVPCFWV

SEQ ID NO: 525630 - protein, 11 aa, Influenza virus
GRNPGNAEIED

SEQ ID NO: 525631 - protein, 11 aa, Influenza virus
GRNSFFSRLNW

SEQ ID NO: 525632 - protein, 11 aa, Influenza virus
GRPEEAKYVEW

SEQ ID NO: 525633 - protein, 11 aa, Influenza virus
GRPEEAKYVWW

SEQ ID NO: 525634 - protein, 11 aa, Influenza virus
GRPEEVKYVWW

SEQ ID NO: 525635 - protein, 11 aa, Influenza virus
GRPKEDEVWWT

SEQ ID NO: 525636 - protein, 11 aa, Influenza virus
GRPKEDKVWWT

SEQ ID NO: 525637 - protein, 11 aa, Influenza virus
GRPKEDRVWWT

SEQ ID NO: 525638 - protein, 11 aa, Influenza virus
GRPKEEKVWWT

SEQ ID NO: 525639 - protein, 11 aa, Influenza virus
GRQEKNPALRM

SEQ ID NO: 525640 - protein, 11 aa, Influenza virus
GRQEKNPSLRM

SEQ ID NO: 525641 - protein, 11 aa, Influenza virus
GRQTFDWTLNR

SEQ ID NO: 525642 - protein, 11 aa, Influenza virus
GRQTYDWTLNR

SEQ ID NO: 525643 - protein, 11 aa, Influenza virus
GRRKTNLYGFI

SEQ ID NO: 525644 - protein, 11 aa, Influenza virus
GRRRTNLYGFI

SEQ ID NO: 525645 - protein, 11 aa, Influenza virus
GRSHLRNDTDV

SEQ ID NO: 525646 - protein, 11 aa, Influenza virus
GRTFSPRSRSG

SEQ ID NO: 525647 - protein, 11 aa, Influenza virus
GRTINTASRSG

SEQ ID NO: 525648 - protein, 11 aa, Influenza virus
GRTIQNEDIPI

SEQ ID NO: 525649 - protein, 11 aa, Influenza virus
GRTISIASRSG

SEQ ID NO: 525650 - protein, 11 aa, Influenza virus
GRTISKDLRSG

SEQ ID NO: 525651 - protein, 11 aa, Influenza virus
GRTISKDSRSG

SEQ ID NO: 525652 - protein, 11 aa, Influenza virus
GRTISKDTRSG

SEQ ID NO: 525653 - protein, 11 aa, Influenza virus
GRTISMDSRSG

SEQ ID NO: 525654 - protein, 11 aa, Influenza virus
GRTISPKLRSG

SEQ ID NO: 525655 - protein, 11 aa, Influenza virus
GRTISPRLRSG

SEQ ID NO: 525656 - protein, 11 aa, Influenza virus
GRTISPRSRNG

SEQ ID NO: 525657 - protein, 11 aa, Influenza virus
GRTISPRSRSG

SEQ ID NO: 525658 - protein, 11 aa, Influenza virus
GRTISRDSRSG

SEQ ID NO: 525659 - protein, 11 aa, Influenza virus
GRTISTASRAG

SEQ ID NO: 525660 - protein, 11 aa, Influenza virus
GRTISTASRSG

SEQ ID NO: 525661 - protein, 11 aa, Influenza virus
GRTKSLESRRG

SEQ ID NO: 525662 - protein, 11 aa, Influenza virus
GRTKSLESRSG

SEQ ID NO: 525663 - protein, 11 aa, Influenza virus
GRTLDLHDANV

SEQ ID NO: 525664 - protein, 11 aa, Influenza virus
GRTLDMHDANV

SEQ ID NO: 525665 - protein, 11 aa, Influenza virus
GRTLGLHDANV

SEQ ID NO: 525666 - protein, 11 aa, Influenza virus
GRTLNTASRSG

SEQ ID NO: 525667 - protein, 11 aa, Influenza virus
GRTSDMRAEII

SEQ ID NO: 525668 - protein, 11 aa, Influenza virus
GRTSDMRTEII

SEQ ID NO: 525669 - protein, 11 aa, Influenza virus
GRTSDMRTEVI

SEQ ID NO: 525670 - protein, 11 aa, Influenza virus
GRTSISCLYKL

SEQ ID NO: 525671 - protein, 11 aa, Influenza virus
GRTTSKDSRSG

SEQ ID NO: 525672 - protein, 11 aa, Influenza virus
GRVSFYWTIVE

SEQ ID NO: 525673 - protein, 11 aa, Influenza virus
GRVTVSTRSDQ

SEQ ID NO: 525674 - protein, 11 aa, Influenza virus
GRWPGLVAGWY

SEQ ID NO: 525675 - protein, 11 aa, Influenza virus
GRYGVKGFSFR

SEQ ID NO: 525676 - protein, 11 aa, Influenza virus
GRYSIADKICI

SEQ ID NO: 525677 - protein, 11 aa, Influenza virus
GRYSKADKICI

SEQ ID NO: 525678 - protein, 11 aa, Influenza virus
GRYSRADKICI

SEQ ID NO: 525679 - protein, 11 aa, Influenza virus
GSAEHIEECSC

SEQ ID NO: 525680 - protein, 11 aa, Influenza virus
GSAKHIEECSC

SEQ ID NO: 525681 - protein, 11 aa, Influenza virus
GSAKHVEECSC

SEQ ID NO: 525682 - protein, 11 aa, Influenza virus
GSAQHIEECSC

SEQ ID NO: 525683 - protein, 11 aa, Influenza virus
GSAQHVEECSC

SEQ ID NO: 525684 - protein, 11 aa, Influenza virus
GSARHIEECPC

SEQ ID NO: 525685 - protein, 11 aa, Influenza virus
GSARHIEECSC

SEQ ID NO: 525686 - protein, 11 aa, Influenza virus
GSARHIEEWSC

SEQ ID NO: 525687 - protein, 11 aa, Influenza virus
GSARHVEECSC

SEQ ID NO: 525688 - protein, 11 aa, Influenza virus
GSASGKADTRI

SEQ ID NO: 525689 - protein, 11 aa, Influenza virus
GSASGRADTKI

SEQ ID NO: 525690 - protein, 11 aa, Influenza virus
GSASGRADTRI

SEQ ID NO: 525691 - protein, 11 aa, Influenza virus
GSATGPADTRI

SEQ ID NO: 525692 - protein, 11 aa, Influenza virus
GSATGPADTRV

SEQ ID NO: 525693 - protein, 11 aa, Influenza virus
GSATGPAETRI

SEQ ID NO: 525694 - protein, 11 aa, Influenza virus
GSATGPAETRV

SEQ ID NO: 525695 - protein, 11 aa, Influenza virus
GSCAVVMTDGS

SEQ ID NO: 525696 - protein, 11 aa, Influenza virus
GSCFTIMTDGP

SEQ ID NO: 525697 - protein, 11 aa, Influenza virus
GSCFTLMTDGP

SEQ ID NO: 525698 - protein, 11 aa, Influenza virus
GSCFTVLTDGP

SEQ ID NO: 525699 - protein, 11 aa, Influenza virus
GSCFTVMTDGP

SEQ ID NO: 525700 - protein, 11 aa, Influenza virus
GSCGILGTIIG

SEQ ID NO: 525701 - protein, 11 aa, Influenza virus
GSCTSPCLTDK

SEQ ID NO: 525702 - protein, 11 aa, Influenza virus
GSCTVVMTDGN

SEQ ID NO: 525703 - protein, 11 aa, Influenza virus
GSCTVVMTDGS

SEQ ID NO: 525704 - protein, 11 aa, Influenza virus
GSDVWLGRTVS

SEQ ID NO: 525705 - protein, 11 aa, Influenza virus
GSEHTAYSQIT

SEQ ID NO: 525706 - protein, 11 aa, Influenza virus
GSFIQHPELTG

SEQ ID NO: 525707 - protein, 11 aa, Influenza virus
GSFNGAFIAPD

SEQ ID NO: 525708 - protein, 11 aa, Influenza virus
GSFPDGAKIQY

SEQ ID NO: 525709 - protein, 11 aa, Influenza virus
GSFPDGAQIKY

SEQ ID NO: 525710 - protein, 11 aa, Influenza virus
GSFPDGAQIQY

SEQ ID NO: 525711 - protein, 11 aa, Influenza virus
GSFPDGARIQY

SEQ ID NO: 525712 - protein, 11 aa, Influenza virus
GSFPNGAQIQY

SEQ ID NO: 525713 - protein, 11 aa, Influenza virus
GSFSIRGETTG

SEQ ID NO: 525714 - protein, 11 aa, Influenza virus
GSFSIRWETTG

SEQ ID NO: 525715 - protein, 11 aa, Influenza virus
GSFVQHPELTG

SEQ ID NO: 525716 - protein, 11 aa, Influenza virus
GSFVQHPEMTG

SEQ ID NO: 525717 - protein, 11 aa, Influenza virus
GSFYRNMRWLT

SEQ ID NO: 525718 - protein, 11 aa, Influenza virus
GSFYRSIRWLT

SEQ ID NO: 525719 - protein, 11 aa, Influenza virus
GSFYRSMRWLT

SEQ ID NO: 525720 - protein, 11 aa, Influenza virus
GSGFFPDGPQI

SEQ ID NO: 525721 - protein, 11 aa, Influenza virus
GSGHWPDGSNI

SEQ ID NO: 525722 - protein, 11 aa, Influenza virus
GSGNWPDGANI

SEQ ID NO: 525723 - protein, 11 aa, Influenza virus
GSGNWPDGSNI

SEQ ID NO: 525724 - protein, 11 aa, Influenza virus
GSGRIFQSGVR

SEQ ID NO: 525725 - protein, 11 aa, Influenza virus
GSGSFPDGAKI

SEQ ID NO: 525726 - protein, 11 aa, Influenza virus
GSGSFPDGAQI

SEQ ID NO: 525727 - protein, 11 aa, Influenza virus
GSGSFPDGARI

SEQ ID NO: 525728 - protein, 11 aa, Influenza virus
GSGSFPNGAQI

SEQ ID NO: 525729 - protein, 11 aa, Influenza virus
GSGTDNYGVKG

SEQ ID NO: 525730 - protein, 11 aa, Influenza virus
GSGTNNYGVKG

SEQ ID NO: 525731 - protein, 11 aa, Influenza virus
GSGWLTLGITG

SEQ ID NO: 525732 - protein, 11 aa, Influenza virus
GSGYAADKAST

SEQ ID NO: 525733 - protein, 11 aa, Influenza virus
GSGYAADKESS

SEQ ID NO: 525734 - protein, 11 aa, Influenza virus
GSGYAADKEST

SEQ ID NO: 525735 - protein, 11 aa, Influenza virus
GSGYAADKKST

SEQ ID NO: 525736 - protein, 11 aa, Influenza virus
GSGYAADLKST

SEQ ID NO: 525737 - protein, 11 aa, Influenza virus
GSGYAADQEST

SEQ ID NO: 525738 - protein, 11 aa, Influenza virus
GSGYAADQKST

SEQ ID NO: 525739 - protein, 11 aa, Influenza virus
GSGYAADREST

SEQ ID NO: 525740 - protein, 11 aa, Influenza virus
GSGYAADRKST

SEQ ID NO: 525741 - protein, 11 aa, Influenza virus
GSHGVKGWAFD

SEQ ID NO: 525742 - protein, 11 aa, Influenza virus
GSIAHKSCLPA

SEQ ID NO: 525743 - protein, 11 aa, Influenza virus
GSIENLEELRF

SEQ ID NO: 525744 - protein, 11 aa, Influenza virus
GSIENQEELKS

SEQ ID NO: 525745 - protein, 11 aa, Influenza virus
GSIENQEELRF

SEQ ID NO: 525746 - protein, 11 aa, Influenza virus
GSIENQEELRS

SEQ ID NO: 525747 - protein, 11 aa, Influenza virus
GSIGKVCRALL

SEQ ID NO: 525748 - protein, 11 aa, Influenza virus
GSIGKVCRTLL

SEQ ID NO: 525749 - protein, 11 aa, Influenza virus
GSIITELPFQN

SEQ ID NO: 525750 - protein, 11 aa, Influenza virus
GSIKNQEELRS

SEQ ID NO: 525751 - protein, 11 aa, Influenza virus
GSIKTKLPFQN

SEQ ID NO: 525752 - protein, 11 aa, Influenza virus
GSINTKLPFQN

SEQ ID NO: 525753 - protein, 11 aa, Influenza virus
GSINTRLPFQN

SEQ ID NO: 525754 - protein, 11 aa, Influenza virus
GSIPNDKPFQN

SEQ ID NO: 525755 - protein, 11 aa, Influenza virus
GSIPNEKPFQN

SEQ ID NO: 525756 - protein, 11 aa, Influenza virus
GSIPNGKPFQN

SEQ ID NO: 525757 - protein, 11 aa, Influenza virus
GSIPNNKPFQN

SEQ ID NO: 525758 - protein, 11 aa, Influenza virus
GSIQSDKPFQN

SEQ ID NO: 525759 - protein, 11 aa, Influenza virus
GSISNDKPFQN

SEQ ID NO: 525760 - protein, 11 aa, Influenza virus
GSKEQLGSWSW

SEQ ID NO: 525761 - protein, 11 aa, Influenza virus
GSKERLGSWSW

SEQ ID NO: 525762 - protein, 11 aa, Influenza virus
GSKGDIFVIRE

SEQ ID NO: 525763 - protein, 11 aa, Influenza virus
GSKGDIFVMRE

SEQ ID NO: 525764 - protein, 11 aa, Influenza virus
GSKGDVFVIRE

SEQ ID NO: 525765 - protein, 11 aa, Influenza virus
GSKGDVFVMRE

SEQ ID NO: 525766 - protein, 11 aa, Influenza virus
GSKGHVFVIRE

SEQ ID NO: 525767 - protein, 11 aa, Influenza virus
GSKKRLGSWSW

SEQ ID NO: 525768 - protein, 11 aa, Influenza virus
GSLEFIAEQFT

SEQ ID NO: 525769 - protein, 11 aa, Influenza virus
GSLKLAIGLRN

SEQ ID NO: 525770 - protein, 11 aa, Influenza virus
GSLKLAIGPRN

SEQ ID NO: 525771 - protein, 11 aa, Influenza virus
GSLKLATGMRN

SEQ ID NO: 525772 - protein, 11 aa, Influenza virus
GSLLLATGMRN

SEQ ID NO: 525773 - protein, 11 aa, Influenza virus
GSLLNDKHFNG

SEQ ID NO: 525774 - protein, 11 aa, Influenza virus
GSLLNDKHSNG

SEQ ID NO: 525775 - protein, 11 aa, Influenza virus
GSLLNDRHSNG

SEQ ID NO: 525776 - protein, 11 aa, Influenza virus
GSLMLATGMRN

SEQ ID NO: 525777 - protein, 11 aa, Influenza virus
GSLNFVSMEFS

SEQ ID NO: 525778 - protein, 11 aa, Influenza virus
GSLPDGAQIQY

SEQ ID NO: 525779 - protein, 11 aa, Influenza virus
GSLPNDKHSNG

SEQ ID NO: 525780 - protein, 11 aa, Influenza virus
GSLRLATGMRN

SEQ ID NO: 525781 - protein, 11 aa, Influenza virus
GSLSLAIMIAG

SEQ ID NO: 525782 - protein, 11 aa, Influenza virus
GSLSLAIMMAG

SEQ ID NO: 525783 - protein, 11 aa, Influenza virus
GSLSLAIMVAG

SEQ ID NO: 525784 - protein, 11 aa, Influenza virus
GSMQCRICIGS

SEQ ID NO: 525785 - protein, 11 aa, Influenza virus
GSNEQAAEAME

SEQ ID NO: 525786 - protein, 11 aa, Influenza virus
GSNNNGVKGFS

SEQ ID NO: 525787 - protein, 11 aa, Influenza virus
GSNRPIIDINM

SEQ ID NO: 525788 - protein, 11 aa, Influenza virus
GSNRPVIDINM

SEQ ID NO: 525789 - protein, 11 aa, Influenza virus
GSNRPVIDVNM

SEQ ID NO: 525790 - protein, 11 aa, Influenza virus
GSNRPVIQIDP

SEQ ID NO: 525791 - protein, 11 aa, Influenza virus
GSNRPVIQINP

SEQ ID NO: 525792 - protein, 11 aa, Influenza virus
GSNRPVIRIDP

SEQ ID NO: 525793 - protein, 11 aa, Influenza virus
GSNRPVVDINM

SEQ ID NO: 525794 - protein, 11 aa, Influenza virus
GSNRPWIRFNS

SEQ ID NO: 525795 - protein, 11 aa, Influenza virus
GSNRPWIRINN

SEQ ID NO: 525796 - protein, 11 aa, Influenza virus
GSNRPWMRINN

SEQ ID NO: 525797 - protein, 11 aa, Influenza virus
GSNRPWMRISN

SEQ ID NO: 525798 - protein, 11 aa, Influenza virus
GSNRPWVRINN

SEQ ID NO: 525799 - protein, 11 aa, Influenza virus
GSNRPWVRMNN

SEQ ID NO: 525800 - protein, 11 aa, Influenza virus
GSPDPGVKGFA

SEQ ID NO: 525801 - protein, 11 aa, Influenza virus
GSPFPVGSGSF

SEQ ID NO: 525802 - protein, 11 aa, Influenza virus
GSPGAPGVKGF

SEQ ID NO: 525803 - protein, 11 aa, Influenza virus
GSPGCDRLQDT

SEQ ID NO: 525804 - protein, 11 aa, Influenza virus
GSPGVKGWAFD

SEQ ID NO: 525805 - protein, 11 aa, Influenza virus
GSPISVGSGSF

SEQ ID NO: 525806 - protein, 11 aa, Influenza virus
GSPLELRDCKI

SEQ ID NO: 525807 - protein, 11 aa, Influenza virus
GSPLVLDDCSL

SEQ ID NO: 525808 - protein, 11 aa, Influenza virus
GSPPIVSNSDF

SEQ ID NO: 525809 - protein, 11 aa, Influenza virus
GSPPIVSNSEF

SEQ ID NO: 525810 - protein, 11 aa, Influenza virus
GSPPMVSNSDF

SEQ ID NO: 525811 - protein, 11 aa, Influenza virus
GSPPVVSNSDF

SEQ ID NO: 525812 - protein, 11 aa, Influenza virus
GSPSAPGVKGF

SEQ ID NO: 525813 - protein, 11 aa, Influenza virus
GSPVPVGSGSF

SEQ ID NO: 525814 - protein, 11 aa, Influenza virus
GSPVSVGSGSF

SEQ ID NO: 525815 - protein, 11 aa, Influenza virus
GSQGVKGWAFD

SEQ ID NO: 525816 - protein, 11 aa, Influenza virus
GSQKQEFKMNP

SEQ ID NO: 525817 - protein, 11 aa, Influenza virus
GSRERLGSWSW

SEQ ID NO: 525818 - protein, 11 aa, Influenza virus
GSRGEVFVIRE

SEQ ID NO: 525819 - protein, 11 aa, Influenza virus
GSRGHIFVIRE

SEQ ID NO: 525820 - protein, 11 aa, Influenza virus
GSRGHVFVIRE

SEQ ID NO: 525821 - protein, 11 aa, Influenza virus
GSRPRVRNQSG

SEQ ID NO: 525822 - protein, 11 aa, Influenza virus
GSSEQAAEAIE

SEQ ID NO: 525823 - protein, 11 aa, Influenza virus
GSSEQAAEAMD

SEQ ID NO: 525824 - protein, 11 aa, Influenza virus
GSSEQAAEAME

SEQ ID NO: 525825 - protein, 11 aa, Influenza virus
GSSFYAEMKWL

SEQ ID NO: 525826 - protein, 11 aa, Influenza virus
GSSIAFCGVDS

SEQ ID NO: 525827 - protein, 11 aa, Influenza virus
GSSIAFCGVNS

SEQ ID NO: 525828 - protein, 11 aa, Influenza virus
GSSIYQNSFVP

SEQ ID NO: 525829 - protein, 11 aa, Influenza virus
GSSKYQQSFSP

SEQ ID NO: 525830 - protein, 11 aa, Influenza virus
GSSKYRQSFSP

SEQ ID NO: 525831 - protein, 11 aa, Influenza virus
GSSPNAYQAKF

SEQ ID NO: 525832 - protein, 11 aa, Influenza virus
GSSPNAYQARF

SEQ ID NO: 525833 - protein, 11 aa, Influenza virus
GSSSACLRGGR

SEQ ID NO: 525834 - protein, 11 aa, Influenza virus
GSSSFYAEMKW

SEQ ID NO: 525835 - protein, 11 aa, Influenza virus
GSSSNAYQAKF

SEQ ID NO: 525836 - protein, 11 aa, Influenza virus
GSSTYQNNFVP

SEQ ID NO: 525837 - protein, 11 aa, Influenza virus
GSSTYQNSFVP

SEQ ID NO: 525838 - protein, 11 aa, Influenza virus
GSSTYQSNFVP

SEQ ID NO: 525839 - protein, 11 aa, Influenza virus
GSSYVCSGLVG

SEQ ID NO: 525840 - protein, 11 aa, Influenza virus
GSTLGLDIRTA

SEQ ID NO: 525841 - protein, 11 aa, Influenza virus
GSTLPRRSGAA

SEQ ID NO: 525842 - protein, 11 aa, Influenza virus
GSTQKAIDNMQ

SEQ ID NO: 525843 - protein, 11 aa, Influenza virus
GSTVNEEALRQ

SEQ ID NO: 525844 - protein, 11 aa, Influenza virus
GSVAHKSCLPA

SEQ ID NO: 525845 - protein, 11 aa, Influenza virus
GSVENLEELRF

SEQ ID NO: 525846 - protein, 11 aa, Influenza virus
GSVENQEELRS

SEQ ID NO: 525847 - protein, 11 aa, Influenza virus
GSVNTVLSIIA

SEQ ID NO: 525848 - protein, 11 aa, Influenza virus
GSVYIEVLHLT

SEQ ID NO: 525849 - protein, 11 aa, Influenza virus
GSWPDGADINF

SEQ ID NO: 525850 - protein, 11 aa, Influenza virus
GSWPDGANIDF

SEQ ID NO: 525851 - protein, 11 aa, Influenza virus
GSWPDGANINF

SEQ ID NO: 525852 - protein, 11 aa, Influenza virus
GSWPDGANINL

SEQ ID NO: 525853 - protein, 11 aa, Influenza virus
GSWPDGANISF

SEQ ID NO: 525854 - protein, 11 aa, Influenza virus
GSWPDGANTNF

SEQ ID NO: 525855 - protein, 11 aa, Influenza virus
GSWSHNILRTQ

SEQ ID NO: 525856 - protein, 11 aa, Influenza virus
GSWSQNILRTH

SEQ ID NO: 525857 - protein, 11 aa, Influenza virus
GSWSQNILRTQ

SEQ ID NO: 525858 - protein, 11 aa, Influenza virus
GSWSWHDGAEI

SEQ ID NO: 525859 - protein, 11 aa, Influenza virus
GSYFFGDNAED

SEQ ID NO: 525860 - protein, 11 aa, Influenza virus
GSYFFGDNAEE

SEQ ID NO: 525861 - protein, 11 aa, Influenza virus
GSYFFGDNAKE

SEQ ID NO: 525862 - protein, 11 aa, Influenza virus
GSYFFGDSAEE

SEQ ID NO: 525863 - protein, 11 aa, Influenza virus
GSYNNTNGEQI

SEQ ID NO: 525864 - protein, 11 aa, Influenza virus
GSYNNTSGEQM

SEQ ID NO: 525865 - protein, 11 aa, Influenza virus
GSYNNTSGKQM

SEQ ID NO: 525866 - protein, 11 aa, Influenza virus
GSYVRLYLWGV

SEQ ID NO: 525867 - protein, 11 aa, Influenza virus
GTAADLKSTQA

SEQ ID NO: 525868 - protein, 11 aa, Influenza virus
GTAADLKSTQT

SEQ ID NO: 525869 - protein, 11 aa, Influenza virus
GTAADYKSTPS

SEQ ID NO: 525870 - protein, 11 aa, Influenza virus
GTAADYKSTQA

SEQ ID NO: 525871 - protein, 11 aa, Influenza virus
GTAADYKSTQS

SEQ ID NO: 525872 - protein, 11 aa, Influenza virus
GTAALSPGMMM

SEQ ID NO: 525873 - protein, 11 aa, Influenza virus
GTACFEIFHKC

SEQ ID NO: 525874 - protein, 11 aa, Influenza virus
GTAKHIEECSC

SEQ ID NO: 525875 - protein, 11 aa, Influenza virus
GTAPILGNYKE

SEQ ID NO: 525876 - protein, 11 aa, Influenza virus
GTAPVLGNYKE

SEQ ID NO: 525877 - protein, 11 aa, Influenza virus
GTAPVLGNYRE

SEQ ID NO: 525878 - protein, 11 aa, Influenza virus
GTASLSPGMMM

SEQ ID NO: 525879 - protein, 11 aa, Influenza virus
GTATHIEECSC

SEQ ID NO: 525880 - protein, 11 aa, Influenza virus
GTCAVVMTDGS

SEQ ID NO: 525881 - protein, 11 aa, Influenza virus
GTCIVAVTDGP

SEQ ID NO: 525882 - protein, 11 aa, Influenza virus
GTCTVIMTDGS

SEQ ID NO: 525883 - protein, 11 aa, Influenza virus
GTCTVVMTDGN

SEQ ID NO: 525884 - protein, 11 aa, Influenza virus
GTCTVVMTDGS

SEQ ID NO: 525885 - protein, 11 aa, Influenza virus
GTCVVAVTDGP

SEQ ID NO: 525886 - protein, 11 aa, Influenza virus
GTCVVIMTDGP

SEQ ID NO: 525887 - protein, 11 aa, Influenza virus
GTCVVIMTDGS

SEQ ID NO: 525888 - protein, 11 aa, Influenza virus
GTCVVTVTDGP

SEQ ID NO: 525889 - protein, 11 aa, Influenza virus
GTCVVVMTDGS

SEQ ID NO: 525890 - protein, 11 aa, Influenza virus
GTCWEQLYTPG

SEQ ID NO: 525891 - protein, 11 aa, Influenza virus
GTCWEQMYTPG

SEQ ID NO: 525892 - protein, 11 aa, Influenza virus
GTDDDAYAVIH

SEQ ID NO: 525893 - protein, 11 aa, Influenza virus
GTDNYGVKGFG

SEQ ID NO: 525894 - protein, 11 aa, Influenza virus
GTFEFTSFFYR

SEQ ID NO: 525895 - protein, 11 aa, Influenza virus
GTFGPVHFQNQ

SEQ ID NO: 525896 - protein, 11 aa, Influenza virus
GTFGPVHFRNQ

SEQ ID NO: 525897 - protein, 11 aa, Influenza virus
GTFGPVHFRSQ

SEQ ID NO: 525898 - protein, 11 aa, Influenza virus
GTGCFEIFHKC

SEQ ID NO: 525899 - protein, 11 aa, Influenza virus
GTGCFEIFHRC

SEQ ID NO: 525900 - protein, 11 aa, Influenza virus
GTGCFEILHKC

SEQ ID NO: 525901 - protein, 11 aa, Influenza virus
GTGIAADKAST

SEQ ID NO: 525902 - protein, 11 aa, Influenza virus
GTGIAADKEST

SEQ ID NO: 525903 - protein, 11 aa, Influenza virus
GTGIAADKTST

SEQ ID NO: 525904 - protein, 11 aa, Influenza virus
GTGIAADKVST

SEQ ID NO: 525905 - protein, 11 aa, Influenza virus
GTGIAADRDST

SEQ ID NO: 525906 - protein, 11 aa, Influenza virus
GTGIAADREST

SEQ ID NO: 525907 - protein, 11 aa, Influenza virus
GTGIAADRGST

SEQ ID NO: 525908 - protein, 11 aa, Influenza virus
GTGIAAEKEST

SEQ ID NO: 525909 - protein, 11 aa, Influenza virus
GTGIVADRDST

SEQ ID NO: 525910 - protein, 11 aa, Influenza virus
GTGMAADQKST

SEQ ID NO: 525911 - protein, 11 aa, Influenza virus
GTGMAADRDST

SEQ ID NO: 525912 - protein, 11 aa, Influenza virus
GTGNKLITVGS

SEQ ID NO: 525913 - protein, 11 aa, Influenza virus
GTGQAADLKST

SEQ ID NO: 525914 - protein, 11 aa, Influenza virus
GTGQAADYEST

SEQ ID NO: 525915 - protein, 11 aa, Influenza virus
GTGQAADYKST

SEQ ID NO: 525916 - protein, 11 aa, Influenza virus
GTGRIFQSGIR

SEQ ID NO: 525917 - protein, 11 aa, Influenza virus
GTGRIFQSGVR

SEQ ID NO: 525918 - protein, 11 aa, Influenza virus
GTGRIFQSRIR

SEQ ID NO: 525919 - protein, 11 aa, Influenza virus
GTGSIYIEVLH

SEQ ID NO: 525920 - protein, 11 aa, Influenza virus
GTGSVYIEVLH

SEQ ID NO: 525921 - protein, 11 aa, Influenza virus
GTGSWPDGADI

SEQ ID NO: 525922 - protein, 11 aa, Influenza virus
GTGSWPDGANI

SEQ ID NO: 525923 - protein, 11 aa, Influenza virus
GTGTAADLKST

SEQ ID NO: 525924 - protein, 11 aa, Influenza virus
GTGTGYTMDTV

SEQ ID NO: 525925 - protein, 11 aa, Influenza virus
GTGYTMDTVNR

SEQ ID NO: 525926 - protein, 11 aa, Influenza virus
GTGYTMDTVSR

SEQ ID NO: 525927 - protein, 11 aa, Influenza virus
GTIAGFIEGGW

SEQ ID NO: 525928 - protein, 11 aa, Influenza virus
GTIASSLPFQN

SEQ ID NO: 525929 - protein, 11 aa, Influenza virus
GTIHDRAAFRG

SEQ ID NO: 525930 - protein, 11 aa, Influenza virus
GTIHDRSPFRA

SEQ ID NO: 525931 - protein, 11 aa, Influenza virus
GTIHDRSPYRA

SEQ ID NO: 525932 - protein, 11 aa, Influenza virus
GTIHDRSQFRA

SEQ ID NO: 525933 - protein, 11 aa, Influenza virus
GTIHDRSQYRA

SEQ ID NO: 525934 - protein, 11 aa, Influenza virus
GTIHDRSQYRS

SEQ ID NO: 525935 - protein, 11 aa, Influenza virus
GTIHDRTAFRG

SEQ ID NO: 525936 - protein, 11 aa, Influenza virus
GTIHDRTTFRG

SEQ ID NO: 525937 - protein, 11 aa, Influenza virus
GTIIGPPQCDL

SEQ ID NO: 525938 - protein, 11 aa, Influenza virus
GTIIGPPQCDS

SEQ ID NO: 525939 - protein, 11 aa, Influenza virus
GTIIKTLTNEK

SEQ ID NO: 525940 - protein, 11 aa, Influenza virus
GTIISNLPFQN

SEQ ID NO: 525941 - protein, 11 aa, Influenza virus
GTIISSLPFQN

SEQ ID NO: 525942 - protein, 11 aa, Influenza virus
GTIKDRSPYRT

SEQ ID NO: 525943 - protein, 11 aa, Influenza virus
GTINDRSPFRA

SEQ ID NO: 525944 - protein, 11 aa, Influenza virus
GTINSPLPFQN

SEQ ID NO: 525945 - protein, 11 aa, Influenza virus
GTISPRSRSGF

SEQ ID NO: 525946 - protein, 11 aa, Influenza virus
GTITSNLPFQN

SEQ ID NO: 525947 - protein, 11 aa, Influenza virus
GTITSPLPFQN

SEQ ID NO: 525948 - protein, 11 aa, Influenza virus
GTIVKTLTNEK

SEQ ID NO: 525949 - protein, 11 aa, Influenza virus
GTIVKTLTNEQ

SEQ ID NO: 525950 - protein, 11 aa, Influenza virus
GTIVKTLTNER

SEQ ID NO: 525951 - protein, 11 aa, Influenza virus
GTIVKTLTSEK

SEQ ID NO: 525952 - protein, 11 aa, Influenza virus
GTIVSSLPFQN

SEQ ID NO: 525953 - protein, 11 aa, Influenza virus
GTIVSSLPFQS

SEQ ID NO: 525954 - protein, 11 aa, Influenza virus
GTKINTLTERG

SEQ ID NO: 525955 - protein, 11 aa, Influenza virus
GTKQVCAAWSS

SEQ ID NO: 525956 - protein, 11 aa, Influenza virus
GTKQVCIAWSS

SEQ ID NO: 525957 - protein, 11 aa, Influenza virus
GTKQVCMAWSS

SEQ ID NO: 525958 - protein, 11 aa, Influenza virus
GTKQVCVAWSS

SEQ ID NO: 525959 - protein, 11 aa, Influenza virus
GTKRSHEQMET

SEQ ID NO: 525960 - protein, 11 aa, Influenza virus
GTKRSYEQMET

SEQ ID NO: 525961 - protein, 11 aa, Influenza virus
GTKVNTLTEKG

SEQ ID NO: 525962 - protein, 11 aa, Influenza virus
GTKVNTLTERG

SEQ ID NO: 525963 - protein, 11 aa, Influenza virus
GTLNRLIDKTN

SEQ ID NO: 525964 - protein, 11 aa, Influenza virus
GTMDYYWGILK

SEQ ID NO: 525965 - protein, 11 aa, Influenza virus
GTMHDRSPFRA

SEQ ID NO: 525966 - protein, 11 aa, Influenza virus
GTMKDRSPYRT

SEQ ID NO: 525967 - protein, 11 aa, Influenza virus
GTNNYGVKGFG

SEQ ID NO: 525968 - protein, 11 aa, Influenza virus
GTPACDLHLTG

SEQ ID NO: 525969 - protein, 11 aa, Influenza virus
GTPACDLYLTG

SEQ ID NO: 525970 - protein, 11 aa, Influenza virus
GTPDPGVKGFA

SEQ ID NO: 525971 - protein, 11 aa, Influenza virus
GTPLELRDCKI

SEQ ID NO: 525972 - protein, 11 aa, Influenza virus
GTPPTVSNSDF

SEQ ID NO: 525973 - protein, 11 aa, Influenza virus
GTPVCDPHLTG

SEQ ID NO: 525974 - protein, 11 aa, Influenza virus
GTQGVKGWAFD

SEQ ID NO: 525975 - protein, 11 aa, Influenza virus
GTQPLSISVGS

SEQ ID NO: 525976 - protein, 11 aa, Influenza virus
GTQSLSISIGS

SEQ ID NO: 525977 - protein, 11 aa, Influenza virus
GTQSLSISVES

SEQ ID NO: 525978 - protein, 11 aa, Influenza virus
GTQSLSISVGS

SEQ ID NO: 525979 - protein, 11 aa, Influenza virus
GTREWSYLIED

SEQ ID NO: 525980 - protein, 11 aa, Influenza virus
GTRIGDGQRSW

SEQ ID NO: 525981 - protein, 11 aa, Influenza virus
GTRPGYNGQKS

SEQ ID NO: 525982 - protein, 11 aa, Influenza virus
GTRQVCIAWSS

SEQ ID NO: 525983 - protein, 11 aa, Influenza virus
GTRQVCMAWSS

SEQ ID NO: 525984 - protein, 11 aa, Influenza virus
GTRQVCVAWSS

SEQ ID NO: 525985 - protein, 11 aa, Influenza virus
GTRWMKIIRVG

SEQ ID NO: 525986 - protein, 11 aa, Influenza virus
GTSGTYGAGSW

SEQ ID NO: 525987 - protein, 11 aa, Influenza virus
GTSGTYGKGSW

SEQ ID NO: 525988 - protein, 11 aa, Influenza virus
GTSGTYGSGSW

SEQ ID NO: 525989 - protein, 11 aa, Influenza virus
GTSGTYGTGSW

SEQ ID NO: 525990 - protein, 11 aa, Influenza virus
GTSGTYGTGTW

SEQ ID NO: 525991 - protein, 11 aa, Influenza virus
GTSIWTSSSST

SEQ ID NO: 525992 - protein, 11 aa, Influenza virus
GTSKACNALTG

SEQ ID NO: 525993 - protein, 11 aa, Influenza virus
GTSKACNASTG

SEQ ID NO: 525994 - protein, 11 aa, Influenza virus
GTSKACSASTG

SEQ ID NO: 525995 - protein, 11 aa, Influenza virus
GTSKIKMKWGM

SEQ ID NO: 525996 - protein, 11 aa, Influenza virus
GTSKVKMKWGM

SEQ ID NO: 525997 - protein, 11 aa, Influenza virus
GTSSIYIEVLH

SEQ ID NO: 525998 - protein, 11 aa, Influenza virus
GTSSVYIEVLH

SEQ ID NO: 525999 - protein, 11 aa, Influenza virus
GTSSVYVEVLH

SEQ ID NO: 526000 - protein, 11 aa, Influenza virus
GTSVKTLTDNH

SEQ ID NO: 526001 - protein, 11 aa, Influenza virus
GTTASCQNRGA

SEQ ID NO: 526002 - protein, 11 aa, Influenza virus
GTTGNPIICLG

SEQ ID NO: 526003 - protein, 11 aa, Influenza virus
GTTHDRTAFRG

SEQ ID NO: 526004 - protein, 11 aa, Influenza virus
GTTIRGKHSNG

SEQ ID NO: 526005 - protein, 11 aa, Influenza virus
GTTIRGRHSNG

SEQ ID NO: 526006 - protein, 11 aa, Influenza virus
GTTIRNKHSNG

SEQ ID NO: 526007 - protein, 11 aa, Influenza virus
GTTIRNKHSNS

SEQ ID NO: 526008 - protein, 11 aa, Influenza virus
GTTIRNRHSNG

SEQ ID NO: 526009 - protein, 11 aa, Influenza virus
GTTLDNEHSNG

SEQ ID NO: 526010 - protein, 11 aa, Influenza virus
GTTLDNKHSND

SEQ ID NO: 526011 - protein, 11 aa, Influenza virus
GTTLDNKHSNG

SEQ ID NO: 526012 - protein, 11 aa, Influenza virus
GTTLENKHSNG

SEQ ID NO: 526013 - protein, 11 aa, Influenza virus
GTTLKGRHANG

SEQ ID NO: 526014 - protein, 11 aa, Influenza virus
GTTLNNKHSNG

SEQ ID NO: 526015 - protein, 11 aa, Influenza virus
GTTLRGQHANG

SEQ ID NO: 526016 - protein, 11 aa, Influenza virus
GTTLRGRHANG

SEQ ID NO: 526017 - protein, 11 aa, Influenza virus
GTTLYNKHSNG

SEQ ID NO: 526018 - protein, 11 aa, Influenza virus
GTTVNEEALRQ

SEQ ID NO: 526019 - protein, 11 aa, Influenza virus
GTVKDRSPFRT

SEQ ID NO: 526020 - protein, 11 aa, Influenza virus
GTVKDRSPYRT

SEQ ID NO: 526021 - protein, 11 aa, Influenza virus
GTVSLSPGMMM

SEQ ID NO: 526022 - protein, 11 aa, Influenza virus
GTWDTLIERDN

SEQ ID NO: 526023 - protein, 11 aa, Influenza virus
GTWDTLIEREN

SEQ ID NO: 526024 - protein, 11 aa, Influenza virus
GTWDTLIERGS

SEQ ID NO: 526025 - protein, 11 aa, Influenza virus
GTYCSLNGISP

SEQ ID NO: 526026 - protein, 11 aa, Influenza virus
GTYCSLNGVSP

SEQ ID NO: 526027 - protein, 11 aa, Influenza virus
GTYDHKDYEEE

SEQ ID NO: 526028 - protein, 11 aa, Influenza virus
GTYDHKEFEEE

SEQ ID NO: 526029 - protein, 11 aa, Influenza virus
GTYDHKEFEKE

SEQ ID NO: 526030 - protein, 11 aa, Influenza virus
GTYDHKEFKEE

SEQ ID NO: 526031 - protein, 11 aa, Influenza virus
GTYDHKEYEEE

SEQ ID NO: 526032 - protein, 11 aa, Influenza virus
GTYDHNIYRDE

SEQ ID NO: 526033 - protein, 11 aa, Influenza virus
GTYDYIKYEEE

SEQ ID NO: 526034 - protein, 11 aa, Influenza virus
GTYDYPKYEEE

SEQ ID NO: 526035 - protein, 11 aa, Influenza virus
GTYDYPKYEKE

SEQ ID NO: 526036 - protein, 11 aa, Influenza virus
GTYDYPKYSEE

SEQ ID NO: 526037 - protein, 11 aa, Influenza virus
GTYDYPKYSKE

SEQ ID NO: 526038 - protein, 11 aa, Influenza virus
GTYDYSKYEEE

SEQ ID NO: 526039 - protein, 11 aa, Influenza virus
GTYGAGSWPDG

SEQ ID NO: 526040 - protein, 11 aa, Influenza virus
GTYGSGSWPDG

SEQ ID NO: 526041 - protein, 11 aa, Influenza virus
GTYGTGSWPDG

SEQ ID NO: 526042 - protein, 11 aa, Influenza virus
GTYGTGTWPDG

SEQ ID NO: 526043 - protein, 11 aa, Influenza virus
GTYKILTIYST

SEQ ID NO: 526044 - protein, 11 aa, Influenza virus
GTYNHEDYKEE

SEQ ID NO: 526045 - protein, 11 aa, Influenza virus
GTYNHEDYREE

SEQ ID NO: 526046 - protein, 11 aa, Influenza virus
GTYNHKDYEEE

SEQ ID NO: 526047 - protein, 11 aa, Influenza virus
GTYNHKEYEEE

SEQ ID NO: 526048 - protein, 11 aa, Influenza virus
GTYNNTTGRDV

SEQ ID NO: 526049 - protein, 11 aa, Influenza virus
GTYNRKEYEEE

SEQ ID NO: 526050 - protein, 11 aa, Influenza virus
GTYNYPKYEEE

SEQ ID NO: 526051 - protein, 11 aa, Influenza virus
GTYNYPKYSEE

SEQ ID NO: 526052 - protein, 11 aa, Influenza virus
GTYQILSIYST

SEQ ID NO: 526053 - protein, 11 aa, Influenza virus
GTYQILSLYST

SEQ ID NO: 526054 - protein, 11 aa, Influenza virus
GTYYYPKYEEE

SEQ ID NO: 526055 - protein, 11 aa, Influenza virus
GVAADKESTQK

SEQ ID NO: 526056 - protein, 11 aa, Influenza virus
GVAIALSILNL

SEQ ID NO: 526057 - protein, 11 aa, Influenza virus
GVAIALSVLNL

SEQ ID NO: 526058 - protein, 11 aa, Influenza virus
GVAPSPSNSRF

SEQ ID NO: 526059 - protein, 11 aa, Influenza virus
GVAPSPYNSRF

SEQ ID NO: 526060 - protein, 11 aa, Influenza virus
GVAPVLGNYKE

SEQ ID NO: 526061 - protein, 11 aa, Influenza virus
GVCPVVFTDGS

SEQ ID NO: 526062 - protein, 11 aa, Influenza virus
GVCPVVMTDGP

SEQ ID NO: 526063 - protein, 11 aa, Influenza virus
GVCYPGSIENQ

SEQ ID NO: 526064 - protein, 11 aa, Influenza virus
GVCYPGSIKNQ

SEQ ID NO: 526065 - protein, 11 aa, Influenza virus
GVDRFYRICKL

SEQ ID NO: 526066 - protein, 11 aa, Influenza virus
GVDRFYRTCKL

SEQ ID NO: 526067 - protein, 11 aa, Influenza virus
GVELSSMGVYQ

SEQ ID NO: 526068 - protein, 11 aa, Influenza virus
GVESAVLRGFL

SEQ ID NO: 526069 - protein, 11 aa, Influenza virus
GVETMVILSAS

SEQ ID NO: 526070 - protein, 11 aa, Influenza virus
GVEVVDATETV

SEQ ID NO: 526071 - protein, 11 aa, Influenza virus
GVEVVNATETV

SEQ ID NO: 526072 - protein, 11 aa, Influenza virus
GVEYNGKSLGI

SEQ ID NO: 526073 - protein, 11 aa, Influenza virus
GVFEFSDERAA

SEQ ID NO: 526074 - protein, 11 aa, Influenza virus
GVFELSDEKAA

SEQ ID NO: 526075 - protein, 11 aa, Influenza virus
GVFELSDEKAT

SEQ ID NO: 526076 - protein, 11 aa, Influenza virus
GVFELSDERAA

SEQ ID NO: 526077 - protein, 11 aa, Influenza virus
GVFELSDERAT

SEQ ID NO: 526078 - protein, 11 aa, Influenza virus
GVGIAADKEST

SEQ ID NO: 526079 - protein, 11 aa, Influenza virus
GVGMAADKEST

SEQ ID NO: 526080 - protein, 11 aa, Influenza virus
GVGNLIFNTVI

SEQ ID NO: 526081 - protein, 11 aa, Influenza virus
GVGNLVFNTVI

SEQ ID NO: 526082 - protein, 11 aa, Influenza virus
GVGRMTICIQG

SEQ ID NO: 526083 - protein, 11 aa, Influenza virus
GVGRMTICVQG

SEQ ID NO: 526084 - protein, 11 aa, Influenza virus
GVHHPSSDNEQ

SEQ ID NO: 526085 - protein, 11 aa, Influenza virus
GVHHPSTDAEQ

SEQ ID NO: 526086 - protein, 11 aa, Influenza virus
GVHHPSTDKEQ

SEQ ID NO: 526087 - protein, 11 aa, Influenza virus
GVHHPSTDTEQ

SEQ ID NO: 526088 - protein, 11 aa, Influenza virus
GVHHSSSLDEQ

SEQ ID NO: 526089 - protein, 11 aa, Influenza virus
GVINTSKPFQN

SEQ ID NO: 526090 - protein, 11 aa, Influenza virus
GVIPLTTTPTK

SEQ ID NO: 526091 - protein, 11 aa, Influenza virus
GVITDTLKSWK

SEQ ID NO: 526092 - protein, 11 aa, Influenza virus
GVKGFGFRQGD

SEQ ID NO: 526093 - protein, 11 aa, Influenza virus
GVKGFGFRQGN

SEQ ID NO: 526094 - protein, 11 aa, Influenza virus
GVKGFGFRQGT

SEQ ID NO: 526095 - protein, 11 aa, Influenza virus
GVKGFSFRYGD

SEQ ID NO: 526096 - protein, 11 aa, Influenza virus
GVKGWAFDNGD

SEQ ID NO: 526097 - protein, 11 aa, Influenza virus
GVKGWAFDNGN

SEQ ID NO: 526098 - protein, 11 aa, Influenza virus
GVKGWAFDSGD

SEQ ID NO: 526099 - protein, 11 aa, Influenza virus
GVKGWAFDYGN

SEQ ID NO: 526100 - protein, 11 aa, Influenza virus
GVKGWAFDYGS

SEQ ID NO: 526101 - protein, 11 aa, Influenza virus
GVKLEENSTYK

SEQ ID NO: 526102 - protein, 11 aa, Influenza virus
GVKLSNMGIYQ

SEQ ID NO: 526103 - protein, 11 aa, Influenza virus
GVKLSNMGVYQ

SEQ ID NO: 526104 - protein, 11 aa, Influenza virus
GVKLSSMGIYQ

SEQ ID NO: 526105 - protein, 11 aa, Influenza virus
GVKLSSMGVYQ

SEQ ID NO: 526106 - protein, 11 aa, Influenza virus
GVKMNPNQKII

SEQ ID NO: 526107 - protein, 11 aa, Influenza virus
GVKVDGSSSAC

SEQ ID NO: 526108 - protein, 11 aa, Influenza virus
GVLEDEQMYQK

SEQ ID NO: 526109 - protein, 11 aa, Influenza virus
GVLLGTKHSNG

SEQ ID NO: 526110 - protein, 11 aa, Influenza virus
GVLTDTSRPGD

SEQ ID NO: 526111 - protein, 11 aa, Influenza virus
GVLTDTSRPKD

SEQ ID NO: 526112 - protein, 11 aa, Influenza virus
GVLTDTSRPSD

SEQ ID NO: 526113 - protein, 11 aa, Influenza virus
GVMNTSKPFQN

SEQ ID NO: 526114 - protein, 11 aa, Influenza virus
GVMNTSKPLQN

SEQ ID NO: 526115 - protein, 11 aa, Influenza virus
GVNDRNFWRGE

SEQ ID NO: 526116 - protein, 11 aa, Influenza virus
GVNESADMSIG

SEQ ID NO: 526117 - protein, 11 aa, Influenza virus
GVNRFYRTCKL

SEQ ID NO: 526118 - protein, 11 aa, Influenza virus
GVNSFSRTELI

SEQ ID NO: 526119 - protein, 11 aa, Influenza virus
GVNTNKTFQNI

SEQ ID NO: 526120 - protein, 11 aa, Influenza virus
GVPFHLATKQV

SEQ ID NO: 526121 - protein, 11 aa, Influenza virus
GVPFHLGTKQV

SEQ ID NO: 526122 - protein, 11 aa, Influenza virus
GVPFHLGTRQV

SEQ ID NO: 526123 - protein, 11 aa, Influenza virus
GVPFYLGTKQV

SEQ ID NO: 526124 - protein, 11 aa, Influenza virus
GVPPLELGDCS

SEQ ID NO: 526125 - protein, 11 aa, Influenza virus
GVPVTSSIDLV

SEQ ID NO: 526126 - protein, 11 aa, Influenza virus
GVPVTSSVDLV

SEQ ID NO: 526127 - protein, 11 aa, Influenza virus
GVQAGVDRFYR

SEQ ID NO: 526128 - protein, 11 aa, Influenza virus
GVQDIIDNDNW

SEQ ID NO: 526129 - protein, 11 aa, Influenza virus
GVQDIIDNNNW

SEQ ID NO: 526130 - protein, 11 aa, Influenza virus
GVQMQRFRRPD

SEQ ID NO: 526131 - protein, 11 aa, Influenza virus
GVREWSYLIED

SEQ ID NO: 526132 - protein, 11 aa, Influenza virus
GVRIGSKGDVF

SEQ ID NO: 526133 - protein, 11 aa, Influenza virus
GVRPGYNGQKS

SEQ ID NO: 526134 - protein, 11 aa, Influenza virus
GVRPGYNGQRS

SEQ ID NO: 526135 - protein, 11 aa, Influenza virus
GVRPRYNGQRS

SEQ ID NO: 526136 - protein, 11 aa, Influenza virus
GVSFHLGTKQV

SEQ ID NO: 526137 - protein, 11 aa, Influenza virus
GVSGADDDAYA

SEQ ID NO: 526138 - protein, 11 aa, Influenza virus
GVSGADNDAYA

SEQ ID NO: 526139 - protein, 11 aa, Influenza virus
GVSGEVPGWSW

SEQ ID NO: 526140 - protein, 11 aa, Influenza virus
GVSGINESADM

SEQ ID NO: 526141 - protein, 11 aa, Influenza virus
GVSGPDNGAVA

SEQ ID NO: 526142 - protein, 11 aa, Influenza virus
GVSGTDDDAYA

SEQ ID NO: 526143 - protein, 11 aa, Influenza virus
GVSGVNESADM

SEQ ID NO: 526144 - protein, 11 aa, Influenza virus
GVSPIHLGDCS

SEQ ID NO: 526145 - protein, 11 aa, Influenza virus
GVSPVHLGDCN

SEQ ID NO: 526146 - protein, 11 aa, Influenza virus
GVSPVHLGDCR

SEQ ID NO: 526147 - protein, 11 aa, Influenza virus
GVSPVHLGDCS

SEQ ID NO: 526148 - protein, 11 aa, Influenza virus
GVSSEAPGWSW

SEQ ID NO: 526149 - protein, 11 aa, Influenza virus
GVSSEVPEWSW

SEQ ID NO: 526150 - protein, 11 aa, Influenza virus
GVSSEVPGWSW

SEQ ID NO: 526151 - protein, 11 aa, Influenza virus
GVTASCLDKGA

SEQ ID NO: 526152 - protein, 11 aa, Influenza virus
GVTASCLDRGA

SEQ ID NO: 526153 - protein, 11 aa, Influenza virus
GVTASCLDRGT

SEQ ID NO: 526154 - protein, 11 aa, Influenza virus
GVTASCRDNGA

SEQ ID NO: 526155 - protein, 11 aa, Influenza virus
GVTNKVNSIID

SEQ ID NO: 526156 - protein, 11 aa, Influenza virus
GVTNKVNSIIG

SEQ ID NO: 526157 - protein, 11 aa, Influenza virus
GVTNKVNSIIN

SEQ ID NO: 526158 - protein, 11 aa, Influenza virus
GVTRREIHIYY

SEQ ID NO: 526159 - protein, 11 aa, Influenza virus
GVTRREVHIYY

SEQ ID NO: 526160 - protein, 11 aa, Influenza virus
GVTRREVHMYY

SEQ ID NO: 526161 - protein, 11 aa, Influenza virus
GVTRREVHTYY

SEQ ID NO: 526162 - protein, 11 aa, Influenza virus
GVTRREVHVYY

SEQ ID NO: 526163 - protein, 11 aa, Influenza virus
GVTTHYVSQIG

SEQ ID NO: 526164 - protein, 11 aa, Influenza virus
GVTVIKNNMIN

SEQ ID NO: 526165 - protein, 11 aa, Influenza virus
GVTVIKNNMVN

SEQ ID NO: 526166 - protein, 11 aa, Influenza virus
GVTVIRNNMIN

SEQ ID NO: 526167 - protein, 11 aa, Influenza virus
GVVNTALSTIA

SEQ ID NO: 526168 - protein, 11 aa, Influenza virus
GVVNTTLSTIA

SEQ ID NO: 526169 - protein, 11 aa, Influenza virus
GVWIGRTKSLE

SEQ ID NO: 526170 - protein, 11 aa, Influenza virus
GVWTYNAELLV

SEQ ID NO: 526171 - protein, 11 aa, Influenza virus
GVWWTSNSIVV

SEQ ID NO: 526172 - protein, 11 aa, Influenza virus
GVYINTALLNA

SEQ ID NO: 526173 - protein, 11 aa, Influenza virus
GVYINTALLNS

SEQ ID NO: 526174 - protein, 11 aa, Influenza virus
GVYINTAMLNA

SEQ ID NO: 526175 - protein, 11 aa, Influenza virus
GVYKALSIYSC

SEQ ID NO: 526176 - protein, 11 aa, Influenza virus
GVYMNTALLNA

SEQ ID NO: 526177 - protein, 11 aa, Influenza virus
GVYNNTTGRDV

SEQ ID NO: 526178 - protein, 11 aa, Influenza virus
GVYQILAIYAT

SEQ ID NO: 526179 - protein, 11 aa, Influenza virus
GVYQILAIYST

SEQ ID NO: 526180 - protein, 11 aa, Influenza virus
GVYQILSIYST

SEQ ID NO: 526181 - protein, 11 aa, Influenza virus
GVYQVLAIYAT

SEQ ID NO: 526182 - protein, 11 aa, Influenza virus
GVYVNTALLNA

SEQ ID NO: 526183 - protein, 11 aa, Influenza virus
GWAPLSKDNGI

SEQ ID NO: 526184 - protein, 11 aa, Influenza virus
GWCGMIDGWYG

SEQ ID NO: 526185 - protein, 11 aa, Influenza virus
GWEGLIDGWYG

SEQ ID NO: 526186 - protein, 11 aa, Influenza virus
GWEGLINGWYG

SEQ ID NO: 526187 - protein, 11 aa, Influenza virus
GWEGLVDGWYG

SEQ ID NO: 526188 - protein, 11 aa, Influenza virus
GWEGMIDGWYG

SEQ ID NO: 526189 - protein, 11 aa, Influenza virus
GWEGMMDGWYG

SEQ ID NO: 526190 - protein, 11 aa, Influenza virus
GWEGMVDGWYG

SEQ ID NO: 526191 - protein, 11 aa, Influenza virus
GWEGMVNGWYG

SEQ ID NO: 526192 - protein, 11 aa, Influenza virus
GWIDSPNHAKS

SEQ ID NO: 526193 - protein, 11 aa, Influenza virus
GWILGNPMCDD

SEQ ID NO: 526194 - protein, 11 aa, Influenza virus
GWILGNPMCDE

SEQ ID NO: 526195 - protein, 11 aa, Influenza virus
GWILGNPMCDN

SEQ ID NO: 526196 - protein, 11 aa, Influenza virus
GWILGNPMCDY

SEQ ID NO: 526197 - protein, 11 aa, Influenza virus
GWILGNPRCDD

SEQ ID NO: 526198 - protein, 11 aa, Influenza virus
GWINSPNHAKS

SEQ ID NO: 526199 - protein, 11 aa, Influenza virus
GWINSPNHVKS

SEQ ID NO: 526200 - protein, 11 aa, Influenza virus
GWINSPSQAKS

SEQ ID NO: 526201 - protein, 11 aa, Influenza virus
GWITIGISGPD

SEQ ID NO: 526202 - protein, 11 aa, Influenza virus
GWIVGNPSCAS

SEQ ID NO: 526203 - protein, 11 aa, Influenza virus
GWIVGNPSCAT

SEQ ID NO: 526204 - protein, 11 aa, Influenza virus
GWLLGNPECDI

SEQ ID NO: 526205 - protein, 11 aa, Influenza virus
GWLLGNPECDL

SEQ ID NO: 526206 - protein, 11 aa, Influenza virus
GWLLGNPECDR

SEQ ID NO: 526207 - protein, 11 aa, Influenza virus
GWLLGNPKCDR

SEQ ID NO: 526208 - protein, 11 aa, Influenza virus
GWLLGNPLCDE

SEQ ID NO: 526209 - protein, 11 aa, Influenza virus
GWLLGNPMCDA

SEQ ID NO: 526210 - protein, 11 aa, Influenza virus
GWLLGNPMCDE

SEQ ID NO: 526211 - protein, 11 aa, Influenza virus
GWLLGNPMCDK

SEQ ID NO: 526212 - protein, 11 aa, Influenza virus
GWLTIGISGPD

SEQ ID NO: 526213 - protein, 11 aa, Influenza virus
GWLTIGITGPD

SEQ ID NO: 526214 - protein, 11 aa, Influenza virus
GWLTLGITGPD

SEQ ID NO: 526215 - protein, 11 aa, Influenza virus
GWMDYYWGILK

SEQ ID NO: 526216 - protein, 11 aa, Influenza virus
GWPGLINGWYG

SEQ ID NO: 526217 - protein, 11 aa, Influenza virus
GWPGLVAGWYG

SEQ ID NO: 526218 - protein, 11 aa, Influenza virus
GWQGLIDGWYG

SEQ ID NO: 526219 - protein, 11 aa, Influenza virus
GWQGLVDGWYG

SEQ ID NO: 526220 - protein, 11 aa, Influenza virus
GWQGMIDGWYG

SEQ ID NO: 526221 - protein, 11 aa, Influenza virus
GWQGMVDGWYG

SEQ ID NO: 526222 - protein, 11 aa, Influenza virus
GWSATACHDGK

SEQ ID NO: 526223 - protein, 11 aa, Influenza virus
GWSGLIAGWYG

SEQ ID NO: 526224 - protein, 11 aa, Influenza virus
GWSGLVAGWYG

SEQ ID NO: 526225 - protein, 11 aa, Influenza virus
GWSGMIDGWYG

SEQ ID NO: 526226 - protein, 11 aa, Influenza virus
GWSSTSCHDGI

SEQ ID NO: 526227 - protein, 11 aa, Influenza virus
GWSSTSCHDGK

SEQ ID NO: 526228 - protein, 11 aa, Influenza virus
GWSSTSCHDGM

SEQ ID NO: 526229 - protein, 11 aa, Influenza virus
GWSSTSCHDGR

SEQ ID NO: 526230 - protein, 11 aa, Influenza virus
GWSSTSCHDGV

SEQ ID NO: 526231 - protein, 11 aa, Influenza virus
GWSSTTCHDGI

SEQ ID NO: 526232 - protein, 11 aa, Influenza virus
GWSSTTCHDGV

SEQ ID NO: 526233 - protein, 11 aa, Influenza virus
GWSWDDGAILP

SEQ ID NO: 526234 - protein, 11 aa, Influenza virus
GWSWPDGALFP

SEQ ID NO: 526235 - protein, 11 aa, Influenza virus
GWSWPDGALLP

SEQ ID NO: 526236 - protein, 11 aa, Influenza virus
GWSYIVERPSA

SEQ ID NO: 526237 - protein, 11 aa, Influenza virus
GWTGLIDGWYG

SEQ ID NO: 526238 - protein, 11 aa, Influenza virus
GWTGMIDGWYG

SEQ ID NO: 526239 - protein, 11 aa, Influenza virus
GWTGMVDGWYG

SEQ ID NO: 526240 - protein, 11 aa, Influenza virus
GWTGMVNGWYG

SEQ ID NO: 526241 - protein, 11 aa, Influenza virus
GWTSNSIVVFC

SEQ ID NO: 526242 - protein, 11 aa, Influenza virus
GWVSTDKDSNG

SEQ ID NO: 526243 - protein, 11 aa, Influenza virus
GWVSTDKNSNG

SEQ ID NO: 526244 - protein, 11 aa, Influenza virus
GWVTADKDSNG

SEQ ID NO: 526245 - protein, 11 aa, Influenza virus
GWVVIAKDNAI

SEQ ID NO: 526246 - protein, 11 aa, Influenza virus
GWVVIAKDNAV

SEQ ID NO: 526247 - protein, 11 aa, Influenza virus
GWVVIAQDNAI

SEQ ID NO: 526248 - protein, 11 aa, Influenza virus
GWVVIEKDNAV

SEQ ID NO: 526249 - protein, 11 aa, Influenza virus
GWVVVAKDNAI

SEQ ID NO: 526250 - protein, 11 aa, Influenza virus
GWYGFHHSNAE

SEQ ID NO: 526251 - protein, 11 aa, Influenza virus
GWYGFHHSNSE

SEQ ID NO: 526252 - protein, 11 aa, Influenza virus
GWYGFKHQNAQ

SEQ ID NO: 526253 - protein, 11 aa, Influenza virus
GWYGFQHQNAE

SEQ ID NO: 526254 - protein, 11 aa, Influenza virus
GWYGFQHQNEQ

SEQ ID NO: 526255 - protein, 11 aa, Influenza virus
GWYGFQHQNSE

SEQ ID NO: 526256 - protein, 11 aa, Influenza virus
GWYGFQHRNDE

SEQ ID NO: 526257 - protein, 11 aa, Influenza virus
GWYGFQHRNEE

SEQ ID NO: 526258 - protein, 11 aa, Influenza virus
GWYGFQHSNAQ

SEQ ID NO: 526259 - protein, 11 aa, Influenza virus
GWYGFQHSNDQ

SEQ ID NO: 526260 - protein, 11 aa, Influenza virus
GWYGFQHSNEQ

SEQ ID NO: 526261 - protein, 11 aa, Influenza virus
GWYGFQHTNDQ

SEQ ID NO: 526262 - protein, 11 aa, Influenza virus
GWYGFRHHNSE

SEQ ID NO: 526263 - protein, 11 aa, Influenza virus
GWYGFRHLNSE

SEQ ID NO: 526264 - protein, 11 aa, Influenza virus
GWYGFRHQKAQ

SEQ ID NO: 526265 - protein, 11 aa, Influenza virus
GWYGFRHQNAE

SEQ ID NO: 526266 - protein, 11 aa, Influenza virus
GWYGFRHQNAQ

SEQ ID NO: 526267 - protein, 11 aa, Influenza virus
GWYGFRHQNSE

SEQ ID NO: 526268 - protein, 11 aa, Influenza virus
GWYGFRHQNSQ

SEQ ID NO: 526269 - protein, 11 aa, Influenza virus
GWYGFRHQNTQ

SEQ ID NO: 526270 - protein, 11 aa, Influenza virus
GWYGFRYQNSE

SEQ ID NO: 526271 - protein, 11 aa, Influenza virus
GWYGYHHENSQ

SEQ ID NO: 526272 - protein, 11 aa, Influenza virus
GWYGYHHQNEQ

SEQ ID NO: 526273 - protein, 11 aa, Influenza virus
GWYGYHHQNGQ

SEQ ID NO: 526274 - protein, 11 aa, Influenza virus
GWYGYHHSNDQ

SEQ ID NO: 526275 - protein, 11 aa, Influenza virus
GWYGYKHQNAQ

SEQ ID NO: 526276 - protein, 11 aa, Influenza virus
GWYGYRHQNAQ

SEQ ID NO: 526277 - protein, 11 aa, Influenza virus
GYAADKASTQK

SEQ ID NO: 526278 - protein, 11 aa, Influenza virus
GYAADKESTQK

SEQ ID NO: 526279 - protein, 11 aa, Influenza virus
GYAADKESTQR

SEQ ID NO: 526280 - protein, 11 aa, Influenza virus
GYAADKKSTQK

SEQ ID NO: 526281 - protein, 11 aa, Influenza virus
GYAADQESTQK

SEQ ID NO: 526282 - protein, 11 aa, Influenza virus
GYAADRESTQK

SEQ ID NO: 526283 - protein, 11 aa, Influenza virus
GYAADRESTQR

SEQ ID NO: 526284 - protein, 11 aa, Influenza virus
GYAADRKSTQK

SEQ ID NO: 526285 - protein, 11 aa, Influenza virus
GYAQTDCVLEA

SEQ ID NO: 526286 - protein, 11 aa, Influenza virus
GYCFTVMTDGP

SEQ ID NO: 526287 - protein, 11 aa, Influenza virus
GYDFEKEGYSL

SEQ ID NO: 526288 - protein, 11 aa, Influenza virus
GYDFEREGYSL

SEQ ID NO: 526289 - protein, 11 aa, Influenza virus
GYEILKVPNAE

SEQ ID NO: 526290 - protein, 11 aa, Influenza virus
GYEKNATASFI

SEQ ID NO: 526291 - protein, 11 aa, Influenza virus
GYEMLKVPDAE

SEQ ID NO: 526292 - protein, 11 aa, Influenza virus
GYEMLKVPNAE

SEQ ID NO: 526293 - protein, 11 aa, Influenza virus
GYEMLKVPNAL

SEQ ID NO: 526294 - protein, 11 aa, Influenza virus
GYETFKVIGGW

SEQ ID NO: 526295 - protein, 11 aa, Influenza virus
GYETFRVIDGW

SEQ ID NO: 526296 - protein, 11 aa, Influenza virus
GYETFRVIGGW

SEQ ID NO: 526297 - protein, 11 aa, Influenza virus
GYETFRVISGW

SEQ ID NO: 526298 - protein, 11 aa, Influenza virus
GYEVLKVPDAE

SEQ ID NO: 526299 - protein, 11 aa, Influenza virus
GYEVLKVPNAE

SEQ ID NO: 526300 - protein, 11 aa, Influenza virus
GYGEDNESTQK

SEQ ID NO: 526301 - protein, 11 aa, Influenza virus
GYGVKGFGFRQ

SEQ ID NO: 526302 - protein, 11 aa, Influenza virus
GYHANNSKKQI

SEQ ID NO: 526303 - protein, 11 aa, Influenza virus
GYHANNSSDTV

SEQ ID NO: 526304 - protein, 11 aa, Influenza virus
GYHANNSTDTI

SEQ ID NO: 526305 - protein, 11 aa, Influenza virus
GYHANNSTDTV

SEQ ID NO: 526306 - protein, 11 aa, Influenza virus
GYHANNSTEQV

SEQ ID NO: 526307 - protein, 11 aa, Influenza virus
GYHANNSTETV

SEQ ID NO: 526308 - protein, 11 aa, Influenza virus
GYHANNSTKQI

SEQ ID NO: 526309 - protein, 11 aa, Influenza virus
GYHANNSTKQV

SEQ ID NO: 526310 - protein, 11 aa, Influenza virus
GYHANNSTTKV

SEQ ID NO: 526311 - protein, 11 aa, Influenza virus
GYHANNSTTQI

SEQ ID NO: 526312 - protein, 11 aa, Influenza virus
GYHANNSTTQV

SEQ ID NO: 526313 - protein, 11 aa, Influenza virus
GYHFEECSCYP

SEQ ID NO: 526314 - protein, 11 aa, Influenza virus
GYHHENSQGSG

SEQ ID NO: 526315 - protein, 11 aa, Influenza virus
GYHHQNAQGSG

SEQ ID NO: 526316 - protein, 11 aa, Influenza virus
GYHHQNEQGSG

SEQ ID NO: 526317 - protein, 11 aa, Influenza virus
GYHHQNGQGSG

SEQ ID NO: 526318 - protein, 11 aa, Influenza virus
GYHHSNDQGAG

SEQ ID NO: 526319 - protein, 11 aa, Influenza virus
GYHHSNDQGSG

SEQ ID NO: 526320 - protein, 11 aa, Influenza virus
GYICSGFFGDN

SEQ ID NO: 526321 - protein, 11 aa, Influenza virus
GYICSGIFGDN

SEQ ID NO: 526322 - protein, 11 aa, Influenza virus
GYICSGVFGDN

SEQ ID NO: 526323 - protein, 11 aa, Influenza virus
GYICSGVFGDS

SEQ ID NO: 526324 - protein, 11 aa, Influenza virus
GYICSGVFGDT

SEQ ID NO: 526325 - protein, 11 aa, Influenza virus
GYICSGVLGDN

SEQ ID NO: 526326 - protein, 11 aa, Influenza virus
GYICSKFHSDT

SEQ ID NO: 526327 - protein, 11 aa, Influenza virus
GYIEGKLSQMS

SEQ ID NO: 526328 - protein, 11 aa, Influenza virus
GYIIEEYGKGR

SEQ ID NO: 526329 - protein, 11 aa, Influenza virus
GYIIEEYGRGR

SEQ ID NO: 526330 - protein, 11 aa, Influenza virus
GYIIEKYGSGR

SEQ ID NO: 526331 - protein, 11 aa, Influenza virus
GYIIEKYGTGR

SEQ ID NO: 526332 - protein, 11 aa, Influenza virus
GYKDIILWFSF

SEQ ID NO: 526333 - protein, 11 aa, Influenza virus
GYKDIILWISF

SEQ ID NO: 526334 - protein, 11 aa, Influenza virus
GYKDIILWVSF

SEQ ID NO: 526335 - protein, 11 aa, Influenza virus
GYKDVIIWFSF

SEQ ID NO: 526336 - protein, 11 aa, Influenza virus
GYKDVILWFSF

SEQ ID NO: 526337 - protein, 11 aa, Influenza virus
GYKDVILWFSL

SEQ ID NO: 526338 - protein, 11 aa, Influenza virus
GYKDVILWISF

SEQ ID NO: 526339 - protein, 11 aa, Influenza virus
GYKDWFLWISF

SEQ ID NO: 526340 - protein, 11 aa, Influenza virus
GYKDWILWISF

SEQ ID NO: 526341 - protein, 11 aa, Influenza virus
GYKDWVLWISF

SEQ ID NO: 526342 - protein, 11 aa, Influenza virus
GYKEVILWFSF

SEQ ID NO: 526343 - protein, 11 aa, Influenza virus
GYKHQNAQGEG

SEQ ID NO: 526344 - protein, 11 aa, Influenza virus
GYKMNIQILIL

SEQ ID NO: 526345 - protein, 11 aa, Influenza virus
GYKMNNQILIL

SEQ ID NO: 526346 - protein, 11 aa, Influenza virus
GYKMNTKILVL

SEQ ID NO: 526347 - protein, 11 aa, Influenza virus
GYKMNTQILIF

SEQ ID NO: 526348 - protein, 11 aa, Influenza virus
GYKMNTQILIL

SEQ ID NO: 526349 - protein, 11 aa, Influenza virus
GYKMNTQILVF

SEQ ID NO: 526350 - protein, 11 aa, Influenza virus
GYKMNTRILIL

SEQ ID NO: 526351 - protein, 11 aa, Influenza virus
GYKNWILWISF

SEQ ID NO: 526352 - protein, 11 aa, Influenza virus
GYLCAGIPSDT

SEQ ID NO: 526353 - protein, 11 aa, Influenza virus
GYLCAGIPTDT

SEQ ID NO: 526354 - protein, 11 aa, Influenza virus
GYLCAGLPSDT

SEQ ID NO: 526355 - protein, 11 aa, Influenza virus
GYLIRALTLNT

SEQ ID NO: 526356 - protein, 11 aa, Influenza virus
GYLITGKSHGR

SEQ ID NO: 526357 - protein, 11 aa, Influenza virus
GYLLKGESHCR

SEQ ID NO: 526358 - protein, 11 aa, Influenza virus
GYLLKGESHGK

SEQ ID NO: 526359 - protein, 11 aa, Influenza virus
GYLLKGESHGR

SEQ ID NO: 526360 - protein, 11 aa, Influenza virus
GYLLKGESYGR

SEQ ID NO: 526361 - protein, 11 aa, Influenza virus
GYLLLNKSLCN

SEQ ID NO: 526362 - protein, 11 aa, Influenza virus
GYLLRGESHGR

SEQ ID NO: 526363 - protein, 11 aa, Influenza virus
GYLSNNATDTV

SEQ ID NO: 526364 - protein, 11 aa, Influenza virus
GYLSNNSSDTV

SEQ ID NO: 526365 - protein, 11 aa, Influenza virus
GYLSNNSTDKI

SEQ ID NO: 526366 - protein, 11 aa, Influenza virus
GYLSNNSTDKV

SEQ ID NO: 526367 - protein, 11 aa, Influenza virus
GYLSNNSTDTV

SEQ ID NO: 526368 - protein, 11 aa, Influenza virus
GYLSNNSTEKV

SEQ ID NO: 526369 - protein, 11 aa, Influenza virus
GYLSNNSTERV

SEQ ID NO: 526370 - protein, 11 aa, Influenza virus
GYLSTNSSDKV

SEQ ID NO: 526371 - protein, 11 aa, Influenza virus
GYLSTNSSEKV

SEQ ID NO: 526372 - protein, 11 aa, Influenza virus
GYLSTNSSERV

SEQ ID NO: 526373 - protein, 11 aa, Influenza virus
GYLSTNSTEKV

SEQ ID NO: 526374 - protein, 11 aa, Influenza virus
GYMSNNSTEKV

SEQ ID NO: 526375 - protein, 11 aa, Influenza virus
GYNFEKEGYSL

SEQ ID NO: 526376 - protein, 11 aa, Influenza virus
GYNGQKSWMKI

SEQ ID NO: 526377 - protein, 11 aa, Influenza virus
GYNGQKSWTKI

SEQ ID NO: 526378 - protein, 11 aa, Influenza virus
GYNGQRSWMKI

SEQ ID NO: 526379 - protein, 11 aa, Influenza virus
GYQSLRSILAN

SEQ ID NO: 526380 - protein, 11 aa, Influenza virus
GYQSNNSTDTV

SEQ ID NO: 526381 - protein, 11 aa, Influenza virus
GYQSNNSTNTV

SEQ ID NO: 526382 - protein, 11 aa, Influenza virus
GYQTNNSTDTV

SEQ ID NO: 526383 - protein, 11 aa, Influenza virus
GYQTNNSTETV

SEQ ID NO: 526384 - protein, 11 aa, Influenza virus
GYRHQNAQGEG

SEQ ID NO: 526385 - protein, 11 aa, Influenza virus
GYSGIFSVEGK

SEQ ID NO: 526386 - protein, 11 aa, Influenza virus
GYSGIFSVEHK

SEQ ID NO: 526387 - protein, 11 aa, Influenza virus
GYSGIFSVENK

SEQ ID NO: 526388 - protein, 11 aa, Influenza virus
GYSGIFSVESK

SEQ ID NO: 526389 - protein, 11 aa, Influenza virus
GYSGSFIDYWA

SEQ ID NO: 526390 - protein, 11 aa, Influenza virus
GYSGSFIDYWD

SEQ ID NO: 526391 - protein, 11 aa, Influenza virus
GYSGSFIDYWN

SEQ ID NO: 526392 - protein, 11 aa, Influenza virus
GYSGSFIQHPE

SEQ ID NO: 526393 - protein, 11 aa, Influenza virus
GYSGSFMDYWA

SEQ ID NO: 526394 - protein, 11 aa, Influenza virus
GYSGSFSIRGE

SEQ ID NO: 526395 - protein, 11 aa, Influenza virus
GYSGSFSIRWE

SEQ ID NO: 526396 - protein, 11 aa, Influenza virus
GYSGSFTLPIE

SEQ ID NO: 526397 - protein, 11 aa, Influenza virus
GYSGSFTLPVE

SEQ ID NO: 526398 - protein, 11 aa, Influenza virus
GYSGSFTLPVG

SEQ ID NO: 526399 - protein, 11 aa, Influenza virus
GYSGSFVDYWA

SEQ ID NO: 526400 - protein, 11 aa, Influenza virus
GYSGSFVQHPE

SEQ ID NO: 526401 - protein, 11 aa, Influenza virus
GYSGVFSVEGK

SEQ ID NO: 526402 - protein, 11 aa, Influenza virus
GYSLVGIDPFK

SEQ ID NO: 526403 - protein, 11 aa, Influenza virus
GYSLVGIDPFR

SEQ ID NO: 526404 - protein, 11 aa, Influenza virus
GYSLVGVDPFK

SEQ ID NO: 526405 - protein, 11 aa, Influenza virus
GYSTGALASCM

SEQ ID NO: 526406 - protein, 11 aa, Influenza virus
GYTMDTVNRTH

SEQ ID NO: 526407 - protein, 11 aa, Influenza virus
GYTMDTVSRTH

SEQ ID NO: 526408 - protein, 11 aa, Influenza virus
GYVCGKFHSDT

SEQ ID NO: 526409 - protein, 11 aa, Influenza virus
GYVCSGIFGDN

SEQ ID NO: 526410 - protein, 11 aa, Influenza virus
GYVCSGIFGDS

SEQ ID NO: 526411 - protein, 11 aa, Influenza virus
GYVCSGLVGDT

SEQ ID NO: 526412 - protein, 11 aa, Influenza virus
GYVCSGVFGDN

SEQ ID NO: 526413 - protein, 11 aa, Influenza virus
GYVCSKFHSDT

SEQ ID NO: 526414 - protein, 11 aa, Influenza virus
GYWAIRTRSGG

SEQ ID NO: 526415 - protein, 11 aa, Influenza virus
HAKDILEKAHN

SEQ ID NO: 526416 - protein, 11 aa, Influenza virus
HAKDILEKTHN

SEQ ID NO: 526417 - protein, 11 aa, Influenza virus
HAKNILEKTHN

SEQ ID NO: 526418 - protein, 11 aa, Influenza virus
HALRELWQCYY

SEQ ID NO: 526419 - protein, 11 aa, Influenza virus
HANGTIHDRSP

SEQ ID NO: 526420 - protein, 11 aa, Influenza virus
HANGTIHDRSQ

SEQ ID NO: 526421 - protein, 11 aa, Influenza virus
HANGTINDRSP

SEQ ID NO: 526422 - protein, 11 aa, Influenza virus
HANGTMHDRSP

SEQ ID NO: 526423 - protein, 11 aa, Influenza virus
HANNSKKQIDT

SEQ ID NO: 526424 - protein, 11 aa, Influenza virus
HANNSTDTIDT

SEQ ID NO: 526425 - protein, 11 aa, Influenza virus
HANNSTDTVDT

SEQ ID NO: 526426 - protein, 11 aa, Influenza virus
HANNSTEQVDT

SEQ ID NO: 526427 - protein, 11 aa, Influenza virus
HANNSTETVDT

SEQ ID NO: 526428 - protein, 11 aa, Influenza virus
HANNSTKQIDT

SEQ ID NO: 526429 - protein, 11 aa, Influenza virus
HANNSTKQVDT

SEQ ID NO: 526430 - protein, 11 aa, Influenza virus
HANNSTTKVDT

SEQ ID NO: 526431 - protein, 11 aa, Influenza virus
HANNSTTQIDT

SEQ ID NO: 526432 - protein, 11 aa, Influenza virus
HANNSTTQVDT

SEQ ID NO: 526433 - protein, 11 aa, Influenza virus
HANNSTTQVNT

SEQ ID NO: 526434 - protein, 11 aa, Influenza virus
HAQDILEKTHN

SEQ ID NO: 526435 - protein, 11 aa, Influenza virus
HAQNILEKTHN

SEQ ID NO: 526436 - protein, 11 aa, Influenza virus
HAQYREEALLN

SEQ ID NO: 526437 - protein, 11 aa, Influenza virus
HASNRPWISFD

SEQ ID NO: 526438 - protein, 11 aa, Influenza virus
HASNRPWVSFD

SEQ ID NO: 526439 - protein, 11 aa, Influenza virus
HASNRPWVSFN

SEQ ID NO: 526440 - protein, 11 aa, Influenza virus
HAVANGTKVNT

SEQ ID NO: 526441 - protein, 11 aa, Influenza virus
HAVENGTSVKT

SEQ ID NO: 526442 - protein, 11 aa, Influenza virus
HAVPNGTIVKT

SEQ ID NO: 526443 - protein, 11 aa, Influenza virus
HAVPNGTIVRT

SEQ ID NO: 526444 - protein, 11 aa, Influenza virus
HAVPNGTKVNT

SEQ ID NO: 526445 - protein, 11 aa, Influenza virus
HAVPNGTLVKT

SEQ ID NO: 526446 - protein, 11 aa, Influenza virus
HAVPNGTMVKT

SEQ ID NO: 526447 - protein, 11 aa, Influenza virus
HAVPNGTVVKT

SEQ ID NO: 526448 - protein, 11 aa, Influenza virus
HAVSNGTKINT

SEQ ID NO: 526449 - protein, 11 aa, Influenza virus
HAVSNGTKVNT

SEQ ID NO: 526450 - protein, 11 aa, Influenza virus
HCINRCFYVEL

SEQ ID NO: 526451 - protein, 11 aa, Influenza virus
HCMESIRNNTY

SEQ ID NO: 526452 - protein, 11 aa, Influenza virus
HCRATEYIIKG

SEQ ID NO: 526453 - protein, 11 aa, Influenza virus
HCRATEYIMKG

SEQ ID NO: 526454 - protein, 11 aa, Influenza virus
HCRATEYMMKG

SEQ ID NO: 526455 - protein, 11 aa, Influenza virus
HCRIIQNEDIP

SEQ ID NO: 526456 - protein, 11 aa, Influenza virus
HCSKYHWNLAL

SEQ ID NO: 526457 - protein, 11 aa, Influenza virus
HCWSFALAQGA

SEQ ID NO: 526458 - protein, 11 aa, Influenza virus
HDANVKNLHDQ

SEQ ID NO: 526459 - protein, 11 aa, Influenza virus
HDANVKNLHEQ

SEQ ID NO: 526460 - protein, 11 aa, Influenza virus
HDANVRNLHDQ

SEQ ID NO: 526461 - protein, 11 aa, Influenza virus
HDANVRNLHDR

SEQ ID NO: 526462 - protein, 11 aa, Influenza virus
HDANVRNLHEQ

SEQ ID NO: 526463 - protein, 11 aa, Influenza virus
HDANVRNLHER

SEQ ID NO: 526464 - protein, 11 aa, Influenza virus
HDFEREGYSLV

SEQ ID NO: 526465 - protein, 11 aa, Influenza virus
HDGIGRMTICI

SEQ ID NO: 526466 - protein, 11 aa, Influenza virus
HDGIGRMTICV

SEQ ID NO: 526467 - protein, 11 aa, Influenza virus
HDGKAWLHICV

SEQ ID NO: 526468 - protein, 11 aa, Influenza virus
HDGKAWLHVCI

SEQ ID NO: 526469 - protein, 11 aa, Influenza virus
HDGKAWLHVCV

SEQ ID NO: 526470 - protein, 11 aa, Influenza virus
HDGRAWLHVCV

SEQ ID NO: 526471 - protein, 11 aa, Influenza virus
HDGVGRMTICI

SEQ ID NO: 526472 - protein, 11 aa, Influenza virus
HDGVGRMTICV

SEQ ID NO: 526473 - protein, 11 aa, Influenza virus
HDRAAFRGLIS

SEQ ID NO: 526474 - protein, 11 aa, Influenza virus
HDRICIGYQSN

SEQ ID NO: 526475 - protein, 11 aa, Influenza virus
HDRIPHRTLLM

SEQ ID NO: 526476 - protein, 11 aa, Influenza virus
HDRISHRTLLM

SEQ ID NO: 526477 - protein, 11 aa, Influenza virus
HDRSPFRALIS

SEQ ID NO: 526478 - protein, 11 aa, Influenza virus
HDRSPFRALVS

SEQ ID NO: 526479 - protein, 11 aa, Influenza virus
HDRSPHRTLLM

SEQ ID NO: 526480 - protein, 11 aa, Influenza virus
HDRSPYRALIS

SEQ ID NO: 526481 - protein, 11 aa, Influenza virus
HDRSQFRALIS

SEQ ID NO: 526482 - protein, 11 aa, Influenza virus
HDRSQYRALIS

SEQ ID NO: 526483 - protein, 11 aa, Influenza virus
HDRSQYRALVS

SEQ ID NO: 526484 - protein, 11 aa, Influenza virus
HDRSQYRSLIS

SEQ ID NO: 526485 - protein, 11 aa, Influenza virus
HDRTAFRGLIS

SEQ ID NO: 526486 - protein, 11 aa, Influenza virus
HDRTAFRGLMS

SEQ ID NO: 526487 - protein, 11 aa, Influenza virus
HDRTPHRTLLM

SEQ ID NO: 526488 - protein, 11 aa, Influenza virus
HDRTSHRTLLM

SEQ ID NO: 526489 - protein, 11 aa, Influenza virus
HDRTTFRGLIS

SEQ ID NO: 526490 - protein, 11 aa, Influenza virus
HDRTTFRGLLS

SEQ ID NO: 526491 - protein, 11 aa, Influenza virus
HDSNVENLFDE

SEQ ID NO: 526492 - protein, 11 aa, Influenza virus
HDSNVKNLFDE

SEQ ID NO: 526493 - protein, 11 aa, Influenza virus
HDSNVKNLYDK

SEQ ID NO: 526494 - protein, 11 aa, Influenza virus
HDSNVKNLYDR

SEQ ID NO: 526495 - protein, 11 aa, Influenza virus
HDSNVKNLYEK

SEQ ID NO: 526496 - protein, 11 aa, Influenza virus
HDSNVKNLYNK

SEQ ID NO: 526497 - protein, 11 aa, Influenza virus
HDSNVRNLHEK

SEQ ID NO: 526498 - protein, 11 aa, Influenza virus
HDSNVRNLHER

SEQ ID NO: 526499 - protein, 11 aa, Influenza virus
HDSNVRNLYDK

SEQ ID NO: 526500 - protein, 11 aa, Influenza virus
HDSNVRSLHEK

SEQ ID NO: 526501 - protein, 11 aa, Influenza virus
HDSNVTNLHEK

SEQ ID NO: 526502 - protein, 11 aa, Influenza virus
HECRTFFLTQG

SEQ ID NO: 526503 - protein, 11 aa, Influenza virus
HEDYKEESQLK

SEQ ID NO: 526504 - protein, 11 aa, Influenza virus
HEDYREESQLK

SEQ ID NO: 526505 - protein, 11 aa, Influenza virus
HEEVTNATETV

SEQ ID NO: 526506 - protein, 11 aa, Influenza virus
HEGEGIPLHDA

SEQ ID NO: 526507 - protein, 11 aa, Influenza virus
HEGEGIPLYDA

SEQ ID NO: 526508 - protein, 11 aa, Influenza virus
HENRMVIASTT

SEQ ID NO: 526509 - protein, 11 aa, Influenza virus
HENRMVLASTT

SEQ ID NO: 526510 - protein, 11 aa, Influenza virus
HENSQGSGYAA

SEQ ID NO: 526511 - protein, 11 aa, Influenza virus
HERVRKQLREN

SEQ ID NO: 526512 - protein, 11 aa, Influenza virus
HESECVCINGT

SEQ ID NO: 526513 - protein, 11 aa, Influenza virus
HFEECSCYPSG

SEQ ID NO: 526514 - protein, 11 aa, Influenza virus
HFEKIKILPRD

SEQ ID NO: 526515 - protein, 11 aa, Influenza virus
HFEKVKILARN

SEQ ID NO: 526516 - protein, 11 aa, Influenza virus
HFEKVKILPKD

SEQ ID NO: 526517 - protein, 11 aa, Influenza virus
HFEKVKILPRD

SEQ ID NO: 526518 - protein, 11 aa, Influenza virus
HFEKVRILPKD

SEQ ID NO: 526519 - protein, 11 aa, Influenza virus
HFESNGNFIAP

SEQ ID NO: 526520 - protein, 11 aa, Influenza virus
HFHRKRRVRDN

SEQ ID NO: 526521 - protein, 11 aa, Influenza virus
HFQNQVKIRRR

SEQ ID NO: 526522 - protein, 11 aa, Influenza virus
HFQRKRRIRDN

SEQ ID NO: 526523 - protein, 11 aa, Influenza virus
HFQRKRRVRDN

SEQ ID NO: 526524 - protein, 11 aa, Influenza virus
HFRNQIKIRRR

SEQ ID NO: 526525 - protein, 11 aa, Influenza virus
HFRNQVKIRRR

SEQ ID NO: 526526 - protein, 11 aa, Influenza virus
HFRSQVKIRRR

SEQ ID NO: 526527 - protein, 11 aa, Influenza virus
HGALLNDKHSN

SEQ ID NO: 526528 - protein, 11 aa, Influenza virus
HGICAVATTHS

SEQ ID NO: 526529 - protein, 11 aa, Influenza virus
HGKIIQNEDIP

SEQ ID NO: 526530 - protein, 11 aa, Influenza virus
HGLCYPGELDN

SEQ ID NO: 526531 - protein, 11 aa, Influenza virus
HGLCYPGELNN

SEQ ID NO: 526532 - protein, 11 aa, Influenza virus
HGRIIQNEDIP

SEQ ID NO: 526533 - protein, 11 aa, Influenza virus
HGRTIQNEDIP

SEQ ID NO: 526534 - protein, 11 aa, Influenza virus
HGSLLNDKHSN

SEQ ID NO: 526535 - protein, 11 aa, Influenza virus
HGSLVLSLWMC

SEQ ID NO: 526536 - protein, 11 aa, Influenza virus
HGSNRPWISFN

SEQ ID NO: 526537 - protein, 11 aa, Influenza virus
HGSNRPWLSFN

SEQ ID NO: 526538 - protein, 11 aa, Influenza virus
HGSNRPWVSFD

SEQ ID NO: 526539 - protein, 11 aa, Influenza virus
HGSNRPWVSFN

SEQ ID NO: 526540 - protein, 11 aa, Influenza virus
HGTGSWPDGAN

SEQ ID NO: 526541 - protein, 11 aa, Influenza virus
HGTGTGYTMDT

SEQ ID NO: 526542 - protein, 11 aa, Influenza virus
HHANNSTEQVD

SEQ ID NO: 526543 - protein, 11 aa, Influenza virus
HHAVANGTKVN

SEQ ID NO: 526544 - protein, 11 aa, Influenza virus
HHAVENGTSVK

SEQ ID NO: 526545 - protein, 11 aa, Influenza virus
HHAVPNGTIVK

SEQ ID NO: 526546 - protein, 11 aa, Influenza virus
HHAVPNGTIVR

SEQ ID NO: 526547 - protein, 11 aa, Influenza virus
HHAVPNGTKVN

SEQ ID NO: 526548 - protein, 11 aa, Influenza virus
HHAVPNGTLVK

SEQ ID NO: 526549 - protein, 11 aa, Influenza virus
HHAVPNGTMVK

SEQ ID NO: 526550 - protein, 11 aa, Influenza virus
HHAVPNGTVVK

SEQ ID NO: 526551 - protein, 11 aa, Influenza virus
HHAVSNGTKIN

SEQ ID NO: 526552 - protein, 11 aa, Influenza virus
HHAVSNGTKVN

SEQ ID NO: 526553 - protein, 11 aa, Influenza virus
HHENSQGSGYA

SEQ ID NO: 526554 - protein, 11 aa, Influenza virus
HHMRKKRGLFG

SEQ ID NO: 526555 - protein, 11 aa, Influenza virus
HHPSSAQEKND

SEQ ID NO: 526556 - protein, 11 aa, Influenza virus
HHPSSDNEQTD

SEQ ID NO: 526557 - protein, 11 aa, Influenza virus
HHPSSTKEKND

SEQ ID NO: 526558 - protein, 11 aa, Influenza virus
HHPSSTKEKNE

SEQ ID NO: 526559 - protein, 11 aa, Influenza virus
HHPSSTQEKND

SEQ ID NO: 526560 - protein, 11 aa, Influenza virus
HHPSSTQERND

SEQ ID NO: 526561 - protein, 11 aa, Influenza virus
HHQNAQGSGYA

SEQ ID NO: 526562 - protein, 11 aa, Influenza virus
HHQNEQGSGYA

SEQ ID NO: 526563 - protein, 11 aa, Influenza virus
HHQNGQGSGYA

SEQ ID NO: 526564 - protein, 11 aa, Influenza virus
HHSNAEGTGMA

SEQ ID NO: 526565 - protein, 11 aa, Influenza virus
HHSNDQGAGYA

SEQ ID NO: 526566 - protein, 11 aa, Influenza virus
HHSNDQGSGYA

SEQ ID NO: 526567 - protein, 11 aa, Influenza virus
HHSNSEGTGMA

SEQ ID NO: 526568 - protein, 11 aa, Influenza virus
HHSSSLDEQNK

SEQ ID NO: 526569 - protein, 11 aa, Influenza virus
HIAILATTVTL

SEQ ID NO: 526570 - protein, 11 aa, Influenza virus
HICIGYHANNS

SEQ ID NO: 526571 - protein, 11 aa, Influenza virus
HICVTGDDRNA

SEQ ID NO: 526572 - protein, 11 aa, Influenza virus
HIEECPCYGHN

SEQ ID NO: 526573 - protein, 11 aa, Influenza virus
HIEECSCYGHD

SEQ ID NO: 526574 - protein, 11 aa, Influenza virus
HIEECSCYGHN

SEQ ID NO: 526575 - protein, 11 aa, Influenza virus
HIEECSCYGHS

SEQ ID NO: 526576 - protein, 11 aa, Influenza virus
HIEECSCYPND

SEQ ID NO: 526577 - protein, 11 aa, Influenza virus
HIEECSCYPNE

SEQ ID NO: 526578 - protein, 11 aa, Influenza virus
HIEECSCYPNL

SEQ ID NO: 526579 - protein, 11 aa, Influenza virus
HIEECSCYPNM

SEQ ID NO: 526580 - protein, 11 aa, Influenza virus
HIEECSCYPNS

SEQ ID NO: 526581 - protein, 11 aa, Influenza virus
HIEECSCYPQY

SEQ ID NO: 526582 - protein, 11 aa, Influenza virus
HIEECSCYPRY

SEQ ID NO: 526583 - protein, 11 aa, Influenza virus
HIEECSCYSRY

SEQ ID NO: 526584 - protein, 11 aa, Influenza virus
HIEEWSCYGHS

SEQ ID NO: 526585 - protein, 11 aa, Influenza virus
HIEVTNATELV

SEQ ID NO: 526586 - protein, 11 aa, Influenza virus
HIFGKDNAIRI

SEQ ID NO: 526587 - protein, 11 aa, Influenza virus
HIFGKDNAVRI

SEQ ID NO: 526588 - protein, 11 aa, Influenza virus
HIFSFNGEEMA

SEQ ID NO: 526589 - protein, 11 aa, Influenza virus
HIFSFTGEEMA

SEQ ID NO: 526590 - protein, 11 aa, Influenza virus
HIFSKDNAIRI

SEQ ID NO: 526591 - protein, 11 aa, Influenza virus
HIFVIREPFVA

SEQ ID NO: 526592 - protein, 11 aa, Influenza virus
HIFVIREPFVS

SEQ ID NO: 526593 - protein, 11 aa, Influenza virus
HIGPLSGSAQH

SEQ ID NO: 526594 - protein, 11 aa, Influenza virus
HIGVAPSPSNS

SEQ ID NO: 526595 - protein, 11 aa, Influenza virus
HIHIFSFNGEE

SEQ ID NO: 526596 - protein, 11 aa, Influenza virus
HIHIFSFTGEE

SEQ ID NO: 526597 - protein, 11 aa, Influenza virus
HIIDLADSEMN

SEQ ID NO: 526598 - protein, 11 aa, Influenza virus
HIIDVTDSEMN

SEQ ID NO: 526599 - protein, 11 aa, Influenza virus
HILSKDNAIRI

SEQ ID NO: 526600 - protein, 11 aa, Influenza virus
HILSKDNAVRI

SEQ ID NO: 526601 - protein, 11 aa, Influenza virus
HILVTREPYLS

SEQ ID NO: 526602 - protein, 11 aa, Influenza virus
HIMIWHSNLND

SEQ ID NO: 526603 - protein, 11 aa, Influenza virus
HIPEAGLKWEL

SEQ ID NO: 526604 - protein, 11 aa, Influenza virus
HIPEVCLKWDL

SEQ ID NO: 526605 - protein, 11 aa, Influenza virus
HIPEVCLKWEL

SEQ ID NO: 526606 - protein, 11 aa, Influenza virus
HIPEVCLKWGL

SEQ ID NO: 526607 - protein, 11 aa, Influenza virus
HISPLAGSAQH

SEQ ID NO: 526608 - protein, 11 aa, Influenza virus
HISPLSGSAQH

SEQ ID NO: 526609 - protein, 11 aa, Influenza virus
HITGFAPFSKD

SEQ ID NO: 526610 - protein, 11 aa, Influenza virus
HIVERILEEES

SEQ ID NO: 526611 - protein, 11 aa, Influenza virus
HIWVTREPYVS

SEQ ID NO: 526612 - protein, 11 aa, Influenza virus
HIYGKDNAIRI

SEQ ID NO: 526613 - protein, 11 aa, Influenza virus
HIYGKDNAVRI

SEQ ID NO: 526614 - protein, 11 aa, Influenza virus
HKCDDDCMASI

SEQ ID NO: 526615 - protein, 11 aa, Influenza virus
HKCDDHCMESI

SEQ ID NO: 526616 - protein, 11 aa, Influenza virus
HKCDDQCMESI

SEQ ID NO: 526617 - protein, 11 aa, Influenza virus
HKCDNECMETI

SEQ ID NO: 526618 - protein, 11 aa, Influenza virus
HKCDNKCMETI

SEQ ID NO: 526619 - protein, 11 aa, Influenza virus
HKCDNQCMESI

SEQ ID NO: 526620 - protein, 11 aa, Influenza virus
HKCNDSCMDTI

SEQ ID NO: 526621 - protein, 11 aa, Influenza virus
HKCNDSCMEAI

SEQ ID NO: 526622 - protein, 11 aa, Influenza virus
HKCNDSCMETI

SEQ ID NO: 526623 - protein, 11 aa, Influenza virus
HKCNNECMETI

SEQ ID NO: 526624 - protein, 11 aa, Influenza virus
HKCNNSCMETI

SEQ ID NO: 526625 - protein, 11 aa, Influenza virus
HKCNNTCMETI

SEQ ID NO: 526626 - protein, 11 aa, Influenza virus
HKDNAIRLGEN

SEQ ID NO: 526627 - protein, 11 aa, Influenza virus
HKDNAIRLGET

SEQ ID NO: 526628 - protein, 11 aa, Influenza virus
HKDNAIRPGEN

SEQ ID NO: 526629 - protein, 11 aa, Influenza virus
HKDNALRLAEN

SEQ ID NO: 526630 - protein, 11 aa, Influenza virus
HKDNAVRLGEN

SEQ ID NO: 526631 - protein, 11 aa, Influenza virus
HKDYEEEAKLE

SEQ ID NO: 526632 - protein, 11 aa, Influenza virus
HKEYEEEAKLE

SEQ ID NO: 526633 - protein, 11 aa, Influenza virus
HKGNSARLIHH

SEQ ID NO: 526634 - protein, 11 aa, Influenza virus
HKICIGYHANN

SEQ ID NO: 526635 - protein, 11 aa, Influenza virus
HKILTIYSTVA

SEQ ID NO: 526636 - protein, 11 aa, Influenza virus
HKMESRGLFGA

SEQ ID NO: 526637 - protein, 11 aa, Influenza virus
HKQLTHHMRKK

SEQ ID NO: 526638 - protein, 11 aa, Influenza virus
HKSCLPACAYG

SEQ ID NO: 526639 - protein, 11 aa, Influenza virus
HKSCLPACIYG

SEQ ID NO: 526640 - protein, 11 aa, Influenza virus
HKSCLPACVYG

SEQ ID NO: 526641 - protein, 11 aa, Influenza virus
HKSQLIWMACH

SEQ ID NO: 526642 - protein, 11 aa, Influenza virus
HKSQLVWMACH

SEQ ID NO: 526643 - protein, 11 aa, Influenza virus
HKSQLVWMACN

SEQ ID NO: 526644 - protein, 11 aa, Influenza virus
HLEECSCYMDI

SEQ ID NO: 526645 - protein, 11 aa, Influenza virus
HLEECSCYPSG

SEQ ID NO: 526646 - protein, 11 aa, Influenza virus
HLEECSCYVDI

SEQ ID NO: 526647 - protein, 11 aa, Influenza virus
HLEECSCYVDT

SEQ ID NO: 526648 - protein, 11 aa, Influenza virus
HLEECSCYVDV

SEQ ID NO: 526649 - protein, 11 aa, Influenza virus
HLEFKADLIIE

SEQ ID NO: 526650 - protein, 11 aa, Influenza virus
HLEICFMYSDF

SEQ ID NO: 526651 - protein, 11 aa, Influenza virus
HLEVCFMYSDF

SEQ ID NO: 526652 - protein, 11 aa, Influenza virus
HLFSGIKSFSR

SEQ ID NO: 526653 - protein, 11 aa, Influenza virus
HLFSGIRSFSR

SEQ ID NO: 526654 - protein, 11 aa, Influenza virus
HLFSGVNSFSR

SEQ ID NO: 526655 - protein, 11 aa, Influenza virus
HLGDCNFEGWI

SEQ ID NO: 526656 - protein, 11 aa, Influenza virus
HLGDCRFEGWI

SEQ ID NO: 526657 - protein, 11 aa, Influenza virus
HLGDCSFEGWI

SEQ ID NO: 526658 - protein, 11 aa, Influenza virus
HLGTKQVCAAW

SEQ ID NO: 526659 - protein, 11 aa, Influenza virus
HLGTKQVCIAW

SEQ ID NO: 526660 - protein, 11 aa, Influenza virus
HLGTKQVCMAW

SEQ ID NO: 526661 - protein, 11 aa, Influenza virus
HLGTKQVCVAW

SEQ ID NO: 526662 - protein, 11 aa, Influenza virus
HLGTRQVCIAW

SEQ ID NO: 526663 - protein, 11 aa, Influenza virus
HLGTRQVCMAW

SEQ ID NO: 526664 - protein, 11 aa, Influenza virus
HLGTRQVCVAW

SEQ ID NO: 526665 - protein, 11 aa, Influenza virus
HLIIWGIHHPS

SEQ ID NO: 526666 - protein, 11 aa, Influenza virus
HLIMWGIHHPS

SEQ ID NO: 526667 - protein, 11 aa, Influenza virus
HLITGKSHGRI

SEQ ID NO: 526668 - protein, 11 aa, Influenza virus
HLITGKSHGRV

SEQ ID NO: 526669 - protein, 11 aa, Influenza virus
HLITWGIHHPS

SEQ ID NO: 526670 - protein, 11 aa, Influenza virus
HLIVWGIHHPS

SEQ ID NO: 526671 - protein, 11 aa, Influenza virus
HLKDQAWSYIV

SEQ ID NO: 526672 - protein, 11 aa, Influenza virus
HLKDQDWSYIV

SEQ ID NO: 526673 - protein, 11 aa, Influenza virus
HLKDQGWSYIV

SEQ ID NO: 526674 - protein, 11 aa, Influenza virus
HLKDQSWSYIV

SEQ ID NO: 526675 - protein, 11 aa, Influenza virus
HLKFKADLIIE

SEQ ID NO: 526676 - protein, 11 aa, Influenza virus
HLMIWHSNLND

SEQ ID NO: 526677 - protein, 11 aa, Influenza virus
HLRDQGWSYIV

SEQ ID NO: 526678 - protein, 11 aa, Influenza virus
HLRNDTDVVNF

SEQ ID NO: 526679 - protein, 11 aa, Influenza virus
HLRNDTDVVNY

SEQ ID NO: 526680 - protein, 11 aa, Influenza virus
HLSSVSSFERF

SEQ ID NO: 526681 - protein, 11 aa, Influenza virus
HLTDSEMNKLF

SEQ ID NO: 526682 - protein, 11 aa, Influenza virus
HLTGIWDTLIE

SEQ ID NO: 526683 - protein, 11 aa, Influenza virus
HLTGMWDTLIE

SEQ ID NO: 526684 - protein, 11 aa, Influenza virus
HLTGTWDTLIE

SEQ ID NO: 526685 - protein, 11 aa, Influenza virus
HLTQGACWEQL

SEQ ID NO: 526686 - protein, 11 aa, Influenza virus
HLTQGTCWEQL

SEQ ID NO: 526687 - protein, 11 aa, Influenza virus
HLTQGTCWEQM

SEQ ID NO: 526688 - protein, 11 aa, Influenza virus
HLTTGKSHGRI

SEQ ID NO: 526689 - protein, 11 aa, Influenza virus
HLVMWGIHHPS

SEQ ID NO: 526690 - protein, 11 aa, Influenza virus
HLVTGKSHGRI

SEQ ID NO: 526691 - protein, 11 aa, Influenza virus
HMAIIKKYTSA

SEQ ID NO: 526692 - protein, 11 aa, Influenza virus
HMAIIKKYTSG

SEQ ID NO: 526693 - protein, 11 aa, Influenza virus
HMAIIKRYTSG

SEQ ID NO: 526694 - protein, 11 aa, Influenza virus
HMEVCFMYSDF

SEQ ID NO: 526695 - protein, 11 aa, Influenza virus
HMMIWHSNLND

SEQ ID NO: 526696 - protein, 11 aa, Influenza virus
HMRKKRGLFGA

SEQ ID NO: 526697 - protein, 11 aa, Influenza virus
HNGGLIAPDRV

SEQ ID NO: 526698 - protein, 11 aa, Influenza virus
HNGGLIAPNRV

SEQ ID NO: 526699 - protein, 11 aa, Influenza virus
HNGGLIAPSRV

SEQ ID NO: 526700 - protein, 11 aa, Influenza virus
HNGGLIAPTRV

SEQ ID NO: 526701 - protein, 11 aa, Influenza virus
HNGGLVAPSRV

SEQ ID NO: 526702 - protein, 11 aa, Influenza virus
HNGGRIAPSRV

SEQ ID NO: 526703 - protein, 11 aa, Influenza virus
HNGICPVAFTD

SEQ ID NO: 526704 - protein, 11 aa, Influenza virus
HNGICPVVFTD

SEQ ID NO: 526705 - protein, 11 aa, Influenza virus
HNGKLCKLNGI

SEQ ID NO: 526706 - protein, 11 aa, Influenza virus
HNGKLCRLRGI

SEQ ID NO: 526707 - protein, 11 aa, Influenza virus
HNGKLCRLSGI

SEQ ID NO: 526708 - protein, 11 aa, Influenza virus
HNGTCAVVMTD

SEQ ID NO: 526709 - protein, 11 aa, Influenza virus
HNGTCVVIMTD

SEQ ID NO: 526710 - protein, 11 aa, Influenza virus
HNGTCVVVMTD

SEQ ID NO: 526711 - protein, 11 aa, Influenza virus
HNGTWAVVMTD

SEQ ID NO: 526712 - protein, 11 aa, Influenza virus
HNGVCPVVFTD

SEQ ID NO: 526713 - protein, 11 aa, Influenza virus
HNIHPLAIGEC

SEQ ID NO: 526714 - protein, 11 aa, Influenza virus
HNIHPLTIGEC

SEQ ID NO: 526715 - protein, 11 aa, Influenza virus
HNIHPLTIGKC

SEQ ID NO: 526716 - protein, 11 aa, Influenza virus
HNILRTQESEC

SEQ ID NO: 526717 - protein, 11 aa, Influenza virus
HNIYRDEAINN

SEQ ID NO: 526718 - protein, 11 aa, Influenza virus
HNNEQGSGYAA

SEQ ID NO: 526719 - protein, 11 aa, Influenza virus
HNQEYTSGRQE

SEQ ID NO: 526720 - protein, 11 aa, Influenza virus
HNSTCVVVMTD

SEQ ID NO: 526721 - protein, 11 aa, Influenza virus
HNVHPLAIGEC

SEQ ID NO: 526722 - protein, 11 aa, Influenza virus
HNVHPLTIGEC

SEQ ID NO: 526723 - protein, 11 aa, Influenza virus
HPATIGECPKY

SEQ ID NO: 526724 - protein, 11 aa, Influenza virus
HPFTIGECPKY

SEQ ID NO: 526725 - protein, 11 aa, Influenza virus
HPFTIGECPRY

SEQ ID NO: 526726 - protein, 11 aa, Influenza virus
HPGIFENSCIE

SEQ ID NO: 526727 - protein, 11 aa, Influenza virus
HPGIFENSCLE

SEQ ID NO: 526728 - protein, 11 aa, Influenza virus
HPGIFESSCLE

SEQ ID NO: 526729 - protein, 11 aa, Influenza virus
HPGIFGNSCLE

SEQ ID NO: 526730 - protein, 11 aa, Influenza virus
HPGLFENSCLE

SEQ ID NO: 526731 - protein, 11 aa, Influenza virus
HPITIGECPKY

SEQ ID NO: 526732 - protein, 11 aa, Influenza virus
HPLAIGECPKY

SEQ ID NO: 526733 - protein, 11 aa, Influenza virus
HPLTIGECPKY

SEQ ID NO: 526734 - protein, 11 aa, Influenza virus
HPLTIGECPRY

SEQ ID NO: 526735 - protein, 11 aa, Influenza virus
HPLTIGKCPKY

SEQ ID NO: 526736 - protein, 11 aa, Influenza virus
HPLTMGECPKY

SEQ ID NO: 526737 - protein, 11 aa, Influenza virus
HPNAGKDPKKT

SEQ ID NO: 526738 - protein, 11 aa, Influenza virus
HPRGLLEVGTR

SEQ ID NO: 526739 - protein, 11 aa, Influenza virus
HPSAGKDPKKT

SEQ ID NO: 526740 - protein, 11 aa, Influenza virus
HPSAGRDPKKT

SEQ ID NO: 526741 - protein, 11 aa, Influenza virus
HPSSAQEKNDL

SEQ ID NO: 526742 - protein, 11 aa, Influenza virus
HPSSDNEQTDL

SEQ ID NO: 526743 - protein, 11 aa, Influenza virus
HPSSTKEKNDL

SEQ ID NO: 526744 - protein, 11 aa, Influenza virus
HPSSTKEKNEL

SEQ ID NO: 526745 - protein, 11 aa, Influenza virus
HPSSTQEKNAL

SEQ ID NO: 526746 - protein, 11 aa, Influenza virus
HPSSTQEKNDL

SEQ ID NO: 526747 - protein, 11 aa, Influenza virus
HPSTGKDPKKT

SEQ ID NO: 526748 - protein, 11 aa, Influenza virus
HPVTIGECPKY

SEQ ID NO: 526749 - protein, 11 aa, Influenza virus
HPVTIGKCPKY

SEQ ID NO: 526750 - protein, 11 aa, Influenza virus
HQCDNNCIESI

SEQ ID NO: 526751 - protein, 11 aa, Influenza virus
HQGTTIRNKHS

SEQ ID NO: 526752 - protein, 11 aa, Influenza virus
HQGTTIRNRHS

SEQ ID NO: 526753 - protein, 11 aa, Influenza virus
HQIEKEFEQVE

SEQ ID NO: 526754 - protein, 11 aa, Influenza virus
HQIEKEFGQVE

SEQ ID NO: 526755 - protein, 11 aa, Influenza virus
HQIEKEFSEIE

SEQ ID NO: 526756 - protein, 11 aa, Influenza virus
HQIEKEFSEVE

SEQ ID NO: 526757 - protein, 11 aa, Influenza virus
HQIEKEFTEVE

SEQ ID NO: 526758 - protein, 11 aa, Influenza virus
HQIGNVINWTK

SEQ ID NO: 526759 - protein, 11 aa, Influenza virus
HQILAIYSTVA

SEQ ID NO: 526760 - protein, 11 aa, Influenza virus
HQLLRHFQKDA

SEQ ID NO: 526761 - protein, 11 aa, Influenza virus
HQLLRHFQKNA

SEQ ID NO: 526762 - protein, 11 aa, Influenza virus
HQLRDNAKELG

SEQ ID NO: 526763 - protein, 11 aa, Influenza virus
HQLRENAEDKG

SEQ ID NO: 526764 - protein, 11 aa, Influenza virus
HQNAEGIGIAA

SEQ ID NO: 526765 - protein, 11 aa, Influenza virus
HQNAEGTGIAA

SEQ ID NO: 526766 - protein, 11 aa, Influenza virus
HQNAEGTGMAA

SEQ ID NO: 526767 - protein, 11 aa, Influenza virus
HQNAEGTGTAA

SEQ ID NO: 526768 - protein, 11 aa, Influenza virus
HQNAQGEGIAA

SEQ ID NO: 526769 - protein, 11 aa, Influenza virus
HQNAQGEGTAA

SEQ ID NO: 526770 - protein, 11 aa, Influenza virus
HQNAQGIGQAA

SEQ ID NO: 526771 - protein, 11 aa, Influenza virus
HQNAQGQGTAA

SEQ ID NO: 526772 - protein, 11 aa, Influenza virus
HQNAQGSGYAA

SEQ ID NO: 526773 - protein, 11 aa, Influenza virus
HQNAQGTGQAA

SEQ ID NO: 526774 - protein, 11 aa, Influenza virus
HQNDQGTGQAA

SEQ ID NO: 526775 - protein, 11 aa, Influenza virus
HQNEQGMGMAA

SEQ ID NO: 526776 - protein, 11 aa, Influenza virus
HQNEQGSGYAA

SEQ ID NO: 526777 - protein, 11 aa, Influenza virus
HQNEQGTGIAA

SEQ ID NO: 526778 - protein, 11 aa, Influenza virus
HQNEQGVGIAA

SEQ ID NO: 526779 - protein, 11 aa, Influenza virus
HQNEQGVGMAA

SEQ ID NO: 526780 - protein, 11 aa, Influenza virus
HQNGQGSGYAA

SEQ ID NO: 526781 - protein, 11 aa, Influenza virus
HQNSEGTGIAA

SEQ ID NO: 526782 - protein, 11 aa, Influenza virus
HQNSEGTGIVA

SEQ ID NO: 526783 - protein, 11 aa, Influenza virus
HQNSEGTGTAA

SEQ ID NO: 526784 - protein, 11 aa, Influenza virus
HQNSQGEGTAA

SEQ ID NO: 526785 - protein, 11 aa, Influenza virus
HQNTQGEGTAA

SEQ ID NO: 526786 - protein, 11 aa, Influenza virus
HRCDDQCMESI

SEQ ID NO: 526787 - protein, 11 aa, Influenza virus
HRDEEGTGIAA

SEQ ID NO: 526788 - protein, 11 aa, Influenza virus
HRFEIIEGRDR

SEQ ID NO: 526789 - protein, 11 aa, Influenza virus
HRLCYPGELDN

SEQ ID NO: 526790 - protein, 11 aa, Influenza virus
HRLKITENSFE

SEQ ID NO: 526791 - protein, 11 aa, Influenza virus
HRNAIGDCPKY

SEQ ID NO: 526792 - protein, 11 aa, Influenza virus
HRNEEGTGIAA

SEQ ID NO: 526793 - protein, 11 aa, Influenza virus
HRNEEGTGVAA

SEQ ID NO: 526794 - protein, 11 aa, Influenza virus
HRNTFGDCPKY

SEQ ID NO: 526795 - protein, 11 aa, Influenza virus
HRNTIGDCPKY

SEQ ID NO: 526796 - protein, 11 aa, Influenza virus
HRNTIGNCPKY

SEQ ID NO: 526797 - protein, 11 aa, Influenza virus
HRTLLMNEIGV

SEQ ID NO: 526798 - protein, 11 aa, Influenza virus
HRTLLMNELGI

SEQ ID NO: 526799 - protein, 11 aa, Influenza virus
HRTLLMNELGV

SEQ ID NO: 526800 - protein, 11 aa, Influenza virus
HRTLLMSELGV

SEQ ID NO: 526801 - protein, 11 aa, Influenza virus
HSDNADKICLG

SEQ ID NO: 526802 - protein, 11 aa, Influenza virus
HSDTPRPADPS

SEQ ID NO: 526803 - protein, 11 aa, Influenza virus
HSDTPRPDDPS

SEQ ID NO: 526804 - protein, 11 aa, Influenza virus
HSDTPRPSDPS

SEQ ID NO: 526805 - protein, 11 aa, Influenza virus
HSDTPRPTDPS

SEQ ID NO: 526806 - protein, 11 aa, Influenza virus
HSDTPRPVDPS

SEQ ID NO: 526807 - protein, 11 aa, Influenza virus
HSEECSCYVDI

SEQ ID NO: 526808 - protein, 11 aa, Influenza virus
HSGICPVVFTD

SEQ ID NO: 526809 - protein, 11 aa, Influenza virus
HSGVCPVVFTD

SEQ ID NO: 526810 - protein, 11 aa, Influenza virus
HSKDNGIRIGS

SEQ ID NO: 526811 - protein, 11 aa, Influenza virus
HSKDNNIRIGS

SEQ ID NO: 526812 - protein, 11 aa, Influenza virus
HSKDNSIRIGS

SEQ ID NO: 526813 - protein, 11 aa, Influenza virus
HSKEQGSGYAA

SEQ ID NO: 526814 - protein, 11 aa, Influenza virus
HSMSDIEAMAS

SEQ ID NO: 526815 - protein, 11 aa, Influenza virus
HSMSGFRSNLP

SEQ ID NO: 526816 - protein, 11 aa, Influenza virus
HSNAEGTGMAA

SEQ ID NO: 526817 - protein, 11 aa, Influenza virus
HSNDQGAGYAA

SEQ ID NO: 526818 - protein, 11 aa, Influenza virus
HSNDQGSGYAA

SEQ ID NO: 526819 - protein, 11 aa, Influenza virus
HSNEQGSGYAA

SEQ ID NO: 526820 - protein, 11 aa, Influenza virus
HSNETVKDRSP

SEQ ID NO: 526821 - protein, 11 aa, Influenza virus
HSNGQGSGYAA

SEQ ID NO: 526822 - protein, 11 aa, Influenza virus
HSNGTAKDRSP

SEQ ID NO: 526823 - protein, 11 aa, Influenza virus
HSNGTIHDRAA

SEQ ID NO: 526824 - protein, 11 aa, Influenza virus
HSNGTIHDRSQ

SEQ ID NO: 526825 - protein, 11 aa, Influenza virus
HSNGTIHDRTA

SEQ ID NO: 526826 - protein, 11 aa, Influenza virus
HSNGTIHDRTT

SEQ ID NO: 526827 - protein, 11 aa, Influenza virus
HSNGTIKDRSP

SEQ ID NO: 526828 - protein, 11 aa, Influenza virus
HSNGTMKDRSP

SEQ ID NO: 526829 - protein, 11 aa, Influenza virus
HSNGTTHDRTA

SEQ ID NO: 526830 - protein, 11 aa, Influenza virus
HSNGTVKDRSP

SEQ ID NO: 526831 - protein, 11 aa, Influenza virus
HSNGTVNDRSP

SEQ ID NO: 526832 - protein, 11 aa, Influenza virus
HSNLNDATYQR

SEQ ID NO: 526833 - protein, 11 aa, Influenza virus
HSNLNDTTYQR

SEQ ID NO: 526834 - protein, 11 aa, Influenza virus
HSNNTVKDRSP

SEQ ID NO: 526835 - protein, 11 aa, Influenza virus
HSNSEGTGMAA

SEQ ID NO: 526836 - protein, 11 aa, Influenza virus
HSNSTTHDRTA

SEQ ID NO: 526837 - protein, 11 aa, Influenza virus
HSQYREEALLN

SEQ ID NO: 526838 - protein, 11 aa, Influenza virus
HSRGLFGAIAG

SEQ ID NO: 526839 - protein, 11 aa, Influenza virus
HSSGTVKDRSP

SEQ ID NO: 526840 - protein, 11 aa, Influenza virus
HSSSLDEQNKL

SEQ ID NO: 526841 - protein, 11 aa, Influenza virus
HSWIPKRNRSI

SEQ ID NO: 526842 - protein, 11 aa, Influenza virus
HSWTPKRNRSI

SEQ ID NO: 526843 - protein, 11 aa, Influenza virus
HSWVPILNTSQ

SEQ ID NO: 526844 - protein, 11 aa, Influenza virus
HSWVPKRNRSI

SEQ ID NO: 526845 - protein, 11 aa, Influenza virus
HTAYSQITNGT

SEQ ID NO: 526846 - protein, 11 aa, Influenza virus
HTDELCPSPLK

SEQ ID NO: 526847 - protein, 11 aa, Influenza virus
HTEYRQEALQN

SEQ ID NO: 526848 - protein, 11 aa, Influenza virus
HTGNPVICLGH

SEQ ID NO: 526849 - protein, 11 aa, Influenza virus
HTGSFCSIDGK

SEQ ID NO: 526850 - protein, 11 aa, Influenza virus
HTGSFCSINGK

SEQ ID NO: 526851 - protein, 11 aa, Influenza virus
HTGSFCSLDGK

SEQ ID NO: 526852 - protein, 11 aa, Influenza virus
HTGTFCSINGK

SEQ ID NO: 526853 - protein, 11 aa, Influenza virus
HTGTYCSLNGI

SEQ ID NO: 526854 - protein, 11 aa, Influenza virus
HTGTYCSLNGV

SEQ ID NO: 526855 - protein, 11 aa, Influenza virus
HTIDLADSEMD

SEQ ID NO: 526856 - protein, 11 aa, Influenza virus
HTIDLADSEML

SEQ ID NO: 526857 - protein, 11 aa, Influenza virus
HTIDLADSEMN

SEQ ID NO: 526858 - protein, 11 aa, Influenza virus
HTIDLADSEMS

SEQ ID NO: 526859 - protein, 11 aa, Influenza virus
HTIDLTDSEMN

SEQ ID NO: 526860 - protein, 11 aa, Influenza virus
HTIDLTDSEMS

SEQ ID NO: 526861 - protein, 11 aa, Influenza virus
HTIDLTNSEMN

SEQ ID NO: 526862 - protein, 11 aa, Influenza virus
HTIDMADSEML

SEQ ID NO: 526863 - protein, 11 aa, Influenza virus
HTIDMADSTML

SEQ ID NO: 526864 - protein, 11 aa, Influenza virus
HTIDMTDSEMN

SEQ ID NO: 526865 - protein, 11 aa, Influenza virus
HTIDSTDSEMN

SEQ ID NO: 526866 - protein, 11 aa, Influenza virus
HTIDVTDSEMD

SEQ ID NO: 526867 - protein, 11 aa, Influenza virus
HTIDVTDSEMN

SEQ ID NO: 526868 - protein, 11 aa, Influenza virus
HTIDVTDSEMS

SEQ ID NO: 526869 - protein, 11 aa, Influenza virus
HTIEMTDSEML

SEQ ID NO: 526870 - protein, 11 aa, Influenza virus
HTIHLTDSEMN

SEQ ID NO: 526871 - protein, 11 aa, Influenza virus
HTQYREEALLN

SEQ ID NO: 526872 - protein, 11 aa, Influenza virus
HTRGLFGAIAG

SEQ ID NO: 526873 - protein, 11 aa, Influenza virus
HTSQYICSPVL

SEQ ID NO: 526874 - protein, 11 aa, Influenza virus
HTSQYLCTGIL

SEQ ID NO: 526875 - protein, 11 aa, Influenza virus
HTSQYLCTGVL

SEQ ID NO: 526876 - protein, 11 aa, Influenza virus
HTSRYVCTGIL

SEQ ID NO: 526877 - protein, 11 aa, Influenza virus
HTTINNITNVV

SEQ ID NO: 526878 - protein, 11 aa, Influenza virus
HVCITGDDRNA

SEQ ID NO: 526879 - protein, 11 aa, Influenza virus
HVCVTGDDGNA

SEQ ID NO: 526880 - protein, 11 aa, Influenza virus
HVCVTGDDKNA

SEQ ID NO: 526881 - protein, 11 aa, Influenza virus
HVCVTGDDRNA

SEQ ID NO: 526882 - protein, 11 aa, Influenza virus
HVDTIMEKNVT

SEQ ID NO: 526883 - protein, 11 aa, Influenza virus
HVEECSCYPRF

SEQ ID NO: 526884 - protein, 11 aa, Influenza virus
HVEECSCYPRS

SEQ ID NO: 526885 - protein, 11 aa, Influenza virus
HVEECSCYPRY

SEQ ID NO: 526886 - protein, 11 aa, Influenza virus
HVEVVSAKELV

SEQ ID NO: 526887 - protein, 11 aa, Influenza virus
HVFIIREPFVS

SEQ ID NO: 526888 - protein, 11 aa, Influenza virus
HVFVIREPFIS

SEQ ID NO: 526889 - protein, 11 aa, Influenza virus
HVFVIREPFVA

SEQ ID NO: 526890 - protein, 11 aa, Influenza virus
HVFVIREPFVS

SEQ ID NO: 526891 - protein, 11 aa, Influenza virus
HVLVTREPYLS

SEQ ID NO: 526892 - protein, 11 aa, Influenza virus
HVRKRFADQEL

SEQ ID NO: 526893 - protein, 11 aa, Influenza virus
HVSPLSGSAQH

SEQ ID NO: 526894 - protein, 11 aa, Influenza virus
HWMLLDPGDTV

SEQ ID NO: 526895 - protein, 11 aa, Influenza virus
HWNLALDIVDS

SEQ ID NO: 526896 - protein, 11 aa, Influenza virus
HWPDGSNIGFM

SEQ ID NO: 526897 - protein, 11 aa, Influenza virus
HYEECSCYPDA

SEQ ID NO: 526898 - protein, 11 aa, Influenza virus
HYEECSCYPDS

SEQ ID NO: 526899 - protein, 11 aa, Influenza virus
HYEECSCYPNA

SEQ ID NO: 526900 - protein, 11 aa, Influenza virus
HYGGIPTDVVR

SEQ ID NO: 526901 - protein, 11 aa, Influenza virus
HYGGMPTDVVR

SEQ ID NO: 526902 - protein, 11 aa, Influenza virus
HYGGVPTDVIR

SEQ ID NO: 526903 - protein, 11 aa, Influenza virus
HYGGVPTDVMR

SEQ ID NO: 526904 - protein, 11 aa, Influenza virus
HYGGVPTDVVR

SEQ ID NO: 526905 - protein, 11 aa, Influenza virus
HYIGKCPKYIP

SEQ ID NO: 526906 - protein, 11 aa, Influenza virus
HYIGKCPKYIS

SEQ ID NO: 526907 - protein, 11 aa, Influenza virus
HYIGKCPRYIP

SEQ ID NO: 526908 - protein, 11 aa, Influenza virus
HYKISKSTKST

SEQ ID NO: 526909 - protein, 11 aa, Influenza virus
HYREEALLNRL

SEQ ID NO: 526910 - protein, 11 aa, Influenza virus
HYVCSGLVGDT

SEQ ID NO: 526911 - protein, 11 aa, Influenza virus
IAADKASTQKA

SEQ ID NO: 526912 - protein, 11 aa, Influenza virus
IAADKESTQKA

SEQ ID NO: 526913 - protein, 11 aa, Influenza virus
IAADKTSTQKA

SEQ ID NO: 526914 - protein, 11 aa, Influenza virus
IAADKVSTQKA

SEQ ID NO: 526915 - protein, 11 aa, Influenza virus
IAADYKSTQSA

SEQ ID NO: 526916 - protein, 11 aa, Influenza virus
IAAEKESTQKA

SEQ ID NO: 526917 - protein, 11 aa, Influenza virus
IAARNIVRRAA

SEQ ID NO: 526918 - protein, 11 aa, Influenza virus
IAARNIVRRAI

SEQ ID NO: 526919 - protein, 11 aa, Influenza virus
IAARNIVRRAT

SEQ ID NO: 526920 - protein, 11 aa, Influenza virus
IAARSIVRRAT

SEQ ID NO: 526921 - protein, 11 aa, Influenza virus
IAASYKRIRLF

SEQ ID NO: 526922 - protein, 11 aa, Influenza virus
IADAQHRSHRQ

SEQ ID NO: 526923 - protein, 11 aa, Influenza virus
IADKICIGYLS

SEQ ID NO: 526924 - protein, 11 aa, Influenza virus
IADRVDDAVTD

SEQ ID NO: 526925 - protein, 11 aa, Influenza virus
IADSHHRSHRQ

SEQ ID NO: 526926 - protein, 11 aa, Influenza virus
IADSQHKSHRQ

SEQ ID NO: 526927 - protein, 11 aa, Influenza virus
IADSQHRSHRQ

SEQ ID NO: 526928 - protein, 11 aa, Influenza virus
IAEQFTWNGVK

SEQ ID NO: 526929 - protein, 11 aa, Influenza virus
IAFCGTSGTYG

SEQ ID NO: 526930 - protein, 11 aa, Influenza virus
IAFCGVDSDTT

SEQ ID NO: 526931 - protein, 11 aa, Influenza virus
IAFCGVNSDTT

SEQ ID NO: 526932 - protein, 11 aa, Influenza virus
IAFLTSSIVCP

SEQ ID NO: 526933 - protein, 11 aa, Influenza virus
IAGFAPFSKDN

SEQ ID NO: 526934 - protein, 11 aa, Influenza virus
IAGFIEGGWCG

SEQ ID NO: 526935 - protein, 11 aa, Influenza virus
IAGFIEGGWPG

SEQ ID NO: 526936 - protein, 11 aa, Influenza virus
IAGFIEGGWQG

SEQ ID NO: 526937 - protein, 11 aa, Influenza virus
IAGFIEGGWSG

SEQ ID NO: 526938 - protein, 11 aa, Influenza virus
IAGFIEGGWTG

SEQ ID NO: 526939 - protein, 11 aa, Influenza virus
IAGFIEGRWPG

SEQ ID NO: 526940 - protein, 11 aa, Influenza virus
IAGFIENGWEG

SEQ ID NO: 526941 - protein, 11 aa, Influenza virus
IAGFIENGWQG

SEQ ID NO: 526942 - protein, 11 aa, Influenza virus
IAGGLILGMQN

SEQ ID NO: 526943 - protein, 11 aa, Influenza virus
IAGLFFWMCSN

SEQ ID NO: 526944 - protein, 11 aa, Influenza virus
IAGLSFWMCSN

SEQ ID NO: 526945 - protein, 11 aa, Influenza virus
IAGSSEQAAEA

SEQ ID NO: 526946 - protein, 11 aa, Influenza virus
IAGWILGNPEC

SEQ ID NO: 526947 - protein, 11 aa, Influenza virus
IAGWLLGNPEC

SEQ ID NO: 526948 - protein, 11 aa, Influenza virus
IAGWLLGNPKC

SEQ ID NO: 526949 - protein, 11 aa, Influenza virus
IAGWLLGNPMC

SEQ ID NO: 526950 - protein, 11 aa, Influenza virus
IAGWYGFQHSN

SEQ ID NO: 526951 - protein, 11 aa, Influenza virus
IAHISPLSGSA

SEQ ID NO: 526952 - protein, 11 aa, Influenza virus
IAHKSCLPACV

SEQ ID NO: 526953 - protein, 11 aa, Influenza virus
IAIALGIINLL

SEQ ID NO: 526954 - protein, 11 aa, Influenza virus
IAIGNCPKYVK

SEQ ID NO: 526955 - protein, 11 aa, Influenza virus
IAIGSVSRTIA

SEQ ID NO: 526956 - protein, 11 aa, Influenza virus
IAILAATVTLH

SEQ ID NO: 526957 - protein, 11 aa, Influenza virus
IAILATTITLH

SEQ ID NO: 526958 - protein, 11 aa, Influenza virus
IAILATTVTLH

SEQ ID NO: 526959 - protein, 11 aa, Influenza virus
IAILVTTVTLH

SEQ ID NO: 526960 - protein, 11 aa, Influenza virus
IAIVLGIINLL

SEQ ID NO: 526961 - protein, 11 aa, Influenza virus
IAKDNAIRFGE

SEQ ID NO: 526962 - protein, 11 aa, Influenza virus
IAKDNAVRFGE

SEQ ID NO: 526963 - protein, 11 aa, Influenza virus
IAKGEKANVLI

SEQ ID NO: 526964 - protein, 11 aa, Influenza virus
IALCGSPFPVG

SEQ ID NO: 526965 - protein, 11 aa, Influenza virus
IALCGSPFSVG

SEQ ID NO: 526966 - protein, 11 aa, Influenza virus
IALGIINLLIG

SEQ ID NO: 526967 - protein, 11 aa, Influenza virus
IALILVALALS

SEQ ID NO: 526968 - protein, 11 aa, Influenza virus
IALSILNLLIG

SEQ ID NO: 526969 - protein, 11 aa, Influenza virus
IALSVLNLLIG

SEQ ID NO: 526970 - protein, 11 aa, Influenza virus
IAMENQHTIDL

SEQ ID NO: 526971 - protein, 11 aa, Influenza virus
IAMENQHTIDM

SEQ ID NO: 526972 - protein, 11 aa, Influenza virus
IAMGLIFMCVK

SEQ ID NO: 526973 - protein, 11 aa, Influenza virus
IAPDRASFFKG

SEQ ID NO: 526974 - protein, 11 aa, Influenza virus
IAPDRASFFRG

SEQ ID NO: 526975 - protein, 11 aa, Influenza virus
IAPDRASFLRG

SEQ ID NO: 526976 - protein, 11 aa, Influenza virus
IAPDRATFLRS

SEQ ID NO: 526977 - protein, 11 aa, Influenza virus
IAPEFGYLLKG

SEQ ID NO: 526978 - protein, 11 aa, Influenza virus
IAPEFGYLLRG

SEQ ID NO: 526979 - protein, 11 aa, Influenza virus
IAPEYGFKISK

SEQ ID NO: 526980 - protein, 11 aa, Influenza virus
IAPEYGFKISR

SEQ ID NO: 526981 - protein, 11 aa, Influenza virus
IAPEYGFRISK

SEQ ID NO: 526982 - protein, 11 aa, Influenza virus
IAPEYGHLITG

SEQ ID NO: 526983 - protein, 11 aa, Influenza virus
IAPEYGHLTTG

SEQ ID NO: 526984 - protein, 11 aa, Influenza virus
IAPEYGHLVTG

SEQ ID NO: 526985 - protein, 11 aa, Influenza virus
IAPEYGYLITG

SEQ ID NO: 526986 - protein, 11 aa, Influenza virus
IAPIMFSNKMA

SEQ ID NO: 526987 - protein, 11 aa, Influenza virus
IAPIMFSNKVA

SEQ ID NO: 526988 - protein, 11 aa, Influenza virus
IAPLMMAYMLE

SEQ ID NO: 526989 - protein, 11 aa, Influenza virus
IAPLMVAYMLE

SEQ ID NO: 526990 - protein, 11 aa, Influenza virus
IAPNRASFFRG

SEQ ID NO: 526991 - protein, 11 aa, Influenza virus
IAPRGHYKISK

SEQ ID NO: 526992 - protein, 11 aa, Influenza virus
IAPRYGYIIEK

SEQ ID NO: 526993 - protein, 11 aa, Influenza virus
IAQDNAIRFGE

SEQ ID NO: 526994 - protein, 11 aa, Influenza virus
IAQKLEDVFAG

SEQ ID NO: 526995 - protein, 11 aa, Influenza virus
IAQRLEDVFAG

SEQ ID NO: 526996 - protein, 11 aa, Influenza virus
IAQRLEGVFAG

SEQ ID NO: 526997 - protein, 11 aa, Influenza virus
IAQRLENVFAG

SEQ ID NO: 526998 - protein, 11 aa, Influenza virus
IAQRLESVFAG

SEQ ID NO: 526999 - protein, 11 aa, Influenza virus
IASDILKRMSK

SEQ ID NO: 527000 - protein, 11 aa, Influenza virus
IASDILTRMSK

SEQ ID NO: 527001 - protein, 11 aa, Influenza virus
IASKDNGIRIG

SEQ ID NO: 527002 - protein, 11 aa, Influenza virus
IASRSGYEILK

SEQ ID NO: 527003 - protein, 11 aa, Influenza virus
IASRSGYEMLK

SEQ ID NO: 527004 - protein, 11 aa, Influenza virus
IASSIVLVGLI

SEQ ID NO: 527005 - protein, 11 aa, Influenza virus
IASSIVMVGLI

SEQ ID NO: 527006 - protein, 11 aa, Influenza virus
IASSLPFQNIN

SEQ ID NO: 527007 - protein, 11 aa, Influenza virus
IASSTVLVGLI

SEQ ID NO: 527008 - protein, 11 aa, Influenza virus
IASSTVMVGLI

SEQ ID NO: 527009 - protein, 11 aa, Influenza virus
IASSVVLVGLI

SEQ ID NO: 527010 - protein, 11 aa, Influenza virus
IASSVVLVGPI

SEQ ID NO: 527011 - protein, 11 aa, Influenza virus
IASTTAKAMEQ

SEQ ID NO: 527012 - protein, 11 aa, Influenza virus
IASVPASRYLI

SEQ ID NO: 527013 - protein, 11 aa, Influenza virus
IASVPASRYLT

SEQ ID NO: 527014 - protein, 11 aa, Influenza virus
IASWAGNILRT

SEQ ID NO: 527015 - protein, 11 aa, Influenza virus
IATPGMQIRGF

SEQ ID NO: 527016 - protein, 11 aa, Influenza virus
IAVFCGTSGTY

SEQ ID NO: 527017 - protein, 11 aa, Influenza virus
IAWSATACHDG

SEQ ID NO: 527018 - protein, 11 aa, Influenza virus
IAWSRSSCHDG

SEQ ID NO: 527019 - protein, 11 aa, Influenza virus
IAWSSASCHDG

SEQ ID NO: 527020 - protein, 11 aa, Influenza virus
IAWSSSSCFDG

SEQ ID NO: 527021 - protein, 11 aa, Influenza virus
IAWSSSSCHDG

SEQ ID NO: 527022 - protein, 11 aa, Influenza virus
IAWSSSSCYDG

SEQ ID NO: 527023 - protein, 11 aa, Influenza virus
IAYERMCNILK

SEQ ID NO: 527024 - protein, 11 aa, Influenza virus
ICATCEQIADS

SEQ ID NO: 527025 - protein, 11 aa, Influenza virus
ICAVATTHSWV

SEQ ID NO: 527026 - protein, 11 aa, Influenza virus
ICAVVMTDGSA

SEQ ID NO: 527027 - protein, 11 aa, Influenza virus
ICEKLEQSGLP

SEQ ID NO: 527028 - protein, 11 aa, Influenza virus
ICFMYSDFHFI

SEQ ID NO: 527029 - protein, 11 aa, Influenza virus
ICIAWSSSSCF

SEQ ID NO: 527030 - protein, 11 aa, Influenza virus
ICIDFRDMRKN

SEQ ID NO: 527031 - protein, 11 aa, Influenza virus
ICIGHHANNST

SEQ ID NO: 527032 - protein, 11 aa, Influenza virus
ICIGYHANKST

SEQ ID NO: 527033 - protein, 11 aa, Influenza virus
ICIGYHANNSK

SEQ ID NO: 527034 - protein, 11 aa, Influenza virus
ICIGYHANNST

SEQ ID NO: 527035 - protein, 11 aa, Influenza virus
ICIGYHSNNST

SEQ ID NO: 527036 - protein, 11 aa, Influenza virus
ICIGYLSNNAT

SEQ ID NO: 527037 - protein, 11 aa, Influenza virus
ICIGYLSNNSS

SEQ ID NO: 527038 - protein, 11 aa, Influenza virus
ICIGYLSNNST

SEQ ID NO: 527039 - protein, 11 aa, Influenza virus
ICIGYLSTNSS

SEQ ID NO: 527040 - protein, 11 aa, Influenza virus
ICIGYMSNNST

SEQ ID NO: 527041 - protein, 11 aa, Influenza virus
ICIGYQSNNST

SEQ ID NO: 527042 - protein, 11 aa, Influenza virus
ICIGYQTNNST

SEQ ID NO: 527043 - protein, 11 aa, Influenza virus
ICIKDGNMRCT

SEQ ID NO: 527044 - protein, 11 aa, Influenza virus
ICIKICESRLR

SEQ ID NO: 527045 - protein, 11 aa, Influenza virus
ICIKNGNMQCT

SEQ ID NO: 527046 - protein, 11 aa, Influenza virus
ICIKNGNMRCT

SEQ ID NO: 527047 - protein, 11 aa, Influenza virus
ICIKNGNVRCT

SEQ ID NO: 527048 - protein, 11 aa, Influenza virus
ICILDQNFRNI

SEQ ID NO: 527049 - protein, 11 aa, Influenza virus
ICIQGNNDNAT

SEQ ID NO: 527050 - protein, 11 aa, Influenza virus
ICIRFVNSDCS

SEQ ID NO: 527051 - protein, 11 aa, Influenza virus
ICISGPNNNAS

SEQ ID NO: 527052 - protein, 11 aa, Influenza virus
ICKAAIGLRIS

SEQ ID NO: 527053 - protein, 11 aa, Influenza virus
ICKAALGLRIS

SEQ ID NO: 527054 - protein, 11 aa, Influenza virus
ICKAAMGLKIS

SEQ ID NO: 527055 - protein, 11 aa, Influenza virus
ICKAAMGLRIS

SEQ ID NO: 527056 - protein, 11 aa, Influenza virus
ICKAAMGMRIS

SEQ ID NO: 527057 - protein, 11 aa, Influenza virus
ICKDNWKGSNR

SEQ ID NO: 527058 - protein, 11 aa, Influenza virus
ICKLVGINMSK

SEQ ID NO: 527059 - protein, 11 aa, Influenza virus
ICKPYIGKCPK

SEQ ID NO: 527060 - protein, 11 aa, Influenza virus
ICLGHHAVANG

SEQ ID NO: 527061 - protein, 11 aa, Influenza virus
ICLGHHAVENG

SEQ ID NO: 527062 - protein, 11 aa, Influenza virus
ICLGHHAVPNG

SEQ ID NO: 527063 - protein, 11 aa, Influenza virus
ICLGHHAVSNG

SEQ ID NO: 527064 - protein, 11 aa, Influenza virus
ICLGHHAVTNG

SEQ ID NO: 527065 - protein, 11 aa, Influenza virus
ICMSGPNDNAS

SEQ ID NO: 527066 - protein, 11 aa, Influenza virus
ICMSGPNNNAS

SEQ ID NO: 527067 - protein, 11 aa, Influenza virus
ICNSNAITRSG

SEQ ID NO: 527068 - protein, 11 aa, Influenza virus
ICPVVFTDGSA

SEQ ID NO: 527069 - protein, 11 aa, Influenza virus
ICPVVMTDGPA

SEQ ID NO: 527070 - protein, 11 aa, Influenza virus
ICQMEKIVLLF

SEQ ID NO: 527071 - protein, 11 aa, Influenza virus
ICRDNWKGANR

SEQ ID NO: 527072 - protein, 11 aa, Influenza virus
ICRDNWKGSNR

SEQ ID NO: 527073 - protein, 11 aa, Influenza virus
ICRDNWRGANR

SEQ ID NO: 527074 - protein, 11 aa, Influenza virus
ICRDNWRGSNR

SEQ ID NO: 527075 - protein, 11 aa, Influenza virus
ICRDNWTGTNR

SEQ ID NO: 527076 - protein, 11 aa, Influenza virus
ICSCIASSLVL

SEQ ID NO: 527077 - protein, 11 aa, Influenza virus
ICSGFFGDNPR

SEQ ID NO: 527078 - protein, 11 aa, Influenza virus
ICSGIFGDNPR

SEQ ID NO: 527079 - protein, 11 aa, Influenza virus
ICSGLVGDTPR

SEQ ID NO: 527080 - protein, 11 aa, Influenza virus
ICSGVFGDNPR

SEQ ID NO: 527081 - protein, 11 aa, Influenza virus
ICSGVFGDSPR

SEQ ID NO: 527082 - protein, 11 aa, Influenza virus
ICSGVFGDTPR

SEQ ID NO: 527083 - protein, 11 aa, Influenza virus
ICSGVLGDNPR

SEQ ID NO: 527084 - protein, 11 aa, Influenza virus
ICSKFHSDTPR

SEQ ID NO: 527085 - protein, 11 aa, Influenza virus
ICSPVLTDNPR

SEQ ID NO: 527086 - protein, 11 aa, Influenza virus
ICTCRDNWQGS

SEQ ID NO: 527087 - protein, 11 aa, Influenza virus
ICTGILTDTSR

SEQ ID NO: 527088 - protein, 11 aa, Influenza virus
ICTGVLTDTSR

SEQ ID NO: 527089 - protein, 11 aa, Influenza virus
ICTHLEICFMY

SEQ ID NO: 527090 - protein, 11 aa, Influenza virus
ICTHLEVCFMY

SEQ ID NO: 527091 - protein, 11 aa, Influenza virus
ICTHMEVCFMY

SEQ ID NO: 527092 - protein, 11 aa, Influenza virus
ICTVVMTDGSA

SEQ ID NO: 527093 - protein, 11 aa, Influenza virus
ICVAWSSSSCF

SEQ ID NO: 527094 - protein, 11 aa, Influenza virus
ICVAWSSTSCF

SEQ ID NO: 527095 - protein, 11 aa, Influenza virus
ICVCRDNWHGS

SEQ ID NO: 527096 - protein, 11 aa, Influenza virus
ICVGWSSTSCH

SEQ ID NO: 527097 - protein, 11 aa, Influenza virus
ICVGWSSTTCH

SEQ ID NO: 527098 - protein, 11 aa, Influenza virus
ICVGYHANNST

SEQ ID NO: 527099 - protein, 11 aa, Influenza virus
ICVGYHSNNST

SEQ ID NO: 527100 - protein, 11 aa, Influenza virus
ICVGYLSTNSS

SEQ ID NO: 527101 - protein, 11 aa, Influenza virus
ICVGYLSTNST

SEQ ID NO: 527102 - protein, 11 aa, Influenza virus
ICVKNGNHAVH

SEQ ID NO: 527103 - protein, 11 aa, Influenza virus
ICVKNGNMQCT

SEQ ID NO: 527104 - protein, 11 aa, Influenza virus
ICVKNGNMRCT

SEQ ID NO: 527105 - protein, 11 aa, Influenza virus
ICVQGNNDNAT

SEQ ID NO: 527106 - protein, 11 aa, Influenza virus
ICVQGNNKNAT

SEQ ID NO: 527107 - protein, 11 aa, Influenza virus
ICVQGNNNNAT

SEQ ID NO: 527108 - protein, 11 aa, Influenza virus
ICVSGPNNNAS

SEQ ID NO: 527109 - protein, 11 aa, Influenza virus
ICVTGDDRNAT

SEQ ID NO: 527110 - protein, 11 aa, Influenza virus
ICVVAVTDGPA

SEQ ID NO: 527111 - protein, 11 aa, Influenza virus
ICYPGKFTNEE

SEQ ID NO: 527112 - protein, 11 aa, Influenza virus
ICYPGRFTNEE

SEQ ID NO: 527113 - protein, 11 aa, Influenza virus
ICYPGSIENQE

SEQ ID NO: 527114 - protein, 11 aa, Influenza virus
ICYPGSVENQE

SEQ ID NO: 527115 - protein, 11 aa, Influenza virus
IDAGDGCFEIL

SEQ ID NO: 527116 - protein, 11 aa, Influenza virus
IDAGNGCFDIL

SEQ ID NO: 527117 - protein, 11 aa, Influenza virus
IDALLGDPHCD

SEQ ID NO: 527118 - protein, 11 aa, Influenza virus
IDALLGDPQCD

SEQ ID NO: 527119 - protein, 11 aa, Influenza virus
IDARIDFESGR

SEQ ID NO: 527120 - protein, 11 aa, Influenza virus
IDARVDFESGR

SEQ ID NO: 527121 - protein, 11 aa, Influenza virus
IDAVKLSSGYK

SEQ ID NO: 527122 - protein, 11 aa, Influenza virus
IDDAVTDIWSY

SEQ ID NO: 527123 - protein, 11 aa, Influenza virus
IDDAVTDVWSY

SEQ ID NO: 527124 - protein, 11 aa, Influenza virus
IDDQIEDLWAY

SEQ ID NO: 527125 - protein, 11 aa, Influenza virus
IDDQIEELWAY

SEQ ID NO: 527126 - protein, 11 aa, Influenza virus
IDDQIEGLWAY

SEQ ID NO: 527127 - protein, 11 aa, Influenza virus
IDDQIENLWAY

SEQ ID NO: 527128 - protein, 11 aa, Influenza virus
IDDQIIDIWAY

SEQ ID NO: 527129 - protein, 11 aa, Influenza virus
IDDQITDIWAY

SEQ ID NO: 527130 - protein, 11 aa, Influenza virus
IDDQVTDIWAY

SEQ ID NO: 527131 - protein, 11 aa, Influenza virus
IDECRTFFLTQ

SEQ ID NO: 527132 - protein, 11 aa, Influenza virus
IDEESRARIKT

SEQ ID NO: 527133 - protein, 11 aa, Influenza virus
IDEGDGCFNFF

SEQ ID NO: 527134 - protein, 11 aa, Influenza virus
IDEGDGCFNLL

SEQ ID NO: 527135 - protein, 11 aa, Influenza virus
IDEGDGCFSIL

SEQ ID NO: 527136 - protein, 11 aa, Influenza virus
IDEGDGCFSLL

SEQ ID NO: 527137 - protein, 11 aa, Influenza virus
IDEGNGCFELL

SEQ ID NO: 527138 - protein, 11 aa, Influenza virus
IDEITTKINNI

SEQ ID NO: 527139 - protein, 11 aa, Influenza virus
IDESCEGECFY

SEQ ID NO: 527140 - protein, 11 aa, Influenza virus
IDFHWMLLDPG

SEQ ID NO: 527141 - protein, 11 aa, Influenza virus
IDFRDMRKNTL

SEQ ID NO: 527142 - protein, 11 aa, Influenza virus
IDGFEPNGCIE

SEQ ID NO: 527143 - protein, 11 aa, Influenza virus
IDGITNKINSI

SEQ ID NO: 527144 - protein, 11 aa, Influenza virus
IDGITNKVNSI

SEQ ID NO: 527145 - protein, 11 aa, Influenza virus
IDGVTNKVNSI

SEQ ID NO: 527146 - protein, 11 aa, Influenza virus
IDGWTTANSKS

SEQ ID NO: 527147 - protein, 11 aa, Influenza virus
IDGWYGFHHSN

SEQ ID NO: 527148 - protein, 11 aa, Influenza virus
IDGWYGFKHQN

SEQ ID NO: 527149 - protein, 11 aa, Influenza virus
IDGWYGFRHQN

SEQ ID NO: 527150 - protein, 11 aa, Influenza virus
IDGWYGYHHEN

SEQ ID NO: 527151 - protein, 11 aa, Influenza virus
IDGWYGYHHQN

SEQ ID NO: 527152 - protein, 11 aa, Influenza virus
IDGWYGYHHSN

SEQ ID NO: 527153 - protein, 11 aa, Influenza virus
IDGWYGYKHQN

SEQ ID NO: 527154 - protein, 11 aa, Influenza virus
IDGWYGYRHQN

SEQ ID NO: 527155 - protein, 11 aa, Influenza virus
IDIMQNKLNNV

SEQ ID NO: 527156 - protein, 11 aa, Influenza virus
IDIWAYNAELL

SEQ ID NO: 527157 - protein, 11 aa, Influenza virus
IDIWTYNAELL

SEQ ID NO: 527158 - protein, 11 aa, Influenza virus
IDIYCICRDNW

SEQ ID NO: 527159 - protein, 11 aa, Influenza virus
IDKEPMGFRYS

SEQ ID NO: 527160 - protein, 11 aa, Influenza virus
IDKESMGFRYS

SEQ ID NO: 527161 - protein, 11 aa, Influenza virus
IDKICLGHHAV

SEQ ID NO: 527162 - protein, 11 aa, Influenza virus
IDKINGKLNRL

SEQ ID NO: 527163 - protein, 11 aa, Influenza virus
IDKITNKINNI

SEQ ID NO: 527164 - protein, 11 aa, Influenza virus
IDKITNKVNNI

SEQ ID NO: 527165 - protein, 11 aa, Influenza virus
IDKMNGNYDSI

SEQ ID NO: 527166 - protein, 11 aa, Influenza virus
IDKNALGDCPK

SEQ ID NO: 527167 - protein, 11 aa, Influenza virus
IDKNALGECPK

SEQ ID NO: 527168 - protein, 11 aa, Influenza virus
IDKTNQQFELI

SEQ ID NO: 527169 - protein, 11 aa, Influenza virus
IDKTNQQFEMI

SEQ ID NO: 527170 - protein, 11 aa, Influenza virus
IDKVCTKGKKA

SEQ ID NO: 527171 - protein, 11 aa, Influenza virus
IDLADSEMDKL

SEQ ID NO: 527172 - protein, 11 aa, Influenza virus
IDLADSEMKKL

SEQ ID NO: 527173 - protein, 11 aa, Influenza virus
IDLADSEMLNL

SEQ ID NO: 527174 - protein, 11 aa, Influenza virus
IDLADSEMNKL

SEQ ID NO: 527175 - protein, 11 aa, Influenza virus
IDLADSEMNNL

SEQ ID NO: 527176 - protein, 11 aa, Influenza virus
IDLADSEMSKL

SEQ ID NO: 527177 - protein, 11 aa, Influenza virus
IDLAESEMNKL

SEQ ID NO: 527178 - protein, 11 aa, Influenza virus
IDLANSEMNKL

SEQ ID NO: 527179 - protein, 11 aa, Influenza virus
IDLTDSEMNKL

SEQ ID NO: 527180 - protein, 11 aa, Influenza virus
IDLTDSEMSKL

SEQ ID NO: 527181 - protein, 11 aa, Influenza virus
IDLTNSEMNKL

SEQ ID NO: 527182 - protein, 11 aa, Influenza virus
IDLVETNHTGT

SEQ ID NO: 527183 - protein, 11 aa, Influenza virus
IDLWSYNADVL

SEQ ID NO: 527184 - protein, 11 aa, Influenza virus
IDLWSYNAELL

SEQ ID NO: 527185 - protein, 11 aa, Influenza virus
IDLWSYNAGLL

SEQ ID NO: 527186 - protein, 11 aa, Influenza virus
IDMADSEMLNL

SEQ ID NO: 527187 - protein, 11 aa, Influenza virus
IDNDNWSGYSG

SEQ ID NO: 527188 - protein, 11 aa, Influenza virus
IDNEFTEVEQQ

SEQ ID NO: 527189 - protein, 11 aa, Influenza virus
IDNGDGCFEIL

SEQ ID NO: 527190 - protein, 11 aa, Influenza virus
IDNMQNKLNNV

SEQ ID NO: 527191 - protein, 11 aa, Influenza virus
IDNMQNRLNNV

SEQ ID NO: 527192 - protein, 11 aa, Influenza virus
IDNNNWSGYSG

SEQ ID NO: 527193 - protein, 11 aa, Influenza virus
IDPKGLFGAIA

SEQ ID NO: 527194 - protein, 11 aa, Influenza virus
IDPVELSSGYK

SEQ ID NO: 527195 - protein, 11 aa, Influenza virus
IDPVKLSGGYK

SEQ ID NO: 527196 - protein, 11 aa, Influenza virus
IDPVKLSSGYK

SEQ ID NO: 527197 - protein, 11 aa, Influenza virus
IDQINGKLNRL

SEQ ID NO: 527198 - protein, 11 aa, Influenza virus
IDQITGKLNRL

SEQ ID NO: 527199 - protein, 11 aa, Influenza virus
IDQITRKLNRL

SEQ ID NO: 527200 - protein, 11 aa, Influenza virus
IDQITTKINNI

SEQ ID NO: 527201 - protein, 11 aa, Influenza virus
IDQSLIIAARN

SEQ ID NO: 527202 - protein, 11 aa, Influenza virus
IDQSLIIAARS

SEQ ID NO: 527203 - protein, 11 aa, Influenza virus
IDQVKLSSGYK

SEQ ID NO: 527204 - protein, 11 aa, Influenza virus
IDQVTGKLNRL

SEQ ID NO: 527205 - protein, 11 aa, Influenza virus
IDRITTKINNI

SEQ ID NO: 527206 - protein, 11 aa, Influenza virus
IDRNAIGDCPK

SEQ ID NO: 527207 - protein, 11 aa, Influenza virus
IDRNALGDCPK

SEQ ID NO: 527208 - protein, 11 aa, Influenza virus
IDRSFRPNIGP

SEQ ID NO: 527209 - protein, 11 aa, Influenza virus
IDRTNHQFELI

SEQ ID NO: 527210 - protein, 11 aa, Influenza virus
IDSGYVCSGLV

SEQ ID NO: 527211 - protein, 11 aa, Influenza virus
IDSIGSWSQNI

SEQ ID NO: 527212 - protein, 11 aa, Influenza virus
IDSLLGDPHCD

SEQ ID NO: 527213 - protein, 11 aa, Influenza virus
IDSNYVCSGLV

SEQ ID NO: 527214 - protein, 11 aa, Influenza virus
IDSRAVGKCPR

SEQ ID NO: 527215 - protein, 11 aa, Influenza virus
IDSSYICSGLV

SEQ ID NO: 527216 - protein, 11 aa, Influenza virus
IDSSYLCSGLV

SEQ ID NO: 527217 - protein, 11 aa, Influenza virus
IDSSYVCSGLV

SEQ ID NO: 527218 - protein, 11 aa, Influenza virus
IDSVKLSSGYK

SEQ ID NO: 527219 - protein, 11 aa, Influenza virus
IDSWAVGRCPR

SEQ ID NO: 527220 - protein, 11 aa, Influenza virus
IDTGDGCFEIL

SEQ ID NO: 527221 - protein, 11 aa, Influenza virus
IDTGKGCFDIL

SEQ ID NO: 527222 - protein, 11 aa, Influenza virus
IDTGNGCFDIL

SEQ ID NO: 527223 - protein, 11 aa, Influenza virus
IDTIMEKNVTV

SEQ ID NO: 527224 - protein, 11 aa, Influenza virus
IDTLTETGVPV

SEQ ID NO: 527225 - protein, 11 aa, Influenza virus
IDTNKTFQNID

SEQ ID NO: 527226 - protein, 11 aa, Influenza virus
IDVTDSEMNKL

SEQ ID NO: 527227 - protein, 11 aa, Influenza virus
IDVWTYNAELL

SEQ ID NO: 527228 - protein, 11 aa, Influenza virus
IDVYCICRDNW

SEQ ID NO: 527229 - protein, 11 aa, Influenza virus
IDVYCVCRDNW

SEQ ID NO: 527230 - protein, 11 aa, Influenza virus
IDWTRDSVTEL

SEQ ID NO: 527231 - protein, 11 aa, Influenza virus
IEAESSIKEKD

SEQ ID NO: 527232 - protein, 11 aa, Influenza virus
IEAESSVKEKD

SEQ ID NO: 527233 - protein, 11 aa, Influenza virus
IEAESSVREKD

SEQ ID NO: 527234 - protein, 11 aa, Influenza virus
IEAMASQGTKR

SEQ ID NO: 527235 - protein, 11 aa, Influenza virus
IEAMATQGTKR

SEQ ID NO: 527236 - protein, 11 aa, Influenza virus
IEARGLFGAIA

SEQ ID NO: 527237 - protein, 11 aa, Influenza virus
IEAVIYGNPKC

SEQ ID NO: 527238 - protein, 11 aa, Influenza virus
IECIGWSSTSC

SEQ ID NO: 527239 - protein, 11 aa, Influenza virus
IECVCRDNWRG

SEQ ID NO: 527240 - protein, 11 aa, Influenza virus
IECVGWSSTSC

SEQ ID NO: 527241 - protein, 11 aa, Influenza virus
IEDLIFLARSA

SEQ ID NO: 527242 - protein, 11 aa, Influenza virus
IEDLIFLTRSA

SEQ ID NO: 527243 - protein, 11 aa, Influenza virus
IEDLIFMARSA

SEQ ID NO: 527244 - protein, 11 aa, Influenza virus
IEDLIFSARSA

SEQ ID NO: 527245 - protein, 11 aa, Influenza virus
IEDLTFLARSA

SEQ ID NO: 527246 - protein, 11 aa, Influenza virus
IEDLWAYNAEL

SEQ ID NO: 527247 - protein, 11 aa, Influenza virus
IEDPAAPHGLC

SEQ ID NO: 527248 - protein, 11 aa, Influenza virus
IEDPDHEGEGI

SEQ ID NO: 527249 - protein, 11 aa, Influenza virus
IEDPGAPHGLC

SEQ ID NO: 527250 - protein, 11 aa, Influenza virus
IEDPNAPHKLC

SEQ ID NO: 527251 - protein, 11 aa, Influenza virus
IEDPNAPNKFC

SEQ ID NO: 527252 - protein, 11 aa, Influenza virus
IEDPNAPNKLC

SEQ ID NO: 527253 - protein, 11 aa, Influenza virus
IEDPNHEGEGI

SEQ ID NO: 527254 - protein, 11 aa, Influenza virus
IEDPSAPHGLC

SEQ ID NO: 527255 - protein, 11 aa, Influenza virus
IEDPSAPHRLC

SEQ ID NO: 527256 - protein, 11 aa, Influenza virus
IEDPSHEGEGI

SEQ ID NO: 527257 - protein, 11 aa, Influenza virus
IEDPTAPHGLC

SEQ ID NO: 527258 - protein, 11 aa, Influenza virus
IEDQITDIWAY

SEQ ID NO: 527259 - protein, 11 aa, Influenza virus
IEECLINDPWV

SEQ ID NO: 527260 - protein, 11 aa, Influenza virus
IEECPCYGHNS

SEQ ID NO: 527261 - protein, 11 aa, Influenza virus
IEECSCYGHDS

SEQ ID NO: 527262 - protein, 11 aa, Influenza virus
IEECSCYGHNQ

SEQ ID NO: 527263 - protein, 11 aa, Influenza virus
IEECSCYGHNS

SEQ ID NO: 527264 - protein, 11 aa, Influenza virus
IEECSCYGHSQ

SEQ ID NO: 527265 - protein, 11 aa, Influenza virus
IEECSCYPNDG

SEQ ID NO: 527266 - protein, 11 aa, Influenza virus
IEECSCYPNEG

SEQ ID NO: 527267 - protein, 11 aa, Influenza virus
IEECSCYPNLG

SEQ ID NO: 527268 - protein, 11 aa, Influenza virus
IEECSCYPNMG

SEQ ID NO: 527269 - protein, 11 aa, Influenza virus
IEECSCYPNNG

SEQ ID NO: 527270 - protein, 11 aa, Influenza virus
IEECSCYPNSG

SEQ ID NO: 527271 - protein, 11 aa, Influenza virus
IEECSCYPQYP

SEQ ID NO: 527272 - protein, 11 aa, Influenza virus
IEECSCYPRYP

SEQ ID NO: 527273 - protein, 11 aa, Influenza virus
IEEGSIGKVCR

SEQ ID NO: 527274 - protein, 11 aa, Influenza virus
IEEGSVYPRFL

SEQ ID NO: 527275 - protein, 11 aa, Influenza virus
IEELRRQKSLI

SEQ ID NO: 527276 - protein, 11 aa, Influenza virus
IEELRRQKWWV

SEQ ID NO: 527277 - protein, 11 aa, Influenza virus
IEELWAYNAEL

SEQ ID NO: 527278 - protein, 11 aa, Influenza virus
IEEPSHEGEGI

SEQ ID NO: 527279 - protein, 11 aa, Influenza virus
IEEYGKGRIFQ

SEQ ID NO: 527280 - protein, 11 aa, Influenza virus
IEEYGRGRIFQ

SEQ ID NO: 527281 - protein, 11 aa, Influenza virus
IEFEPFQSLVP

SEQ ID NO: 527282 - protein, 11 aa, Influenza virus
IEGGWCGMIDG

SEQ ID NO: 527283 - protein, 11 aa, Influenza virus
IEGGWPGLING

SEQ ID NO: 527284 - protein, 11 aa, Influenza virus
IEGGWPGLVAG

SEQ ID NO: 527285 - protein, 11 aa, Influenza virus
IEGGWQGLVDG

SEQ ID NO: 527286 - protein, 11 aa, Influenza virus
IEGGWQGMIDG

SEQ ID NO: 527287 - protein, 11 aa, Influenza virus
IEGGWQGMVDG

SEQ ID NO: 527288 - protein, 11 aa, Influenza virus
IEGGWSGLIAG

SEQ ID NO: 527289 - protein, 11 aa, Influenza virus
IEGGWSGLVAG

SEQ ID NO: 527290 - protein, 11 aa, Influenza virus
IEGGWSGLVDG

SEQ ID NO: 527291 - protein, 11 aa, Influenza virus
IEGGWSGMIDG

SEQ ID NO: 527292 - protein, 11 aa, Influenza virus
IEGGWTGLIDG

SEQ ID NO: 527293 - protein, 11 aa, Influenza virus
IEGGWTGMIDG

SEQ ID NO: 527294 - protein, 11 aa, Influenza virus
IEGGWTGMIEG

SEQ ID NO: 527295 - protein, 11 aa, Influenza virus
IEGGWTGMVDG

SEQ ID NO: 527296 - protein, 11 aa, Influenza virus
IEGGWTGMVNG

SEQ ID NO: 527297 - protein, 11 aa, Influenza virus
IEGICYPGSIE

SEQ ID NO: 527298 - protein, 11 aa, Influenza virus
IEGIKLKSEDN

SEQ ID NO: 527299 - protein, 11 aa, Influenza virus
IEGIKLKTEDN

SEQ ID NO: 527300 - protein, 11 aa, Influenza virus
IEGLWAYNAEL

SEQ ID NO: 527301 - protein, 11 aa, Influenza virus
IEGRIQDLEKY

SEQ ID NO: 527302 - protein, 11 aa, Influenza virus
IEGRWPGLVAG

SEQ ID NO: 527303 - protein, 11 aa, Influenza virus
IEGWVVVAKDN

SEQ ID NO: 527304 - protein, 11 aa, Influenza virus
IEHQIGNVINW

SEQ ID NO: 527305 - protein, 11 aa, Influenza virus
IEIITIGSICM

SEQ ID NO: 527306 - protein, 11 aa, Influenza virus
IEIMASQGTKR

SEQ ID NO: 527307 - protein, 11 aa, Influenza virus
IEIPSWAGNIL

SEQ ID NO: 527308 - protein, 11 aa, Influenza virus
IEIWSYNAEFL

SEQ ID NO: 527309 - protein, 11 aa, Influenza virus
IEKDNAVRFGE

SEQ ID NO: 527310 - protein, 11 aa, Influenza virus
IEKEFEQVEGR

SEQ ID NO: 527311 - protein, 11 aa, Influenza virus
IEKEFGQVEGR

SEQ ID NO: 527312 - protein, 11 aa, Influenza virus
IEKEFSEIEGR

SEQ ID NO: 527313 - protein, 11 aa, Influenza virus
IEKEFSEVEGR

SEQ ID NO: 527314 - protein, 11 aa, Influenza virus
IEKEFTEVEGR

SEQ ID NO: 527315 - protein, 11 aa, Influenza virus
IEKIEKIRPLL

SEQ ID NO: 527316 - protein, 11 aa, Influenza virus
IEKIRNGTYDH

SEQ ID NO: 527317 - protein, 11 aa, Influenza virus
IEKITNKVNNI

SEQ ID NO: 527318 - protein, 11 aa, Influenza virus
IEKMNGNYDSI

SEQ ID NO: 527319 - protein, 11 aa, Influenza virus
IEKMVLSAFDE

SEQ ID NO: 527320 - protein, 11 aa, Influenza virus
IEKNALGDCPK

SEQ ID NO: 527321 - protein, 11 aa, Influenza virus
IEKQIGNVINW

SEQ ID NO: 527322 - protein, 11 aa, Influenza virus
IEKTNDKYHQI

SEQ ID NO: 527323 - protein, 11 aa, Influenza virus
IEKTNEKFHQI

SEQ ID NO: 527324 - protein, 11 aa, Influenza virus
IEKTNEKYHQI

SEQ ID NO: 527325 - protein, 11 aa, Influenza virus
IEKTNKQFELI

SEQ ID NO: 527326 - protein, 11 aa, Influenza virus
IEKTNQQFELI

SEQ ID NO: 527327 - protein, 11 aa, Influenza virus
IEKTNQQFKLI

SEQ ID NO: 527328 - protein, 11 aa, Influenza virus
IEKTNTEFESI

SEQ ID NO: 527329 - protein, 11 aa, Influenza virus
IEKTNTQFELI

SEQ ID NO: 527330 - protein, 11 aa, Influenza virus
IEKTSWSYIVE

SEQ ID NO: 527331 - protein, 11 aa, Influenza virus
IEKVRNGTYDH

SEQ ID NO: 527332 - protein, 11 aa, Influenza virus
IEKYGSGRIFQ

SEQ ID NO: 527333 - protein, 11 aa, Influenza virus
IEKYGTGRIFQ

SEQ ID NO: 527334 - protein, 11 aa, Influenza virus
IEMTDSEMLNL

SEQ ID NO: 527335 - protein, 11 aa, Influenza virus
IENDRTLDLHD

SEQ ID NO: 527336 - protein, 11 aa, Influenza virus
IENGWEGLIDG

SEQ ID NO: 527337 - protein, 11 aa, Influenza virus
IENGWEGLING

SEQ ID NO: 527338 - protein, 11 aa, Influenza virus
IENGWEGLVDG

SEQ ID NO: 527339 - protein, 11 aa, Influenza virus
IENGWEGMIDG

SEQ ID NO: 527340 - protein, 11 aa, Influenza virus
IENGWEGMMDG

SEQ ID NO: 527341 - protein, 11 aa, Influenza virus
IENGWEGMVDG

SEQ ID NO: 527342 - protein, 11 aa, Influenza virus
IENGWEGMVNG

SEQ ID NO: 527343 - protein, 11 aa, Influenza virus
IENGWQGLIDG

SEQ ID NO: 527344 - protein, 11 aa, Influenza virus
IENLEELRFVF

SEQ ID NO: 527345 - protein, 11 aa, Influenza virus
IENLNKKIDDG

SEQ ID NO: 527346 - protein, 11 aa, Influenza virus
IENLNKKMEDG

SEQ ID NO: 527347 - protein, 11 aa, Influenza virus
IENLNKKVDDG

SEQ ID NO: 527348 - protein, 11 aa, Influenza virus
IENLNRKMEDG

SEQ ID NO: 527349 - protein, 11 aa, Influenza virus
IENLNRKVDDG

SEQ ID NO: 527350 - protein, 11 aa, Influenza virus
IENLQAYQKRM

SEQ ID NO: 527351 - protein, 11 aa, Influenza virus
IENLWAYNAEL

SEQ ID NO: 527352 - protein, 11 aa, Influenza virus
IENNVTVTSSV

SEQ ID NO: 527353 - protein, 11 aa, Influenza virus
IENPSHEGEGI

SEQ ID NO: 527354 - protein, 11 aa, Influenza virus
IENQEELKSLF

SEQ ID NO: 527355 - protein, 11 aa, Influenza virus
IENQEELRFLF

SEQ ID NO: 527356 - protein, 11 aa, Influenza virus
IENQEELRSLF

SEQ ID NO: 527357 - protein, 11 aa, Influenza virus
IENQHTIDLAD

SEQ ID NO: 527358 - protein, 11 aa, Influenza virus
IENTYVNKTTV

SEQ ID NO: 527359 - protein, 11 aa, Influenza virus
IENTYVNNTTI

SEQ ID NO: 527360 - protein, 11 aa, Influenza virus
IENTYVNNTTV

SEQ ID NO: 527361 - protein, 11 aa, Influenza virus
IEPKGLFGAIA

SEQ ID NO: 527362 - protein, 11 aa, Influenza virus
IEPRGLFGAIA

SEQ ID NO: 527363 - protein, 11 aa, Influenza virus
IEQNIPVTQVE

SEQ ID NO: 527364 - protein, 11 aa, Influenza virus
IEQNVPVTQVE

SEQ ID NO: 527365 - protein, 11 aa, Influenza virus
IEQQIGNVINW

SEQ ID NO: 527366 - protein, 11 aa, Influenza virus
IERMVLSAFDE

SEQ ID NO: 527367 - protein, 11 aa, Influenza virus
IERNALGDCPK

SEQ ID NO: 527368 - protein, 11 aa, Influenza virus
IERNALGNCPK

SEQ ID NO: 527369 - protein, 11 aa, Influenza virus
IERPTAVDTCY

SEQ ID NO: 527370 - protein, 11 aa, Influenza virus
IERRNSSDICY

SEQ ID NO: 527371 - protein, 11 aa, Influenza virus
IERTNEKFHQI

SEQ ID NO: 527372 - protein, 11 aa, Influenza virus
IERTNEKYHQI

SEQ ID NO: 527373 - protein, 11 aa, Influenza virus
IERTNQQFELI

SEQ ID NO: 527374 - protein, 11 aa, Influenza virus
IERVRNGTYDH

SEQ ID NO: 527375 - protein, 11 aa, Influenza virus
IESEFNEIEHQ

SEQ ID NO: 527376 - protein, 11 aa, Influenza virus
IESEFNEIEYQ

SEQ ID NO: 527377 - protein, 11 aa, Influenza virus
IESEFSEIEHQ

SEQ ID NO: 527378 - protein, 11 aa, Influenza virus
IESEFSETEHQ

SEQ ID NO: 527379 - protein, 11 aa, Influenza virus
IESIIEAESSV

SEQ ID NO: 527380 - protein, 11 aa, Influenza virus
IESIRNGTYDH

SEQ ID NO: 527381 - protein, 11 aa, Influenza virus
IESIRNGTYNH

SEQ ID NO: 527382 - protein, 11 aa, Influenza virus
IESLNKKMEDG

SEQ ID NO: 527383 - protein, 11 aa, Influenza virus
IESMIEAESSI

SEQ ID NO: 527384 - protein, 11 aa, Influenza virus
IESMIEAESSV

SEQ ID NO: 527385 - protein, 11 aa, Influenza virus
IESMVEAESSV

SEQ ID NO: 527386 - protein, 11 aa, Influenza virus
IESNGNLIAPW

SEQ ID NO: 527387 - protein, 11 aa, Influenza virus
IESNVTVTNSV

SEQ ID NO: 527388 - protein, 11 aa, Influenza virus
IESNVTVTSSI

SEQ ID NO: 527389 - protein, 11 aa, Influenza virus
IESNVTVTSSV

SEQ ID NO: 527390 - protein, 11 aa, Influenza virus
IESRGLFGAIA

SEQ ID NO: 527391 - protein, 11 aa, Influenza virus
IETGYVCSKFH

SEQ ID NO: 527392 - protein, 11 aa, Influenza virus
IETNHTGTYCS

SEQ ID NO: 527393 - protein, 11 aa, Influenza virus
IETTHTGTYCS

SEQ ID NO: 527394 - protein, 11 aa, Influenza virus
IEVLHLTQGAC

SEQ ID NO: 527395 - protein, 11 aa, Influenza virus
IEVLHLTQGTC

SEQ ID NO: 527396 - protein, 11 aa, Influenza virus
IEVTNATELVQ

SEQ ID NO: 527397 - protein, 11 aa, Influenza virus
IEVVAAQELVE

SEQ ID NO: 527398 - protein, 11 aa, Influenza virus
IEVVNATETVE

SEQ ID NO: 527399 - protein, 11 aa, Influenza virus
IEVVTAQELVE

SEQ ID NO: 527400 - protein, 11 aa, Influenza virus
IEVWSYNAEFL

SEQ ID NO: 527401 - protein, 11 aa, Influenza virus
IEYDAVATTHS

SEQ ID NO: 527402 - protein, 11 aa, Influenza virus
IEYNGKSLGIQ

SEQ ID NO: 527403 - protein, 11 aa, Influenza virus
IEYQIGNVINW

SEQ ID NO: 527404 - protein, 11 aa, Influenza virus
IFFWMCSNGSL

SEQ ID NO: 527405 - protein, 11 aa, Influenza virus
IFGAIAGFIEG

SEQ ID NO: 527406 - protein, 11 aa, Influenza virus
IFGAIAGFIEN

SEQ ID NO: 527407 - protein, 11 aa, Influenza virus
IFGCQNGNIRC

SEQ ID NO: 527408 - protein, 11 aa, Influenza virus
IFGCQNGNVRC

SEQ ID NO: 527409 - protein, 11 aa, Influenza virus
IFGKDNAIRIG

SEQ ID NO: 527410 - protein, 11 aa, Influenza virus
IFGKDNAVRIG

SEQ ID NO: 527411 - protein, 11 aa, Influenza virus
IFHKCDDDCMA

SEQ ID NO: 527412 - protein, 11 aa, Influenza virus
IFHKCDDHCME

SEQ ID NO: 527413 - protein, 11 aa, Influenza virus
IFHKCDDQCME

SEQ ID NO: 527414 - protein, 11 aa, Influenza virus
IFHKCDNQCME

SEQ ID NO: 527415 - protein, 11 aa, Influenza virus
IFHQCDNNCIE

SEQ ID NO: 527416 - protein, 11 aa, Influenza virus
IFHRCDDQCME

SEQ ID NO: 527417 - protein, 11 aa, Influenza virus
IFIFILLTHWA

SEQ ID NO: 527418 - protein, 11 aa, Influenza virus
IFIFLLLTHWA

SEQ ID NO: 527419 - protein, 11 aa, Influenza virus
IFLARSALILR

SEQ ID NO: 527420 - protein, 11 aa, Influenza virus
IFLWCKIVTTV

SEQ ID NO: 527421 - protein, 11 aa, Influenza virus
IFLWGIHHPPD

SEQ ID NO: 527422 - protein, 11 aa, Influenza virus
IFLWGIHHPPN

SEQ ID NO: 527423 - protein, 11 aa, Influenza virus
IFLWMCSNGSL

SEQ ID NO: 527424 - protein, 11 aa, Influenza virus
IFLYVRTNGTS

SEQ ID NO: 527425 - protein, 11 aa, Influenza virus
IFMARSALILR

SEQ ID NO: 527426 - protein, 11 aa, Influenza virus
IFMCVKNGNLR

SEQ ID NO: 527427 - protein, 11 aa, Influenza virus
IFNFILLTHWA

SEQ ID NO: 527428 - protein, 11 aa, Influenza virus
IFNGAFIAPDR

SEQ ID NO: 527429 - protein, 11 aa, Influenza virus
IFNMERIKELR

SEQ ID NO: 527430 - protein, 11 aa, Influenza virus
IFNSIGNLIAP

SEQ ID NO: 527431 - protein, 11 aa, Influenza virus
IFQPNIGPRPL

SEQ ID NO: 527432 - protein, 11 aa, Influenza virus
IFRPNIGPRPL

SEQ ID NO: 527433 - protein, 11 aa, Influenza virus
IFSARSALILR

SEQ ID NO: 527434 - protein, 11 aa, Influenza virus
IFSFIGEEMAT

SEQ ID NO: 527435 - protein, 11 aa, Influenza virus
IFSFNGEEMAT

SEQ ID NO: 527436 - protein, 11 aa, Influenza virus
IFSFTGEEMAS

SEQ ID NO: 527437 - protein, 11 aa, Influenza virus
IFSFTGEEMAT

SEQ ID NO: 527438 - protein, 11 aa, Influenza virus
IFSHNGGLIAP

SEQ ID NO: 527439 - protein, 11 aa, Influenza virus
IFSKDNAIRIG

SEQ ID NO: 527440 - protein, 11 aa, Influenza virus
IFSKDNGIRIG

SEQ ID NO: 527441 - protein, 11 aa, Influenza virus
IFVIREPFISC

SEQ ID NO: 527442 - protein, 11 aa, Influenza virus
IFVIREPFVAC

SEQ ID NO: 527443 - protein, 11 aa, Influenza virus
IFVIREPFVSC

SEQ ID NO: 527444 - protein, 11 aa, Influenza virus
IFVMREPFISC

SEQ ID NO: 527445 - protein, 11 aa, Influenza virus
IGAIDSSMPFH

SEQ ID NO: 527446 - protein, 11 aa, Influenza virus
IGAPQLNPIDG

SEQ ID NO: 527447 - protein, 11 aa, Influenza virus
IGARIGEGQRS

SEQ ID NO: 527448 - protein, 11 aa, Influenza virus
IGCKMYALHQG

SEQ ID NO: 527449 - protein, 11 aa, Influenza virus
IGDCPKYIKSG

SEQ ID NO: 527450 - protein, 11 aa, Influenza virus
IGDCPKYMNVK

SEQ ID NO: 527451 - protein, 11 aa, Influenza virus
IGDCPKYVNIK

SEQ ID NO: 527452 - protein, 11 aa, Influenza virus
IGDCPKYVNVK

SEQ ID NO: 527453 - protein, 11 aa, Influenza virus
IGDCPKYVNVR

SEQ ID NO: 527454 - protein, 11 aa, Influenza virus
IGDGQRSWMKI

SEQ ID NO: 527455 - protein, 11 aa, Influenza virus
IGDGQRSWMKL

SEQ ID NO: 527456 - protein, 11 aa, Influenza virus
IGECPKYVKSD

SEQ ID NO: 527457 - protein, 11 aa, Influenza virus
IGECPKYVKSE

SEQ ID NO: 527458 - protein, 11 aa, Influenza virus
IGECPKYVKSN

SEQ ID NO: 527459 - protein, 11 aa, Influenza virus
IGECPKYVKSS

SEQ ID NO: 527460 - protein, 11 aa, Influenza virus
IGECPKYVKST

SEQ ID NO: 527461 - protein, 11 aa, Influenza virus
IGECPKYVRSA

SEQ ID NO: 527462 - protein, 11 aa, Influenza virus
IGECPKYVRSE

SEQ ID NO: 527463 - protein, 11 aa, Influenza virus
IGECPKYVRST

SEQ ID NO: 527464 - protein, 11 aa, Influenza virus
IGECPRYVKSE

SEQ ID NO: 527465 - protein, 11 aa, Influenza virus
IGEDSDILVTR

SEQ ID NO: 527466 - protein, 11 aa, Influenza virus
IGEDSDVLVTR

SEQ ID NO: 527467 - protein, 11 aa, Influenza virus
IGEGQRSWMKI

SEQ ID NO: 527468 - protein, 11 aa, Influenza virus
IGEKSDVLVTR

SEQ ID NO: 527469 - protein, 11 aa, Influenza virus
IGENSDVLVTR

SEQ ID NO: 527470 - protein, 11 aa, Influenza virus
IGEYPVVKGEY

SEQ ID NO: 527471 - protein, 11 aa, Influenza virus
IGFHFEECSCY

SEQ ID NO: 527472 - protein, 11 aa, Influenza virus
IGFWMCSNGSL

SEQ ID NO: 527473 - protein, 11 aa, Influenza virus
IGGFIFGCQNG

SEQ ID NO: 527474 - protein, 11 aa, Influenza virus
IGGNSDVLVTR

SEQ ID NO: 527475 - protein, 11 aa, Influenza virus
IGGSGTDNYGV

SEQ ID NO: 527476 - protein, 11 aa, Influenza virus
IGGSGTNNYGV

SEQ ID NO: 527477 - protein, 11 aa, Influenza virus
IGGWATANSKS

SEQ ID NO: 527478 - protein, 11 aa, Influenza virus
IGGWTIANSKS

SEQ ID NO: 527479 - protein, 11 aa, Influenza virus
IGGWTTANSKS

SEQ ID NO: 527480 - protein, 11 aa, Influenza virus
IGHHANNSTEQ

SEQ ID NO: 527481 - protein, 11 aa, Influenza virus
IGIAADRDSTQ

SEQ ID NO: 527482 - protein, 11 aa, Influenza virus
IGIGNLIFNTV

SEQ ID NO: 527483 - protein, 11 aa, Influenza virus
IGIGNLVFNTV

SEQ ID NO: 527484 - protein, 11 aa, Influenza virus
IGISGPDDGAV

SEQ ID NO: 527485 - protein, 11 aa, Influenza virus
IGISGPDNEAV

SEQ ID NO: 527486 - protein, 11 aa, Influenza virus
IGISGPDNGAV

SEQ ID NO: 527487 - protein, 11 aa, Influenza virus
IGISGPDSGAV

SEQ ID NO: 527488 - protein, 11 aa, Influenza virus
IGISNVGLKVS

SEQ ID NO: 527489 - protein, 11 aa, Influenza virus
IGISNVGLNVS

SEQ ID NO: 527490 - protein, 11 aa, Influenza virus
IGITGPDATAV

SEQ ID NO: 527491 - protein, 11 aa, Influenza virus
IGITVIKNNMI

SEQ ID NO: 527492 - protein, 11 aa, Influenza virus
IGKCNDPYPGN

SEQ ID NO: 527493 - protein, 11 aa, Influenza virus
IGKCPKYIPSG

SEQ ID NO: 527494 - protein, 11 aa, Influenza virus
IGKCPKYIPSN

SEQ ID NO: 527495 - protein, 11 aa, Influenza virus
IGKCPKYIPSR

SEQ ID NO: 527496 - protein, 11 aa, Influenza virus
IGKCPKYISSG

SEQ ID NO: 527497 - protein, 11 aa, Influenza virus
IGKCPKYVKSN

SEQ ID NO: 527498 - protein, 11 aa, Influenza virus
IGKCPKYVKST

SEQ ID NO: 527499 - protein, 11 aa, Influenza virus
IGKCPRYIPSG

SEQ ID NO: 527500 - protein, 11 aa, Influenza virus
IGKCSKYVKST

SEQ ID NO: 527501 - protein, 11 aa, Influenza virus
IGKFYIQMCTE

SEQ ID NO: 527502 - protein, 11 aa, Influenza virus
IGKITNKVNNI

SEQ ID NO: 527503 - protein, 11 aa, Influenza virus
IGKTNEKFHQI

SEQ ID NO: 527504 - protein, 11 aa, Influenza virus
IGKTNQQFELI

SEQ ID NO: 527505 - protein, 11 aa, Influenza virus
IGKTSWSYIVE

SEQ ID NO: 527506 - protein, 11 aa, Influenza virus
IGKVCRALLAK

SEQ ID NO: 527507 - protein, 11 aa, Influenza virus
IGKVCRTLLAK

SEQ ID NO: 527508 - protein, 11 aa, Influenza virus
IGLLLQITSLC

SEQ ID NO: 527509 - protein, 11 aa, Influenza virus
IGLREQKQEFK

SEQ ID NO: 527510 - protein, 11 aa, Influenza virus
IGLRISSSFSF

SEQ ID NO: 527511 - protein, 11 aa, Influenza virus
IGLRNTPSIEP

SEQ ID NO: 527512 - protein, 11 aa, Influenza virus
IGNCPKYVKQG

SEQ ID NO: 527513 - protein, 11 aa, Influenza virus
IGNGCFEFYHK

SEQ ID NO: 527514 - protein, 11 aa, Influenza virus
IGNGCFEFYHR

SEQ ID NO: 527515 - protein, 11 aa, Influenza virus
IGNGCFEFYHT

SEQ ID NO: 527516 - protein, 11 aa, Influenza virus
IGNLAFNAVIH

SEQ ID NO: 527517 - protein, 11 aa, Influenza virus
IGNLIAPRGHY

SEQ ID NO: 527518 - protein, 11 aa, Influenza virus
IGNLVAPRGHY

SEQ ID NO: 527519 - protein, 11 aa, Influenza virus
IGNLVFNTVIH

SEQ ID NO: 527520 - protein, 11 aa, Influenza virus
IGNVINWTKDS

SEQ ID NO: 527521 - protein, 11 aa, Influenza virus
IGNVINWTQDA

SEQ ID NO: 527522 - protein, 11 aa, Influenza virus
IGNVINWTRDA

SEQ ID NO: 527523 - protein, 11 aa, Influenza virus
IGNVINWTRDS

SEQ ID NO: 527524 - protein, 11 aa, Influenza virus
IGPLLQITSLC

SEQ ID NO: 527525 - protein, 11 aa, Influenza virus
IGPLSGSAQHI

SEQ ID NO: 527526 - protein, 11 aa, Influenza virus
IGPPHCDQFLE

SEQ ID NO: 527527 - protein, 11 aa, Influenza virus
IGPPQCDKFLE

SEQ ID NO: 527528 - protein, 11 aa, Influenza virus
IGPPQCDLFLE

SEQ ID NO: 527529 - protein, 11 aa, Influenza virus
IGPPQCDLHLE

SEQ ID NO: 527530 - protein, 11 aa, Influenza virus
IGPPQCDQFLE

SEQ ID NO: 527531 - protein, 11 aa, Influenza virus
IGPPQCDRFLE

SEQ ID NO: 527532 - protein, 11 aa, Influenza virus
IGPPQCDSHLK

SEQ ID NO: 527533 - protein, 11 aa, Influenza virus
IGPRALVRGQQ

SEQ ID NO: 527534 - protein, 11 aa, Influenza virus
IGPRPFVRGQQ

SEQ ID NO: 527535 - protein, 11 aa, Influenza virus
IGPRPLIRGQQ

SEQ ID NO: 527536 - protein, 11 aa, Influenza virus
IGPRPLVMGQQ

SEQ ID NO: 527537 - protein, 11 aa, Influenza virus
IGPRPLVREQQ

SEQ ID NO: 527538 - protein, 11 aa, Influenza virus
IGPRPLVRGQQ

SEQ ID NO: 527539 - protein, 11 aa, Influenza virus
IGQAADLKSTQ

SEQ ID NO: 527540 - protein, 11 aa, Influenza virus
IGQAADYKSTQ

SEQ ID NO: 527541 - protein, 11 aa, Influenza virus
IGQGDIVLVMK

SEQ ID NO: 527542 - protein, 11 aa, Influenza virus
IGQGDVVLVMK

SEQ ID NO: 527543 - protein, 11 aa, Influenza virus
IGRFYIQMCTE

SEQ ID NO: 527544 - protein, 11 aa, Influenza virus
IGRFYVQMCTE

SEQ ID NO: 527545 - protein, 11 aa, Influenza virus
IGRMTICIQGN

SEQ ID NO: 527546 - protein, 11 aa, Influenza virus
IGRMTICVQGK

SEQ ID NO: 527547 - protein, 11 aa, Influenza virus
IGRMTICVQGN

SEQ ID NO: 527548 - protein, 11 aa, Influenza virus
IGRTKNLESRS

SEQ ID NO: 527549 - protein, 11 aa, Influenza virus
IGRTKSLESRS

SEQ ID NO: 527550 - protein, 11 aa, Influenza virus
IGRTNQQFELI

SEQ ID NO: 527551 - protein, 11 aa, Influenza virus
IGSCTSPCLTD

SEQ ID NO: 527552 - protein, 11 aa, Influenza virus
IGSGFFPDGPQ

SEQ ID NO: 527553 - protein, 11 aa, Influenza virus
IGSIRNETYDH

SEQ ID NO: 527554 - protein, 11 aa, Influenza virus
IGSIRNGTYDH

SEQ ID NO: 527555 - protein, 11 aa, Influenza virus
IGSIRNGTYNH

SEQ ID NO: 527556 - protein, 11 aa, Influenza virus
IGSKGDIFVIR

SEQ ID NO: 527557 - protein, 11 aa, Influenza virus
IGSKGDIFVMR

SEQ ID NO: 527558 - protein, 11 aa, Influenza virus
IGSKGDVFVIR

SEQ ID NO: 527559 - protein, 11 aa, Influenza virus
IGSKGDVFVMR

SEQ ID NO: 527560 - protein, 11 aa, Influenza virus
IGSKGHVFVIR

SEQ ID NO: 527561 - protein, 11 aa, Influenza virus
IGSRGEVFVIR

SEQ ID NO: 527562 - protein, 11 aa, Influenza virus
IGSRGHIFVIR

SEQ ID NO: 527563 - protein, 11 aa, Influenza virus
IGSRGHVFVIR

SEQ ID NO: 527564 - protein, 11 aa, Influenza virus
IGSRPRVRNQS

SEQ ID NO: 527565 - protein, 11 aa, Influenza virus
IGSSTYQNNFV

SEQ ID NO: 527566 - protein, 11 aa, Influenza virus
IGSSYVCSGLV

SEQ ID NO: 527567 - protein, 11 aa, Influenza virus
IGSWSHNILRT

SEQ ID NO: 527568 - protein, 11 aa, Influenza virus
IGSWSQNILRT

SEQ ID NO: 527569 - protein, 11 aa, Influenza virus
IGTRIGDGQRS

SEQ ID NO: 527570 - protein, 11 aa, Influenza virus
IGVAPSPSNSR

SEQ ID NO: 527571 - protein, 11 aa, Influenza virus
IGVAVIKNNMI

SEQ ID NO: 527572 - protein, 11 aa, Influenza virus
IGVGNLAFNTV

SEQ ID NO: 527573 - protein, 11 aa, Influenza virus
IGVGNLIFNTV

SEQ ID NO: 527574 - protein, 11 aa, Influenza virus
IGVGNLVFNTV

SEQ ID NO: 527575 - protein, 11 aa, Influenza virus
IGVSGPDNGAV

SEQ ID NO: 527576 - protein, 11 aa, Influenza virus
IGVTRREIHIY

SEQ ID NO: 527577 - protein, 11 aa, Influenza virus
IGVTRREVHIY

SEQ ID NO: 527578 - protein, 11 aa, Influenza virus
IGVTRREVHMY

SEQ ID NO: 527579 - protein, 11 aa, Influenza virus
IGVTRREVHTY

SEQ ID NO: 527580 - protein, 11 aa, Influenza virus
IGVTRREVHVY

SEQ ID NO: 527581 - protein, 11 aa, Influenza virus
IGVTVIKNNMI

SEQ ID NO: 527582 - protein, 11 aa, Influenza virus
IGVTVIKNNMV

SEQ ID NO: 527583 - protein, 11 aa, Influenza virus
IGVTVIRNNMI

SEQ ID NO: 527584 - protein, 11 aa, Influenza virus
IGWSSTSCHDG

SEQ ID NO: 527585 - protein, 11 aa, Influenza virus
IGYHANNSKKQ

SEQ ID NO: 527586 - protein, 11 aa, Influenza virus
IGYHANNSTDT

SEQ ID NO: 527587 - protein, 11 aa, Influenza virus
IGYHANNSTEK

SEQ ID NO: 527588 - protein, 11 aa, Influenza virus
IGYHANNSTEM

SEQ ID NO: 527589 - protein, 11 aa, Influenza virus
IGYHANNSTEQ

SEQ ID NO: 527590 - protein, 11 aa, Influenza virus
IGYHANNSTET

SEQ ID NO: 527591 - protein, 11 aa, Influenza virus
IGYHANNSTKQ

SEQ ID NO: 527592 - protein, 11 aa, Influenza virus
IGYHANNSTTK

SEQ ID NO: 527593 - protein, 11 aa, Influenza virus
IGYHANNSTTQ

SEQ ID NO: 527594 - protein, 11 aa, Influenza virus
IGYHSNNSTEK

SEQ ID NO: 527595 - protein, 11 aa, Influenza virus
IGYICSGIFGD

SEQ ID NO: 527596 - protein, 11 aa, Influenza virus
IGYICSGVFGD

SEQ ID NO: 527597 - protein, 11 aa, Influenza virus
IGYLSNNATDT

SEQ ID NO: 527598 - protein, 11 aa, Influenza virus
IGYLSNNSSDT

SEQ ID NO: 527599 - protein, 11 aa, Influenza virus
IGYLSNNSTDK

SEQ ID NO: 527600 - protein, 11 aa, Influenza virus
IGYLSNNSTDT

SEQ ID NO: 527601 - protein, 11 aa, Influenza virus
IGYLSNNSTEK

SEQ ID NO: 527602 - protein, 11 aa, Influenza virus
IGYLSNNSTER

SEQ ID NO: 527603 - protein, 11 aa, Influenza virus
IGYLSTNSSER

SEQ ID NO: 527604 - protein, 11 aa, Influenza virus
IGYMSNNSTEK

SEQ ID NO: 527605 - protein, 11 aa, Influenza virus
IGYQSNNSTDT

SEQ ID NO: 527606 - protein, 11 aa, Influenza virus
IGYQSNNSTNT

SEQ ID NO: 527607 - protein, 11 aa, Influenza virus
IGYQTNNSTDT

SEQ ID NO: 527608 - protein, 11 aa, Influenza virus
IGYQTNNSTET

SEQ ID NO: 527609 - protein, 11 aa, Influenza virus
IGYVCSGIFGD

SEQ ID NO: 527610 - protein, 11 aa, Influenza virus
IGYVCSGVFGD

SEQ ID NO: 527611 - protein, 11 aa, Influenza virus
IHDRIPHRTLL

SEQ ID NO: 527612 - protein, 11 aa, Influenza virus
IHDRSPHRTLL

SEQ ID NO: 527613 - protein, 11 aa, Influenza virus
IHDRSQYRALI

SEQ ID NO: 527614 - protein, 11 aa, Influenza virus
IHDRSQYRALV

SEQ ID NO: 527615 - protein, 11 aa, Influenza virus
IHDRSQYRSLI

SEQ ID NO: 527616 - protein, 11 aa, Influenza virus
IHDRTAFRGLI

SEQ ID NO: 527617 - protein, 11 aa, Influenza virus
IHDRTAFRGLM

SEQ ID NO: 527618 - protein, 11 aa, Influenza virus
IHDRTPHRTLL

SEQ ID NO: 527619 - protein, 11 aa, Influenza virus
IHECRTFFLTQ

SEQ ID NO: 527620 - protein, 11 aa, Influenza virus
IHHPPDAKEQT

SEQ ID NO: 527621 - protein, 11 aa, Influenza virus
IHHPPDETEQT

SEQ ID NO: 527622 - protein, 11 aa, Influenza virus
IHHPPDTKEQT

SEQ ID NO: 527623 - protein, 11 aa, Influenza virus
IHHPPNTKEQT

SEQ ID NO: 527624 - protein, 11 aa, Influenza virus
IHHPPTSAEQV

SEQ ID NO: 527625 - protein, 11 aa, Influenza virus
IHHPPTSDEQI

SEQ ID NO: 527626 - protein, 11 aa, Influenza virus
IHHPPTSDEQV

SEQ ID NO: 527627 - protein, 11 aa, Influenza virus
IHHPPTSNEQV

SEQ ID NO: 527628 - protein, 11 aa, Influenza virus
IHHPPTTDEQM

SEQ ID NO: 527629 - protein, 11 aa, Influenza virus
IHHPSSAQEKN

SEQ ID NO: 527630 - protein, 11 aa, Influenza virus
IHHPSSTKEKN

SEQ ID NO: 527631 - protein, 11 aa, Influenza virus
IHHPSSTQEKN

SEQ ID NO: 527632 - protein, 11 aa, Influenza virus
IHIFSFNGEEM

SEQ ID NO: 527633 - protein, 11 aa, Influenza virus
IHIFSFTGEEM

SEQ ID NO: 527634 - protein, 11 aa, Influenza virus
IHISPLSGSAQ

SEQ ID NO: 527635 - protein, 11 aa, Influenza virus
IHKQLTHHMRK

SEQ ID NO: 527636 - protein, 11 aa, Influenza virus
IHLGDCSFEGW

SEQ ID NO: 527637 - protein, 11 aa, Influenza virus
IHLTDSEMNKL

SEQ ID NO: 527638 - protein, 11 aa, Influenza virus
IHPLAIGECPK

SEQ ID NO: 527639 - protein, 11 aa, Influenza virus
IHPLTIGECPK

SEQ ID NO: 527640 - protein, 11 aa, Influenza virus
IHPLTIGKCPK

SEQ ID NO: 527641 - protein, 11 aa, Influenza virus
IHPLTMGECPK

SEQ ID NO: 527642 - protein, 11 aa, Influenza virus
IHSRGLFGAIA

SEQ ID NO: 527643 - protein, 11 aa, Influenza virus
IHTRGLFGAIA

SEQ ID NO: 527644 - protein, 11 aa, Influenza virus
IHYGGIPTDVV

SEQ ID NO: 527645 - protein, 11 aa, Influenza virus
IHYGGMPTDVV

SEQ ID NO: 527646 - protein, 11 aa, Influenza virus
IHYGGVPTDVI

SEQ ID NO: 527647 - protein, 11 aa, Influenza virus
IHYGGVPTDVM

SEQ ID NO: 527648 - protein, 11 aa, Influenza virus
IHYGGVPTDVV

SEQ ID NO: 527649 - protein, 11 aa, Influenza virus
IIAARNIVRRA

SEQ ID NO: 527650 - protein, 11 aa, Influenza virus
IIAARSIVRRA

SEQ ID NO: 527651 - protein, 11 aa, Influenza virus
IIALLIGIGNL

SEQ ID NO: 527652 - protein, 11 aa, Influenza virus
IICLGHHAVEN

SEQ ID NO: 527653 - protein, 11 aa, Influenza virus
IICTCRDNWQG

SEQ ID NO: 527654 - protein, 11 aa, Influenza virus
IIDIWAYNAEL

SEQ ID NO: 527655 - protein, 11 aa, Influenza virus
IIDKMNGNYDS

SEQ ID NO: 527656 - protein, 11 aa, Influenza virus
IIDKMNTQFEA

SEQ ID NO: 527657 - protein, 11 aa, Influenza virus
IIDKMNTQFET

SEQ ID NO: 527658 - protein, 11 aa, Influenza virus
IIDKMNTRFEA

SEQ ID NO: 527659 - protein, 11 aa, Influenza virus
IIDLADSEMNK

SEQ ID NO: 527660 - protein, 11 aa, Influenza virus
IIDNDNWSGYS

SEQ ID NO: 527661 - protein, 11 aa, Influenza virus
IIDNNNWSGYS

SEQ ID NO: 527662 - protein, 11 aa, Influenza virus
IIEAESSVKEK

SEQ ID NO: 527663 - protein, 11 aa, Influenza virus
IIEEYGKGRIF

SEQ ID NO: 527664 - protein, 11 aa, Influenza virus
IIEEYGRGRIF

SEQ ID NO: 527665 - protein, 11 aa, Influenza virus
IIEKMNGNYDS

SEQ ID NO: 527666 - protein, 11 aa, Influenza virus
IIEKNVTVTHA

SEQ ID NO: 527667 - protein, 11 aa, Influenza virus
IIEKYGSGRIF

SEQ ID NO: 527668 - protein, 11 aa, Influenza virus
IIEKYGTGRIF

SEQ ID NO: 527669 - protein, 11 aa, Influenza virus
IIENNVTVTSS

SEQ ID NO: 527670 - protein, 11 aa, Influenza virus
IIERRNSSDIC

SEQ ID NO: 527671 - protein, 11 aa, Influenza virus
IIESNITVTSS

SEQ ID NO: 527672 - protein, 11 aa, Influenza virus
IIESNVTVTSS

SEQ ID NO: 527673 - protein, 11 aa, Influenza virus
IIETGYVCSKF

SEQ ID NO: 527674 - protein, 11 aa, Influenza virus
IIFLWGIHHPP

SEQ ID NO: 527675 - protein, 11 aa, Influenza virus
IIFNMERIKEL

SEQ ID NO: 527676 - protein, 11 aa, Influenza virus
IIFNSIGNLIA

SEQ ID NO: 527677 - protein, 11 aa, Influenza virus
IIGGFIFGCQN

SEQ ID NO: 527678 - protein, 11 aa, Influenza virus
IIGISNVGLNV

SEQ ID NO: 527679 - protein, 11 aa, Influenza virus
IIGKMNTQFEA

SEQ ID NO: 527680 - protein, 11 aa, Influenza virus
IIGPPQCDLHL

SEQ ID NO: 527681 - protein, 11 aa, Influenza virus
IIGPPQCDSHL

SEQ ID NO: 527682 - protein, 11 aa, Influenza virus
IIHISPLSGSA

SEQ ID NO: 527683 - protein, 11 aa, Influenza virus
IIIAIGSVSRT

SEQ ID NO: 527684 - protein, 11 aa, Influenza virus
IIIRMMENARP

SEQ ID NO: 527685 - protein, 11 aa, Influenza virus
IIIVVLLYTFA

SEQ ID NO: 527686 - protein, 11 aa, Influenza virus
IIKGRSHLRND

SEQ ID NO: 527687 - protein, 11 aa, Influenza virus
IIKKYTSARQE

SEQ ID NO: 527688 - protein, 11 aa, Influenza virus
IIKKYTSGRQE

SEQ ID NO: 527689 - protein, 11 aa, Influenza virus
IIKLLPFAAAP

SEQ ID NO: 527690 - protein, 11 aa, Influenza virus
IIKLLPFASAP

SEQ ID NO: 527691 - protein, 11 aa, Influenza virus
IIKMLPFAAAP

SEQ ID NO: 527692 - protein, 11 aa, Influenza virus
IILGNPKCDLY

SEQ ID NO: 527693 - protein, 11 aa, Influenza virus
IILWFSFGASC

SEQ ID NO: 527694 - protein, 11 aa, Influenza virus
IILWFSFGASS

SEQ ID NO: 527695 - protein, 11 aa, Influenza virus
IILWFSFSISC

SEQ ID NO: 527696 - protein, 11 aa, Influenza virus
IILWISFSISC

SEQ ID NO: 527697 - protein, 11 aa, Influenza virus
IILWISFSMSC

SEQ ID NO: 527698 - protein, 11 aa, Influenza virus
IILWVSFSISC

SEQ ID NO: 527699 - protein, 11 aa, Influenza virus
IINGALGSPGC

SEQ ID NO: 527700 - protein, 11 aa, Influenza virus
IINKMNTQFEA

SEQ ID NO: 527701 - protein, 11 aa, Influenza virus
IINLLIGISNM

SEQ ID NO: 527702 - protein, 11 aa, Influenza virus
IINNQNWSGYS

SEQ ID NO: 527703 - protein, 11 aa, Influenza virus
IIPSGPLKAEI

SEQ ID NO: 527704 - protein, 11 aa, Influenza virus
IIQNEDIPIEN

SEQ ID NO: 527705 - protein, 11 aa, Influenza virus
IIQNEDIPIGN

SEQ ID NO: 527706 - protein, 11 aa, Influenza virus
IIQNEDIPIGS

SEQ ID NO: 527707 - protein, 11 aa, Influenza virus
IIRALTLNTMT

SEQ ID NO: 527708 - protein, 11 aa, Influenza virus
IIREPFVSCSP

SEQ ID NO: 527709 - protein, 11 aa, Influenza virus
IIRESGGIDKE

SEQ ID NO: 527710 - protein, 11 aa, Influenza virus
IIRVGCVILLN

SEQ ID NO: 527711 - protein, 11 aa, Influenza virus
IISKDNGIRIG

SEQ ID NO: 527712 - protein, 11 aa, Influenza virus
IISLCSIWFSH

SEQ ID NO: 527713 - protein, 11 aa, Influenza virus
IISMCSSTEFL

SEQ ID NO: 527714 - protein, 11 aa, Influenza virus
IISNLPFQNIN

SEQ ID NO: 527715 - protein, 11 aa, Influenza virus
IISSLPFQNIN

SEQ ID NO: 527716 - protein, 11 aa, Influenza virus
IITDTFKSWKG

SEQ ID NO: 527717 - protein, 11 aa, Influenza virus
IITDTLKSWKG

SEQ ID NO: 527718 - protein, 11 aa, Influenza virus
IITELPFQNLS

SEQ ID NO: 527719 - protein, 11 aa, Influenza virus
IITIGSASLGL

SEQ ID NO: 527720 - protein, 11 aa, Influenza virus
IITIGSICMVT

SEQ ID NO: 527721 - protein, 11 aa, Influenza virus
IITIGSISLGL

SEQ ID NO: 527722 - protein, 11 aa, Influenza virus
IITIGSISLTI

SEQ ID NO: 527723 - protein, 11 aa, Influenza virus
IITIGSVSLAL

SEQ ID NO: 527724 - protein, 11 aa, Influenza virus
IITIGSVSLTI

SEQ ID NO: 527725 - protein, 11 aa, Influenza virus
IITIGSVSLTL

SEQ ID NO: 527726 - protein, 11 aa, Influenza virus
IITREPYVSCD

SEQ ID NO: 527727 - protein, 11 aa, Influenza virus
IIVFCGTSGTY

SEQ ID NO: 527728 - protein, 11 aa, Influenza virus
IIVFNTIGNLI

SEQ ID NO: 527729 - protein, 11 aa, Influenza virus
IIVILVLGLSM

SEQ ID NO: 527730 - protein, 11 aa, Influenza virus
IIVTREPYVSC

SEQ ID NO: 527731 - protein, 11 aa, Influenza virus
IIYSSSMMWEI

SEQ ID NO: 527732 - protein, 11 aa, Influenza virus
IKAVRGDLNFV

SEQ ID NO: 527733 - protein, 11 aa, Influenza virus
IKCICRDNWKG

SEQ ID NO: 527734 - protein, 11 aa, Influenza virus
IKCICRDNWRG

SEQ ID NO: 527735 - protein, 11 aa, Influenza virus
IKCQTPLGAIN

SEQ ID NO: 527736 - protein, 11 aa, Influenza virus
IKCVCRDNWKG

SEQ ID NO: 527737 - protein, 11 aa, Influenza virus
IKDRSPYRTLM

SEQ ID NO: 527738 - protein, 11 aa, Influenza virus
IKDYRYTYRCH

SEQ ID NO: 527739 - protein, 11 aa, Influenza virus
IKGDYNNTTGR

SEQ ID NO: 527740 - protein, 11 aa, Influenza virus
IKGFAPFSKDN

SEQ ID NO: 527741 - protein, 11 aa, Influenza virus
IKGRSHLRNDT

SEQ ID NO: 527742 - protein, 11 aa, Influenza virus
IKGVELSSMGV

SEQ ID NO: 527743 - protein, 11 aa, Influenza virus
IKGVKLSNMGI

SEQ ID NO: 527744 - protein, 11 aa, Influenza virus
IKGVKLSNMGV

SEQ ID NO: 527745 - protein, 11 aa, Influenza virus
IKGVKLSSMGI

SEQ ID NO: 527746 - protein, 11 aa, Influenza virus
IKGVKLSSMGV

SEQ ID NO: 527747 - protein, 11 aa, Influenza virus
IKGWAPLSKDN

SEQ ID NO: 527748 - protein, 11 aa, Influenza virus
IKHENRMVLAS

SEQ ID NO: 527749 - protein, 11 aa, Influenza virus
IKHLEECSCYV

SEQ ID NO: 527750 - protein, 11 aa, Influenza virus
IKINPVTLTMG

SEQ ID NO: 527751 - protein, 11 aa, Influenza virus
IKIRRRVDINP

SEQ ID NO: 527752 - protein, 11 aa, Influenza virus
IKKTNEKFHQI

SEQ ID NO: 527753 - protein, 11 aa, Influenza virus
IKKYERVKMFD

SEQ ID NO: 527754 - protein, 11 aa, Influenza virus
IKKYTSARQEK

SEQ ID NO: 527755 - protein, 11 aa, Influenza virus
IKKYTSGRQEK

SEQ ID NO: 527756 - protein, 11 aa, Influenza virus
IKLKSEDNVYK

SEQ ID NO: 527757 - protein, 11 aa, Influenza virus
IKLKTEDNIYK

SEQ ID NO: 527758 - protein, 11 aa, Influenza virus
IKLKTEDNVYK

SEQ ID NO: 527759 - protein, 11 aa, Influenza virus
IKLLPFAAAPP

SEQ ID NO: 527760 - protein, 11 aa, Influenza virus
IKLLPFASAPP

SEQ ID NO: 527761 - protein, 11 aa, Influenza virus
IKMKWGMELRR

SEQ ID NO: 527762 - protein, 11 aa, Influenza virus
IKMKWGMEMRR

SEQ ID NO: 527763 - protein, 11 aa, Influenza virus
IKMNPNQKIIT

SEQ ID NO: 527764 - protein, 11 aa, Influenza virus
IKMNPNQKIMT

SEQ ID NO: 527765 - protein, 11 aa, Influenza virus
IKNGNMQCTIC

SEQ ID NO: 527766 - protein, 11 aa, Influenza virus
IKNGNMRCTIC

SEQ ID NO: 527767 - protein, 11 aa, Influenza virus
IKNGTYDHKDY

SEQ ID NO: 527768 - protein, 11 aa, Influenza virus
IKNGTYDHKEY

SEQ ID NO: 527769 - protein, 11 aa, Influenza virus
IKNGTYDYPKY

SEQ ID NO: 527770 - protein, 11 aa, Influenza virus
IKNGTYNHKDY

SEQ ID NO: 527771 - protein, 11 aa, Influenza virus
IKNGTYNHKEY

SEQ ID NO: 527772 - protein, 11 aa, Influenza virus
IKNGTYNRKEY

SEQ ID NO: 527773 - protein, 11 aa, Influenza virus
IKNNMINNDLG

SEQ ID NO: 527774 - protein, 11 aa, Influenza virus
IKNNMVNNDLG

SEQ ID NO: 527775 - protein, 11 aa, Influenza virus
IKNQEELRSLF

SEQ ID NO: 527776 - protein, 11 aa, Influenza virus
IKPCFWVELIR

SEQ ID NO: 527777 - protein, 11 aa, Influenza virus
IKPWARNILRT

SEQ ID NO: 527778 - protein, 11 aa, Influenza virus
IKQGSLKLATG

SEQ ID NO: 527779 - protein, 11 aa, Influenza virus
IKQNGKSGACK

SEQ ID NO: 527780 - protein, 11 aa, Influenza virus
IKQNTLKLATG

SEQ ID NO: 527781 - protein, 11 aa, Influenza virus
IKRGINDRNFW

SEQ ID NO: 527782 - protein, 11 aa, Influenza virus
IKRGVNDRNFW

SEQ ID NO: 527783 - protein, 11 aa, Influenza virus
IKRIRMATNEC

SEQ ID NO: 527784 - protein, 11 aa, Influenza virus
IKRYERVKMFD

SEQ ID NO: 527785 - protein, 11 aa, Influenza virus
IKSDQLKLATG

SEQ ID NO: 527786 - protein, 11 aa, Influenza virus
IKSFSRTELIA

SEQ ID NO: 527787 - protein, 11 aa, Influenza virus
IKSFSRTQLIA

SEQ ID NO: 527788 - protein, 11 aa, Influenza virus
IKSGQLKLATG

SEQ ID NO: 527789 - protein, 11 aa, Influenza virus
IKSWRKDILRT

SEQ ID NO: 527790 - protein, 11 aa, Influenza virus
IKSWRRDILRT

SEQ ID NO: 527791 - protein, 11 aa, Influenza virus
IKTDGATSACK

SEQ ID NO: 527792 - protein, 11 aa, Influenza virus
IKTKLPFQNLS

SEQ ID NO: 527793 - protein, 11 aa, Influenza virus
IKTNGNLIAPE

SEQ ID NO: 527794 - protein, 11 aa, Influenza virus
IKTRLFTIRQE

SEQ ID NO: 527795 - protein, 11 aa, Influenza virus
IKTRLYTIRQE

SEQ ID NO: 527796 - protein, 11 aa, Influenza virus
IKTRPILSPLT

SEQ ID NO: 527797 - protein, 11 aa, Influenza virus
IKTWAGKILRT

SEQ ID NO: 527798 - protein, 11 aa, Influenza virus
IKTWAGNILRT

SEQ ID NO: 527799 - protein, 11 aa, Influenza virus
IKTWAKNILRT

SEQ ID NO: 527800 - protein, 11 aa, Influenza virus
IKTWARNILRT

SEQ ID NO: 527801 - protein, 11 aa, Influenza virus
IKWNVTYTGTS

SEQ ID NO: 527802 - protein, 11 aa, Influenza virus
IKYNGIITDTF

SEQ ID NO: 527803 - protein, 11 aa, Influenza virus
IKYNGIITDTL

SEQ ID NO: 527804 - protein, 11 aa, Influenza virus
ILAATVTLHFK

SEQ ID NO: 527805 - protein, 11 aa, Influenza virus
ILAFILWACSS

SEQ ID NO: 527806 - protein, 11 aa, Influenza virus
ILAFIMWACSN

SEQ ID NO: 527807 - protein, 11 aa, Influenza virus
ILAFIMWACSS

SEQ ID NO: 527808 - protein, 11 aa, Influenza virus
ILAIYATVAGS

SEQ ID NO: 527809 - protein, 11 aa, Influenza virus
ILAIYSTAASS

SEQ ID NO: 527810 - protein, 11 aa, Influenza virus
ILAIYSTISSS

SEQ ID NO: 527811 - protein, 11 aa, Influenza virus
ILAIYSTVASS

SEQ ID NO: 527812 - protein, 11 aa, Influenza virus
ILAIYSTVSSS

SEQ ID NO: 527813 - protein, 11 aa, Influenza virus
ILANNGKFEFI

SEQ ID NO: 527814 - protein, 11 aa, Influenza virus
ILANNGRFEFI

SEQ ID NO: 527815 - protein, 11 aa, Influenza virus
ILASSGSLEFI

SEQ ID NO: 527816 - protein, 11 aa, Influenza virus
ILATTITLHFK

SEQ ID NO: 527817 - protein, 11 aa, Influenza virus
ILATTVTLHFK

SEQ ID NO: 527818 - protein, 11 aa, Influenza virus
ILDEHDSNVKN

SEQ ID NO: 527819 - protein, 11 aa, Influenza virus
ILDFHDSNVKN

SEQ ID NO: 527820 - protein, 11 aa, Influenza virus
ILDGVTASCRD

SEQ ID NO: 527821 - protein, 11 aa, Influenza virus
ILDQNFRNIRK

SEQ ID NO: 527822 - protein, 11 aa, Influenza virus
ILEDEQMYQKC

SEQ ID NO: 527823 - protein, 11 aa, Influenza virus
ILEDEQMYQRC

SEQ ID NO: 527824 - protein, 11 aa, Influenza virus
ILEDERMYQKC

SEQ ID NO: 527825 - protein, 11 aa, Influenza virus
ILEEESDEALK

SEQ ID NO: 527826 - protein, 11 aa, Influenza virus
ILEENTTYKIL

SEQ ID NO: 527827 - protein, 11 aa, Influenza virus
ILEGTTASCQN

SEQ ID NO: 527828 - protein, 11 aa, Influenza virus
ILEKMHNGKLC

SEQ ID NO: 527829 - protein, 11 aa, Influenza virus
ILEKNITVTHS

SEQ ID NO: 527830 - protein, 11 aa, Influenza virus
ILEKNVTVTHA

SEQ ID NO: 527831 - protein, 11 aa, Influenza virus
ILEKNVTVTHS

SEQ ID NO: 527832 - protein, 11 aa, Influenza virus
ILEKTHNGKLC

SEQ ID NO: 527833 - protein, 11 aa, Influenza virus
ILEKTHNGRLC

SEQ ID NO: 527834 - protein, 11 aa, Influenza virus
ILEKVHNGKLC

SEQ ID NO: 527835 - protein, 11 aa, Influenza virus
ILEQNVTVTHA

SEQ ID NO: 527836 - protein, 11 aa, Influenza virus
ILERNVTVTHA

SEQ ID NO: 527837 - protein, 11 aa, Influenza virus
ILERNVTVTHS

SEQ ID NO: 527838 - protein, 11 aa, Influenza virus
ILERTHNGKLC

SEQ ID NO: 527839 - protein, 11 aa, Influenza virus
ILETGYICSKF

SEQ ID NO: 527840 - protein, 11 aa, Influenza virus
ILETGYVCGKF

SEQ ID NO: 527841 - protein, 11 aa, Influenza virus
ILETGYVCSKF

SEQ ID NO: 527842 - protein, 11 aa, Influenza virus
ILETRYVCSKF

SEQ ID NO: 527843 - protein, 11 aa, Influenza virus
ILFNTIGNLIA

SEQ ID NO: 527844 - protein, 11 aa, Influenza virus
ILGFVFTLTVP

SEQ ID NO: 527845 - protein, 11 aa, Influenza virus
ILGFVLWACQN

SEQ ID NO: 527846 - protein, 11 aa, Influenza virus
ILGILTGPPQC

SEQ ID NO: 527847 - protein, 11 aa, Influenza virus
ILGMQNGSCRC

SEQ ID NO: 527848 - protein, 11 aa, Influenza virus
ILGMQNGSYRC

SEQ ID NO: 527849 - protein, 11 aa, Influenza virus
ILGNGCFEFWH

SEQ ID NO: 527850 - protein, 11 aa, Influenza virus
ILGNPKCDLYL

SEQ ID NO: 527851 - protein, 11 aa, Influenza virus
ILGNPKCDPYL

SEQ ID NO: 527852 - protein, 11 aa, Influenza virus
ILGNPMCDDLI

SEQ ID NO: 527853 - protein, 11 aa, Influenza virus
ILGNPMCDELI

SEQ ID NO: 527854 - protein, 11 aa, Influenza virus
ILGNPMCDNLI

SEQ ID NO: 527855 - protein, 11 aa, Influenza virus
ILGNPMCDYLI

SEQ ID NO: 527856 - protein, 11 aa, Influenza virus
ILGNPRCDDLI

SEQ ID NO: 527857 - protein, 11 aa, Influenza virus
ILGTIIGPPQC

SEQ ID NO: 527858 - protein, 11 aa, Influenza virus
ILHKCDNECME

SEQ ID NO: 527859 - protein, 11 aa, Influenza virus
ILHKCDNKCME

SEQ ID NO: 527860 - protein, 11 aa, Influenza virus
ILHKCNDSCME

SEQ ID NO: 527861 - protein, 11 aa, Influenza virus
ILHKCNNECME

SEQ ID NO: 527862 - protein, 11 aa, Influenza virus
ILIAGGLILGM

SEQ ID NO: 527863 - protein, 11 aa, Influenza virus
ILITQESECVC

SEQ ID NO: 527864 - protein, 11 aa, Influenza virus
ILKDCSIAGWL

SEQ ID NO: 527865 - protein, 11 aa, Influenza virus
ILKDCSVAGWL

SEQ ID NO: 527866 - protein, 11 aa, Influenza virus
ILKGKFQTAAQ

SEQ ID NO: 527867 - protein, 11 aa, Influenza virus
ILKHNPTEEQA

SEQ ID NO: 527868 - protein, 11 aa, Influenza virus
ILKPGQTVKIQ

SEQ ID NO: 527869 - protein, 11 aa, Influenza virus
ILKQNPTEEQA

SEQ ID NO: 527870 - protein, 11 aa, Influenza virus
ILKRGETLKIR

SEQ ID NO: 527871 - protein, 11 aa, Influenza virus
ILKVPNALTDE

SEQ ID NO: 527872 - protein, 11 aa, Influenza virus
ILLENERTLDF

SEQ ID NO: 527873 - protein, 11 aa, Influenza virus
ILLENERTLDL

SEQ ID NO: 527874 - protein, 11 aa, Influenza virus
ILLNPFVSHKE

SEQ ID NO: 527875 - protein, 11 aa, Influenza virus
ILLSPEEVSET

SEQ ID NO: 527876 - protein, 11 aa, Influenza virus
ILNLLIGISNV

SEQ ID NO: 527877 - protein, 11 aa, Influenza virus
ILNNKNWSGYS

SEQ ID NO: 527878 - protein, 11 aa, Influenza virus
ILNTSQRGILE

SEQ ID NO: 527879 - protein, 11 aa, Influenza virus
ILNTSQRGVLE

SEQ ID NO: 527880 - protein, 11 aa, Influenza virus
ILPFDFDKISQ

SEQ ID NO: 527881 - protein, 11 aa, Influenza virus
ILPFDIDKIIT

SEQ ID NO: 527882 - protein, 11 aa, Influenza virus
ILRDCSVAGWL

SEQ ID NO: 527883 - protein, 11 aa, Influenza virus
ILRGAVAHKSC

SEQ ID NO: 527884 - protein, 11 aa, Influenza virus
ILRGSIAHKSC

SEQ ID NO: 527885 - protein, 11 aa, Influenza virus
ILRGSVAHKSC

SEQ ID NO: 527886 - protein, 11 aa, Influenza virus
ILRQNPSEEQA

SEQ ID NO: 527887 - protein, 11 aa, Influenza virus
ILRQNPTEEQA

SEQ ID NO: 527888 - protein, 11 aa, Influenza virus
ILRTHESECVC

SEQ ID NO: 527889 - protein, 11 aa, Influenza virus
ILRTQDSECVS

SEQ ID NO: 527890 - protein, 11 aa, Influenza virus
ILRTQESDCVC

SEQ ID NO: 527891 - protein, 11 aa, Influenza virus
ILRTQESECAC

SEQ ID NO: 527892 - protein, 11 aa, Influenza virus
ILRTQESECIC

SEQ ID NO: 527893 - protein, 11 aa, Influenza virus
ILRTQESECLC

SEQ ID NO: 527894 - protein, 11 aa, Influenza virus
ILRTQESECQC

SEQ ID NO: 527895 - protein, 11 aa, Influenza virus
ILRTQESECVC

SEQ ID NO: 527896 - protein, 11 aa, Influenza virus
ILRTQESECVR

SEQ ID NO: 527897 - protein, 11 aa, Influenza virus
ILRTQESECVS

SEQ ID NO: 527898 - protein, 11 aa, Influenza virus
ILRTQESSCSC

SEQ ID NO: 527899 - protein, 11 aa, Influenza virus
ILRTQESSCTC

SEQ ID NO: 527900 - protein, 11 aa, Influenza virus
ILRTQESSCVC

SEQ ID NO: 527901 - protein, 11 aa, Influenza virus
ILSIAPIMFSN

SEQ ID NO: 527902 - protein, 11 aa, Influenza virus
ILSIYSCIASS

SEQ ID NO: 527903 - protein, 11 aa, Influenza virus
ILSIYSCVASS

SEQ ID NO: 527904 - protein, 11 aa, Influenza virus
ILSIYSSVASS

SEQ ID NO: 527905 - protein, 11 aa, Influenza virus
ILSIYSTAASS

SEQ ID NO: 527906 - protein, 11 aa, Influenza virus
ILSIYSTVAAS

SEQ ID NO: 527907 - protein, 11 aa, Influenza virus
ILSIYSTVASS

SEQ ID NO: 527908 - protein, 11 aa, Influenza virus
ILSIYSTVSSS

SEQ ID NO: 527909 - protein, 11 aa, Influenza virus
ILSIYSTVTSS

SEQ ID NO: 527910 - protein, 11 aa, Influenza virus
ILSIYSTVVSS

SEQ ID NO: 527911 - protein, 11 aa, Influenza virus
ILSKDNAIRIG

SEQ ID NO: 527912 - protein, 11 aa, Influenza virus
ILSMAPIMFSN

SEQ ID NO: 527913 - protein, 11 aa, Influenza virus
ILSNPKCDLYL

SEQ ID NO: 527914 - protein, 11 aa, Influenza virus
ILSPLTKGILG

SEQ ID NO: 527915 - protein, 11 aa, Influenza virus
ILSPLTKGMLG

SEQ ID NO: 527916 - protein, 11 aa, Influenza virus
ILSVYSTVASS

SEQ ID NO: 527917 - protein, 11 aa, Influenza virus
ILTDSQTATKR

SEQ ID NO: 527918 - protein, 11 aa, Influenza virus
ILTDTSRPGDK

SEQ ID NO: 527919 - protein, 11 aa, Influenza virus
ILTDTSRPGDR

SEQ ID NO: 527920 - protein, 11 aa, Influenza virus
ILTDTSRPSDK

SEQ ID NO: 527921 - protein, 11 aa, Influenza virus
ILTIYSTAASS

SEQ ID NO: 527922 - protein, 11 aa, Influenza virus
ILTIYSTVASP

SEQ ID NO: 527923 - protein, 11 aa, Influenza virus
ILTIYSTVASS

SEQ ID NO: 527924 - protein, 11 aa, Influenza virus
ILTKITVDHMA

SEQ ID NO: 527925 - protein, 11 aa, Influenza virus
ILTKTTVDHMA

SEQ ID NO: 527926 - protein, 11 aa, Influenza virus
ILTRTTVDHMA

SEQ ID NO: 527927 - protein, 11 aa, Influenza virus
ILVAGGLILGM

SEQ ID NO: 527928 - protein, 11 aa, Influenza virus
ILVALALSHTA

SEQ ID NO: 527929 - protein, 11 aa, Influenza virus
ILVALENQHTI

SEQ ID NO: 527930 - protein, 11 aa, Influenza virus
ILVIYATVAGS

SEQ ID NO: 527931 - protein, 11 aa, Influenza virus
ILVLGLSMVKS

SEQ ID NO: 527932 - protein, 11 aa, Influenza virus
ILVLGLSMVRS

SEQ ID NO: 527933 - protein, 11 aa, Influenza virus
ILVSTNAYDRI

SEQ ID NO: 527934 - protein, 11 aa, Influenza virus
ILVTREPYLSC

SEQ ID NO: 527935 - protein, 11 aa, Influenza virus
ILVTREPYVSC

SEQ ID NO: 527936 - protein, 11 aa, Influenza virus
ILVTTVTLHFK

SEQ ID NO: 527937 - protein, 11 aa, Influenza virus
ILWACSSGNCR

SEQ ID NO: 527938 - protein, 11 aa, Influenza virus
ILWFSFGASCF

SEQ ID NO: 527939 - protein, 11 aa, Influenza virus
ILWFSFGASCV

SEQ ID NO: 527940 - protein, 11 aa, Influenza virus
ILWFSFGASSF

SEQ ID NO: 527941 - protein, 11 aa, Influenza virus
ILWFSLGASCF

SEQ ID NO: 527942 - protein, 11 aa, Influenza virus
ILWISFAISCF

SEQ ID NO: 527943 - protein, 11 aa, Influenza virus
ILWISFAISCL

SEQ ID NO: 527944 - protein, 11 aa, Influenza virus
ILWISFAMSCF

SEQ ID NO: 527945 - protein, 11 aa, Influenza virus
ILWISFATSCF

SEQ ID NO: 527946 - protein, 11 aa, Influenza virus
ILWISFSISCF

SEQ ID NO: 527947 - protein, 11 aa, Influenza virus
ILWISFSMSCF

SEQ ID NO: 527948 - protein, 11 aa, Influenza virus
ILWTSNSIVVF

SEQ ID NO: 527949 - protein, 11 aa, Influenza virus
ILWVSFSISCF

SEQ ID NO: 527950 - protein, 11 aa, Influenza virus
IMASQGTKRSY

SEQ ID NO: 527951 - protein, 11 aa, Influenza virus
IMEKNITVTHA

SEQ ID NO: 527952 - protein, 11 aa, Influenza virus
IMEKNVAVTHA

SEQ ID NO: 527953 - protein, 11 aa, Influenza virus
IMEKNVTVTHA

SEQ ID NO: 527954 - protein, 11 aa, Influenza virus
IMERNVTVTHA

SEQ ID NO: 527955 - protein, 11 aa, Influenza virus
IMESGGIDKIG

SEQ ID NO: 527956 - protein, 11 aa, Influenza virus
IMESGGIDKIS

SEQ ID NO: 527957 - protein, 11 aa, Influenza virus
IMESGGIDKVS

SEQ ID NO: 527958 - protein, 11 aa, Influenza virus
IMESGGISKIS

SEQ ID NO: 527959 - protein, 11 aa, Influenza virus
IMESGGISKMS

SEQ ID NO: 527960 - protein, 11 aa, Influenza virus
IMEVVFPNEVG

SEQ ID NO: 527961 - protein, 11 aa, Influenza virus
IMFSNKMAKLG

SEQ ID NO: 527962 - protein, 11 aa, Influenza virus
IMFSNKMARLG

SEQ ID NO: 527963 - protein, 11 aa, Influenza virus
IMFSNKVARLG

SEQ ID NO: 527964 - protein, 11 aa, Influenza virus
IMGLFFFCLKN

SEQ ID NO: 527965 - protein, 11 aa, Influenza virus
IMGLVFFCLKN

SEQ ID NO: 527966 - protein, 11 aa, Influenza virus
IMGLVFFCLRN

SEQ ID NO: 527967 - protein, 11 aa, Influenza virus
IMHDRTKIRQL

SEQ ID NO: 527968 - protein, 11 aa, Influenza virus
IMINPVKLSGG

SEQ ID NO: 527969 - protein, 11 aa, Influenza virus
IMINPVKLSSG

SEQ ID NO: 527970 - protein, 11 aa, Influenza virus
IMIWHSNLNDA

SEQ ID NO: 527971 - protein, 11 aa, Influenza virus
IMIWHSNLNDT

SEQ ID NO: 527972 - protein, 11 aa, Influenza virus
IMNTSKPFQNT

SEQ ID NO: 527973 - protein, 11 aa, Influenza virus
IMQNKLNNVID

SEQ ID NO: 527974 - protein, 11 aa, Influenza virus
IMRTQESECAC

SEQ ID NO: 527975 - protein, 11 aa, Influenza virus
IMRTQESECVC

SEQ ID NO: 527976 - protein, 11 aa, Influenza virus
IMRTQESSCTC

SEQ ID NO: 527977 - protein, 11 aa, Influenza virus
IMRTVIALSYI

SEQ ID NO: 527978 - protein, 11 aa, Influenza virus
IMTDGPANSQA

SEQ ID NO: 527979 - protein, 11 aa, Influenza virus
IMTDGPASSQA

SEQ ID NO: 527980 - protein, 11 aa, Influenza virus
IMTDGSASSQA

SEQ ID NO: 527981 - protein, 11 aa, Influenza virus
IMTIGSVSLAL

SEQ ID NO: 527982 - protein, 11 aa, Influenza virus
IMWACNSGNCR

SEQ ID NO: 527983 - protein, 11 aa, Influenza virus
IMWACQKGNIK

SEQ ID NO: 527984 - protein, 11 aa, Influenza virus
IMWACQKGNIR

SEQ ID NO: 527985 - protein, 11 aa, Influenza virus
IMWACQRGNIR

SEQ ID NO: 527986 - protein, 11 aa, Influenza virus
IMWACSNGNCR

SEQ ID NO: 527987 - protein, 11 aa, Influenza virus
IMWACSNGSCR

SEQ ID NO: 527988 - protein, 11 aa, Influenza virus
IMWACSSGNCR

SEQ ID NO: 527989 - protein, 11 aa, Influenza virus
IMWTCNSGNCR

SEQ ID NO: 527990 - protein, 11 aa, Influenza virus
IMWTCQKGNIR

SEQ ID NO: 527991 - protein, 11 aa, Influenza virus
INDPWVLLNAS

SEQ ID NO: 527992 - protein, 11 aa, Influenza virus
INDQIEDLWAY

SEQ ID NO: 527993 - protein, 11 aa, Influenza virus
INDQITDIWAY

SEQ ID NO: 527994 - protein, 11 aa, Influenza virus
INDRNFWRGDN

SEQ ID NO: 527995 - protein, 11 aa, Influenza virus
INDRNFWRGEN

SEQ ID NO: 527996 - protein, 11 aa, Influenza virus
INECRTFFLTQ

SEQ ID NO: 527997 - protein, 11 aa, Influenza virus
INEEALRQKIM

SEQ ID NO: 527998 - protein, 11 aa, Influenza virus
INEGNGCFELL

SEQ ID NO: 527999 - protein, 11 aa, Influenza virus
INEITTKINNI

SEQ ID NO: 528000 - protein, 11 aa, Influenza virus
INESADMSIGI

SEQ ID NO: 528001 - protein, 11 aa, Influenza virus
INESADMSIGV

SEQ ID NO: 528002 - protein, 11 aa, Influenza virus
INEVKLEENTT

SEQ ID NO: 528003 - protein, 11 aa, Influenza virus
INFESNGNLIA

SEQ ID NO: 528004 - protein, 11 aa, Influenza virus
INFESTGNLIA

SEQ ID NO: 528005 - protein, 11 aa, Influenza virus
INFESTGNLVA

SEQ ID NO: 528006 - protein, 11 aa, Influenza virus
INGALGSPGCD

SEQ ID NO: 528007 - protein, 11 aa, Influenza virus
INGICTVVMTD

SEQ ID NO: 528008 - protein, 11 aa, Influenza virus
INGKLNRLIEK

SEQ ID NO: 528009 - protein, 11 aa, Influenza virus
INGKLNRLIER

SEQ ID NO: 528010 - protein, 11 aa, Influenza virus
INGPDSVLVNT

SEQ ID NO: 528011 - protein, 11 aa, Influenza virus
INGPESVLINT

SEQ ID NO: 528012 - protein, 11 aa, Influenza virus
INGPESVLVNT

SEQ ID NO: 528013 - protein, 11 aa, Influenza virus
INGQAGRMTFY

SEQ ID NO: 528014 - protein, 11 aa, Influenza virus
INGQSGRIDFH

SEQ ID NO: 528015 - protein, 11 aa, Influenza virus
INGQSGRIDFY

SEQ ID NO: 528016 - protein, 11 aa, Influenza virus
INGSCAVVMTD

SEQ ID NO: 528017 - protein, 11 aa, Influenza virus
INGSCIVVMTD

SEQ ID NO: 528018 - protein, 11 aa, Influenza virus
INGSCTVVMTD

SEQ ID NO: 528019 - protein, 11 aa, Influenza virus
INGTCAVVMTD

SEQ ID NO: 528020 - protein, 11 aa, Influenza virus
INGTCTVIMTD

SEQ ID NO: 528021 - protein, 11 aa, Influenza virus
INGTCTVVITD

SEQ ID NO: 528022 - protein, 11 aa, Influenza virus
INGTCTVVMTD

SEQ ID NO: 528023 - protein, 11 aa, Influenza virus
INGVILEENTT

SEQ ID NO: 528024 - protein, 11 aa, Influenza virus
INGVKLEENST

SEQ ID NO: 528025 - protein, 11 aa, Influenza virus
INGVKLEENTS

SEQ ID NO: 528026 - protein, 11 aa, Influenza virus
INGVKLEENTT

SEQ ID NO: 528027 - protein, 11 aa, Influenza virus
INGVRLEENTT

SEQ ID NO: 528028 - protein, 11 aa, Influenza virus
INGVTNKVNSI

SEQ ID NO: 528029 - protein, 11 aa, Influenza virus
INGWYGFQHQN

SEQ ID NO: 528030 - protein, 11 aa, Influenza virus
INGWYGFQHRD

SEQ ID NO: 528031 - protein, 11 aa, Influenza virus
INGWYGFQHRN

SEQ ID NO: 528032 - protein, 11 aa, Influenza virus
INGWYGFRHQN

SEQ ID NO: 528033 - protein, 11 aa, Influenza virus
INIMASQGTKR

SEQ ID NO: 528034 - protein, 11 aa, Influenza virus
INIREWSYLIE

SEQ ID NO: 528035 - protein, 11 aa, Influenza virus
INKITNKVNNI

SEQ ID NO: 528036 - protein, 11 aa, Influenza virus
INKTGTFEFTS

SEQ ID NO: 528037 - protein, 11 aa, Influenza virus
INKVCTKGKKA

SEQ ID NO: 528038 - protein, 11 aa, Influenza virus
INLHAYISFRN

SEQ ID NO: 528039 - protein, 11 aa, Influenza virus
INLLIGISNMS

SEQ ID NO: 528040 - protein, 11 aa, Influenza virus
INLYASKNPYT

SEQ ID NO: 528041 - protein, 11 aa, Influenza virus
INMIADRVDDA

SEQ ID NO: 528042 - protein, 11 aa, Influenza virus
INMINDKIDDQ

SEQ ID NO: 528043 - protein, 11 aa, Influenza virus
INMINDKINDQ

SEQ ID NO: 528044 - protein, 11 aa, Influenza virus
INMINSKIDDQ

SEQ ID NO: 528045 - protein, 11 aa, Influenza virus
INMINSKIEDQ

SEQ ID NO: 528046 - protein, 11 aa, Influenza virus
INMINSKINDQ

SEQ ID NO: 528047 - protein, 11 aa, Influenza virus
INMINSQIDDQ

SEQ ID NO: 528048 - protein, 11 aa, Influenza virus
INMISDKIDDQ

SEQ ID NO: 528049 - protein, 11 aa, Influenza virus
INMLADRIDDA

SEQ ID NO: 528050 - protein, 11 aa, Influenza virus
INMLADRVDDA

SEQ ID NO: 528051 - protein, 11 aa, Influenza virus
INMLADWVDDA

SEQ ID NO: 528052 - protein, 11 aa, Influenza virus
INMSKKKSYIN

SEQ ID NO: 528053 - protein, 11 aa, Influenza virus
INMSKRKSYIN

SEQ ID NO: 528054 - protein, 11 aa, Influenza virus
INNDLGPATAQ

SEQ ID NO: 528055 - protein, 11 aa, Influenza virus
INNETIIETGY

SEQ ID NO: 528056 - protein, 11 aa, Influenza virus
INNETILETGY

SEQ ID NO: 528057 - protein, 11 aa, Influenza virus
INNETIVETGY

SEQ ID NO: 528058 - protein, 11 aa, Influenza virus
INNGKGRYGVK

SEQ ID NO: 528059 - protein, 11 aa, Influenza virus
INNIIDKMNGN

SEQ ID NO: 528060 - protein, 11 aa, Influenza virus
INNIIEKMNGN

SEQ ID NO: 528061 - protein, 11 aa, Influenza virus
INNIVDKMNRE

SEQ ID NO: 528062 - protein, 11 aa, Influenza virus
INNQNWSGYSG

SEQ ID NO: 528063 - protein, 11 aa, Influenza virus
INNRIKINPVT

SEQ ID NO: 528064 - protein, 11 aa, Influenza virus
INPTLLFLKVP

SEQ ID NO: 528065 - protein, 11 aa, Influenza virus
INPVELSSGYK

SEQ ID NO: 528066 - protein, 11 aa, Influenza virus
INPVKLSGGYK

SEQ ID NO: 528067 - protein, 11 aa, Influenza virus
INPVKLSSGYK

SEQ ID NO: 528068 - protein, 11 aa, Influenza virus
INPVTLSSGYK

SEQ ID NO: 528069 - protein, 11 aa, Influenza virus
INPVTLTMGYK

SEQ ID NO: 528070 - protein, 11 aa, Influenza virus
INQINGKLNRL

SEQ ID NO: 528071 - protein, 11 aa, Influenza virus
INQITGKLNRI

SEQ ID NO: 528072 - protein, 11 aa, Influenza virus
INQITGKLNRL

SEQ ID NO: 528073 - protein, 11 aa, Influenza virus
INRCFYVELIR

SEQ ID NO: 528074 - protein, 11 aa, Influenza virus
INRCFYVELTR

SEQ ID NO: 528075 - protein, 11 aa, Influenza virus
INRCFYVELVR

SEQ ID NO: 528076 - protein, 11 aa, Influenza virus
INRIFQPNIGP

SEQ ID NO: 528077 - protein, 11 aa, Influenza virus
INRIFRPNIGP

SEQ ID NO: 528078 - protein, 11 aa, Influenza virus
INRNFKPNIGP

SEQ ID NO: 528079 - protein, 11 aa, Influenza virus
INRNFQPNIGP

SEQ ID NO: 528080 - protein, 11 aa, Influenza virus
INRQEIEGARL

SEQ ID NO: 528081 - protein, 11 aa, Influenza virus
INRQEIEGVKL

SEQ ID NO: 528082 - protein, 11 aa, Influenza virus
INRQEIEGVRL

SEQ ID NO: 528083 - protein, 11 aa, Influenza virus
INRSFKPNIGP

SEQ ID NO: 528084 - protein, 11 aa, Influenza virus
INRSFQPNIGP

SEQ ID NO: 528085 - protein, 11 aa, Influenza virus
INRSFRPNIGP

SEQ ID NO: 528086 - protein, 11 aa, Influenza virus
INRTGTFEFTS

SEQ ID NO: 528087 - protein, 11 aa, Influenza virus
INSIIDKMNTQ

SEQ ID NO: 528088 - protein, 11 aa, Influenza virus
INSPLPFQNID

SEQ ID NO: 528089 - protein, 11 aa, Influenza virus
INSSKPFQNAS

SEQ ID NO: 528090 - protein, 11 aa, Influenza virus
INSSKPFQNTS

SEQ ID NO: 528091 - protein, 11 aa, Influenza virus
INSSKPLQNAS

SEQ ID NO: 528092 - protein, 11 aa, Influenza virus
INSSMPFHNIH

SEQ ID NO: 528093 - protein, 11 aa, Influenza virus
INSSMPFHNVH

SEQ ID NO: 528094 - protein, 11 aa, Influenza virus
INSSMPLHNIH

SEQ ID NO: 528095 - protein, 11 aa, Influenza virus
INSSRPFQNAS

SEQ ID NO: 528096 - protein, 11 aa, Influenza virus
INSSYVCSGLV

SEQ ID NO: 528097 - protein, 11 aa, Influenza virus
INSVKLFSGYK

SEQ ID NO: 528098 - protein, 11 aa, Influenza virus
INSVKLSSGYK

SEQ ID NO: 528099 - protein, 11 aa, Influenza virus
INSWHIFGKDN

SEQ ID NO: 528100 - protein, 11 aa, Influenza virus
INSWHIYGKDN

SEQ ID NO: 528101 - protein, 11 aa, Influenza virus
INTALLNASCA

SEQ ID NO: 528102 - protein, 11 aa, Influenza virus
INTAMLNASCA

SEQ ID NO: 528103 - protein, 11 aa, Influenza virus
INTINSKIDDQ

SEQ ID NO: 528104 - protein, 11 aa, Influenza virus
INTKLPFQNLS

SEQ ID NO: 528105 - protein, 11 aa, Influenza virus
INTLTERGVEV

SEQ ID NO: 528106 - protein, 11 aa, Influenza virus
INTNKTFQNID

SEQ ID NO: 528107 - protein, 11 aa, Influenza virus
INTNKTFQNIE

SEQ ID NO: 528108 - protein, 11 aa, Influenza virus
INTNRTFQNID

SEQ ID NO: 528109 - protein, 11 aa, Influenza virus
INTRLPFQNLS

SEQ ID NO: 528110 - protein, 11 aa, Influenza virus
INTSKPFQNTS

SEQ ID NO: 528111 - protein, 11 aa, Influenza virus
INTTLPFHNIH

SEQ ID NO: 528112 - protein, 11 aa, Influenza virus
INTTLPFHNVH

SEQ ID NO: 528113 - protein, 11 aa, Influenza virus
INTWARNILRT

SEQ ID NO: 528114 - protein, 11 aa, Influenza virus
INTYQWIIRNW

SEQ ID NO: 528115 - protein, 11 aa, Influenza virus
INVINDKIDDQ

SEQ ID NO: 528116 - protein, 11 aa, Influenza virus
INVTKENTGSY

SEQ ID NO: 528117 - protein, 11 aa, Influenza virus
INWLTKKEPDT

SEQ ID NO: 528118 - protein, 11 aa, Influenza virus
INWLTKKKNPE

SEQ ID NO: 528119 - protein, 11 aa, Influenza virus
INWLTKKKPDI

SEQ ID NO: 528120 - protein, 11 aa, Influenza virus
INWLTKKKPDT

SEQ ID NO: 528121 - protein, 11 aa, Influenza virus
INWTKDSITDI

SEQ ID NO: 528122 - protein, 11 aa, Influenza virus
INWTQDAMTEV

SEQ ID NO: 528123 - protein, 11 aa, Influenza virus
INWTRDAMTEI

SEQ ID NO: 528124 - protein, 11 aa, Influenza virus
INWTRDAMTEV

SEQ ID NO: 528125 - protein, 11 aa, Influenza virus
INWTRDSITEV

SEQ ID NO: 528126 - protein, 11 aa, Influenza virus
INWTRDSLTEI

SEQ ID NO: 528127 - protein, 11 aa, Influenza virus
INWTRDSMTEI

SEQ ID NO: 528128 - protein, 11 aa, Influenza virus
INWTRDSMTEV

SEQ ID NO: 528129 - protein, 11 aa, Influenza virus
INWTRDSVTEL

SEQ ID NO: 528130 - protein, 11 aa, Influenza virus
INYYNETFVNV

SEQ ID NO: 528131 - protein, 11 aa, Influenza virus
IPCFWVEMIRG

SEQ ID NO: 528132 - protein, 11 aa, Influenza virus
IPEAGLKWELM

SEQ ID NO: 528133 - protein, 11 aa, Influenza virus
IPEVCLKWDLM

SEQ ID NO: 528134 - protein, 11 aa, Influenza virus
IPEVCLKWELM

SEQ ID NO: 528135 - protein, 11 aa, Influenza virus
IPEVCLKWGLM

SEQ ID NO: 528136 - protein, 11 aa, Influenza virus
IPFHLGTKQVC

SEQ ID NO: 528137 - protein, 11 aa, Influenza virus
IPGKQAKGLFG

SEQ ID NO: 528138 - protein, 11 aa, Influenza virus
IPHRTLLMNEL

SEQ ID NO: 528139 - protein, 11 aa, Influenza virus
IPHRTLLMSEL

SEQ ID NO: 528140 - protein, 11 aa, Influenza virus
IPIGERGLFGA

SEQ ID NO: 528141 - protein, 11 aa, Influenza virus
IPKRNRSILNT

SEQ ID NO: 528142 - protein, 11 aa, Influenza virus
IPLTTTPTKSY

SEQ ID NO: 528143 - protein, 11 aa, Influenza virus
IPMISKCKTKE

SEQ ID NO: 528144 - protein, 11 aa, Influenza virus
IPMISKCRTKE

SEQ ID NO: 528145 - protein, 11 aa, Influenza virus
IPMISKCRTRE

SEQ ID NO: 528146 - protein, 11 aa, Influenza virus
IPMISKSRTKE

SEQ ID NO: 528147 - protein, 11 aa, Influenza virus
IPMISNCRTKE

SEQ ID NO: 528148 - protein, 11 aa, Influenza virus
IPPLELGDCSI

SEQ ID NO: 528149 - protein, 11 aa, Influenza virus
IPPLELGNCSI

SEQ ID NO: 528150 - protein, 11 aa, Influenza virus
IPPLELRDCSI

SEQ ID NO: 528151 - protein, 11 aa, Influenza virus
IPPLVLGDCSI

SEQ ID NO: 528152 - protein, 11 aa, Influenza virus
IPQIESRGLFG

SEQ ID NO: 528153 - protein, 11 aa, Influenza virus
IPSGPLKAEIA

SEQ ID NO: 528154 - protein, 11 aa, Influenza virus
IPSGSLKLAIG

SEQ ID NO: 528155 - protein, 11 aa, Influenza virus
IPSIQSRGLFG

SEQ ID NO: 528156 - protein, 11 aa, Influenza virus
IPSNSLKLAIG

SEQ ID NO: 528157 - protein, 11 aa, Influenza virus
IPSRSLKLAIG

SEQ ID NO: 528158 - protein, 11 aa, Influenza virus
IPSVQSRGLFG

SEQ ID NO: 528159 - protein, 11 aa, Influenza virus
IPSWAGNILRT

SEQ ID NO: 528160 - protein, 11 aa, Influenza virus
IPSWAGNVLRT

SEQ ID NO: 528161 - protein, 11 aa, Influenza virus
IPSWEGNILRT

SEQ ID NO: 528162 - protein, 11 aa, Influenza virus
IPTDTPRFQDS

SEQ ID NO: 528163 - protein, 11 aa, Influenza virus
IPTDTPRIQDS

SEQ ID NO: 528164 - protein, 11 aa, Influenza virus
IPTDTPRVQDD

SEQ ID NO: 528165 - protein, 11 aa, Influenza virus
IPTDTPRVQDN

SEQ ID NO: 528166 - protein, 11 aa, Influenza virus
IPTDTPRVQDS

SEQ ID NO: 528167 - protein, 11 aa, Influenza virus
IPVTQTMELVE

SEQ ID NO: 528168 - protein, 11 aa, Influenza virus
IPVTQVEELVH

SEQ ID NO: 528169 - protein, 11 aa, Influenza virus
IQAGVDRFYRI

SEQ ID NO: 528170 - protein, 11 aa, Influenza virus
IQAGVDRFYRT

SEQ ID NO: 528171 - protein, 11 aa, Influenza virus
IQAGVNRFYRT

SEQ ID NO: 528172 - protein, 11 aa, Influenza virus
IQALQLLLEVE

SEQ ID NO: 528173 - protein, 11 aa, Influenza virus
IQDIWAYNAEL

SEQ ID NO: 528174 - protein, 11 aa, Influenza virus
IQDLEKYIEDT

SEQ ID NO: 528175 - protein, 11 aa, Influenza virus
IQDLEKYVEDT

SEQ ID NO: 528176 - protein, 11 aa, Influenza virus
IQDLERYVEDT

SEQ ID NO: 528177 - protein, 11 aa, Influenza virus
IQDLWAYNAEL

SEQ ID NO: 528178 - protein, 11 aa, Influenza virus
IQDVWAYNAEL

SEQ ID NO: 528179 - protein, 11 aa, Influenza virus
IQGIKLTQGYK

SEQ ID NO: 528180 - protein, 11 aa, Influenza virus
IQGNNDNATAT

SEQ ID NO: 528181 - protein, 11 aa, Influenza virus
IQGVKLAQGYK

SEQ ID NO: 528182 - protein, 11 aa, Influenza virus
IQGVKLIQGYK

SEQ ID NO: 528183 - protein, 11 aa, Influenza virus
IQGVKLTQGYK

SEQ ID NO: 528184 - protein, 11 aa, Influenza virus
IQGVRLTQGYK

SEQ ID NO: 528185 - protein, 11 aa, Influenza virus
IQHLEECSCYM

SEQ ID NO: 528186 - protein, 11 aa, Influenza virus
IQHLEECSCYT

SEQ ID NO: 528187 - protein, 11 aa, Influenza virus
IQHLEECSCYV

SEQ ID NO: 528188 - protein, 11 aa, Influenza virus
IQHPELTGLNC

SEQ ID NO: 528189 - protein, 11 aa, Influenza virus
IQIDPVKLSGG

SEQ ID NO: 528190 - protein, 11 aa, Influenza virus
IQIDPVKLSSG

SEQ ID NO: 528191 - protein, 11 aa, Influenza virus
IQIDQVKLSSG

SEQ ID NO: 528192 - protein, 11 aa, Influenza virus
IQIDSVKLSSG

SEQ ID NO: 528193 - protein, 11 aa, Influenza virus
IQINPVKLSSG

SEQ ID NO: 528194 - protein, 11 aa, Influenza virus
IQNALNGNGDP

SEQ ID NO: 528195 - protein, 11 aa, Influenza virus
IQNEDIPIENC

SEQ ID NO: 528196 - protein, 11 aa, Influenza virus
IQNEDIPIGNC

SEQ ID NO: 528197 - protein, 11 aa, Influenza virus
IQNEDIPIGSC

SEQ ID NO: 528198 - protein, 11 aa, Influenza virus
IQNEFNKACEL

SEQ ID NO: 528199 - protein, 11 aa, Influenza virus
IQNIWAYNAEL

SEQ ID NO: 528200 - protein, 11 aa, Influenza virus
IQPGDNITFSH

SEQ ID NO: 528201 - protein, 11 aa, Influenza virus
IQPTFSVQRNL

SEQ ID NO: 528202 - protein, 11 aa, Influenza virus
IQQTRVDKLTQ

SEQ ID NO: 528203 - protein, 11 aa, Influenza virus
IQSDAQIDESC

SEQ ID NO: 528204 - protein, 11 aa, Influenza virus
IQSDKPFQNVS

SEQ ID NO: 528205 - protein, 11 aa, Influenza virus
IQSEFNKACEL

SEQ ID NO: 528206 - protein, 11 aa, Influenza virus
IQSKGLFGAIA

SEQ ID NO: 528207 - protein, 11 aa, Influenza virus
IQSRGLFGAIA

SEQ ID NO: 528208 - protein, 11 aa, Influenza virus
IQTLVSNNDWS

SEQ ID NO: 528209 - protein, 11 aa, Influenza virus
IQTNGNLIAPE

SEQ ID NO: 528210 - protein, 11 aa, Influenza virus
IQTRGLFGAIA

SEQ ID NO: 528211 - protein, 11 aa, Influenza virus
IQTSGNLIAPE

SEQ ID NO: 528212 - protein, 11 aa, Influenza virus
IRALTLNTMTK

SEQ ID NO: 528213 - protein, 11 aa, Influenza virus
IRCVCRDNWKG

SEQ ID NO: 528214 - protein, 11 aa, Influenza virus
IREGLILEYYF

SEQ ID NO: 528215 - protein, 11 aa, Influenza virus
IREPFISCSHL

SEQ ID NO: 528216 - protein, 11 aa, Influenza virus
IREPFISCSPL

SEQ ID NO: 528217 - protein, 11 aa, Influenza virus
IREPFISCSQL

SEQ ID NO: 528218 - protein, 11 aa, Influenza virus
IREPFVACGPA

SEQ ID NO: 528219 - protein, 11 aa, Influenza virus
IREPFVACGPS

SEQ ID NO: 528220 - protein, 11 aa, Influenza virus
IREPFVACGPT

SEQ ID NO: 528221 - protein, 11 aa, Influenza virus
IREPFVACSPS

SEQ ID NO: 528222 - protein, 11 aa, Influenza virus
IREPFVSCGPS

SEQ ID NO: 528223 - protein, 11 aa, Influenza virus
IRESGGIDKEP

SEQ ID NO: 528224 - protein, 11 aa, Influenza virus
IRESGGIDKES

SEQ ID NO: 528225 - protein, 11 aa, Influenza virus
IREWSYLIEDP

SEQ ID NO: 528226 - protein, 11 aa, Influenza virus
IRFGEGEQIIV

SEQ ID NO: 528227 - protein, 11 aa, Influenza virus
IRFGESEQIIV

SEQ ID NO: 528228 - protein, 11 aa, Influenza virus
IRFGESEQIVV

SEQ ID NO: 528229 - protein, 11 aa, Influenza virus
IRFGESEQVIV

SEQ ID NO: 528230 - protein, 11 aa, Influenza virus
IRFNSDLDYQI

SEQ ID NO: 528231 - protein, 11 aa, Influenza virus
IRFNSDLNYQI

SEQ ID NO: 528232 - protein, 11 aa, Influenza virus
IRFNSNLDYQI

SEQ ID NO: 528233 - protein, 11 aa, Influenza virus
IRGEFNQVEKR

SEQ ID NO: 528234 - protein, 11 aa, Influenza virus
IRGEFNQVENR

SEQ ID NO: 528235 - protein, 11 aa, Influenza virus
IRGEFNQVEQR

SEQ ID NO: 528236 - protein, 11 aa, Influenza virus
IRGEFSQVEQR

SEQ ID NO: 528237 - protein, 11 aa, Influenza virus
IRGEFSQVERR

SEQ ID NO: 528238 - protein, 11 aa, Influenza virus
IRGETTGRNCT

SEQ ID NO: 528239 - protein, 11 aa, Influenza virus
IRGFVHFVEAL

SEQ ID NO: 528240 - protein, 11 aa, Influenza virus
IRGFVYFVEAL

SEQ ID NO: 528241 - protein, 11 aa, Influenza virus
IRGFVYFVEIL

SEQ ID NO: 528242 - protein, 11 aa, Influenza virus
IRGFVYFVETL

SEQ ID NO: 528243 - protein, 11 aa, Influenza virus
IRGKHSNGTIH

SEQ ID NO: 528244 - protein, 11 aa, Influenza virus
IRGNSPIFNYN

SEQ ID NO: 528245 - protein, 11 aa, Influenza virus
IRGNSPVFNYN

SEQ ID NO: 528246 - protein, 11 aa, Influenza virus
IRGQPKEKAIW

SEQ ID NO: 528247 - protein, 11 aa, Influenza virus
IRGQPKEKTIW

SEQ ID NO: 528248 - protein, 11 aa, Influenza virus
IRGQPKERTIW

SEQ ID NO: 528249 - protein, 11 aa, Influenza virus
IRGQQGRMDYY

SEQ ID NO: 528250 - protein, 11 aa, Influenza virus
IRGRHSNGTIH

SEQ ID NO: 528251 - protein, 11 aa, Influenza virus
IRGRPEEAKYV

SEQ ID NO: 528252 - protein, 11 aa, Influenza virus
IRGRPEEVKYV

SEQ ID NO: 528253 - protein, 11 aa, Influenza virus
IRGRPKEDEVW

SEQ ID NO: 528254 - protein, 11 aa, Influenza virus
IRGRPKEDKVW

SEQ ID NO: 528255 - protein, 11 aa, Influenza virus
IRGRPKEDRVW

SEQ ID NO: 528256 - protein, 11 aa, Influenza virus
IRGRPKEEKVW

SEQ ID NO: 528257 - protein, 11 aa, Influenza virus
IRGVVYFVETL

SEQ ID NO: 528258 - protein, 11 aa, Influenza virus
IRGWAPLSKDN

SEQ ID NO: 528259 - protein, 11 aa, Influenza virus
IRHENRMVIAS

SEQ ID NO: 528260 - protein, 11 aa, Influenza virus
IRHENRMVLAS

SEQ ID NO: 528261 - protein, 11 aa, Influenza virus
IRHLEECSCYV

SEQ ID NO: 528262 - protein, 11 aa, Influenza virus
IRIAWSSSSCF

SEQ ID NO: 528263 - protein, 11 aa, Influenza virus
IRIGSKGDIFV

SEQ ID NO: 528264 - protein, 11 aa, Influenza virus
IRIGSKGDVFA

SEQ ID NO: 528265 - protein, 11 aa, Influenza virus
IRIGSKGDVFV

SEQ ID NO: 528266 - protein, 11 aa, Influenza virus
IRIGSKGHVFV

SEQ ID NO: 528267 - protein, 11 aa, Influenza virus
IRIGSRGDVFI

SEQ ID NO: 528268 - protein, 11 aa, Influenza virus
IRIGSRGDVFV

SEQ ID NO: 528269 - protein, 11 aa, Influenza virus
IRIGSRGEVFV

SEQ ID NO: 528270 - protein, 11 aa, Influenza virus
IRIGSRGHIFV

SEQ ID NO: 528271 - protein, 11 aa, Influenza virus
IRIGSRGHVFI

SEQ ID NO: 528272 - protein, 11 aa, Influenza virus
IRIGSRGHVFV

SEQ ID NO: 528273 - protein, 11 aa, Influenza virus
IRINNETILET

SEQ ID NO: 528274 - protein, 11 aa, Influenza virus
IRKGLILEYYS

SEQ ID NO: 528275 - protein, 11 aa, Influenza virus
IRLAAGGAIWV

SEQ ID NO: 528276 - protein, 11 aa, Influenza virus
IRLAAGGDIWV

SEQ ID NO: 528277 - protein, 11 aa, Influenza virus
IRLFDYSGWNV

SEQ ID NO: 528278 - protein, 11 aa, Influenza virus
IRLFDYSKWNV

SEQ ID NO: 528279 - protein, 11 aa, Influenza virus
IRLFDYSRWNV

SEQ ID NO: 528280 - protein, 11 aa, Influenza virus
IRLQLRDNAKE

SEQ ID NO: 528281 - protein, 11 aa, Influenza virus
IRLSADGDIWV

SEQ ID NO: 528282 - protein, 11 aa, Influenza virus
IRLSAGGAIWV

SEQ ID NO: 528283 - protein, 11 aa, Influenza virus
IRLSAGGDIWI

SEQ ID NO: 528284 - protein, 11 aa, Influenza virus
IRLSAGGDIWV

SEQ ID NO: 528285 - protein, 11 aa, Influenza virus
IRLSGGGDIWV

SEQ ID NO: 528286 - protein, 11 aa, Influenza virus
IRMAINWGRIV

SEQ ID NO: 528287 - protein, 11 aa, Influenza virus
IRMATNECRII

SEQ ID NO: 528288 - protein, 11 aa, Influenza virus
IRMIKRGINDR

SEQ ID NO: 528289 - protein, 11 aa, Influenza virus
IRMIKRGVNDR

SEQ ID NO: 528290 - protein, 11 aa, Influenza virus
IRMVKRGINDR

SEQ ID NO: 528291 - protein, 11 aa, Influenza virus
IRNGTYDHKEF

SEQ ID NO: 528292 - protein, 11 aa, Influenza virus
IRNGTYDHNIY

SEQ ID NO: 528293 - protein, 11 aa, Influenza virus
IRNGTYNHEDY

SEQ ID NO: 528294 - protein, 11 aa, Influenza virus
IRNKHSNGTIH

SEQ ID NO: 528295 - protein, 11 aa, Influenza virus
IRNKHSNGTTH

SEQ ID NO: 528296 - protein, 11 aa, Influenza virus
IRNKHSNSTTH

SEQ ID NO: 528297 - protein, 11 aa, Influenza virus
IRNLHIPEAGL

SEQ ID NO: 528298 - protein, 11 aa, Influenza virus
IRNLHIPEVCL

SEQ ID NO: 528299 - protein, 11 aa, Influenza virus
IRNNMINNDLG

SEQ ID NO: 528300 - protein, 11 aa, Influenza virus
IRNNSYDHSKY

SEQ ID NO: 528301 - protein, 11 aa, Influenza virus
IRNNTYDHAQY

SEQ ID NO: 528302 - protein, 11 aa, Influenza virus
IRNNTYDHKKY

SEQ ID NO: 528303 - protein, 11 aa, Influenza virus
IRNNTYDHSHY

SEQ ID NO: 528304 - protein, 11 aa, Influenza virus
IRNNTYDHSKY

SEQ ID NO: 528305 - protein, 11 aa, Influenza virus
IRNNTYDHSQY

SEQ ID NO: 528306 - protein, 11 aa, Influenza virus
IRNNTYDHSRY

SEQ ID NO: 528307 - protein, 11 aa, Influenza virus
IRNNTYDHSTY

SEQ ID NO: 528308 - protein, 11 aa, Influenza virus
IRNNTYDHTKY

SEQ ID NO: 528309 - protein, 11 aa, Influenza virus
IRNNTYDHTQY

SEQ ID NO: 528310 - protein, 11 aa, Influenza virus
IRNNTYNHTEY

SEQ ID NO: 528311 - protein, 11 aa, Influenza virus
IRNNTYNHTQY

SEQ ID NO: 528312 - protein, 11 aa, Influenza virus
IRNRHSNGTIH

SEQ ID NO: 528313 - protein, 11 aa, Influenza virus
IRPCFWVELIR

SEQ ID NO: 528314 - protein, 11 aa, Influenza virus
IRPCFWVELVR

SEQ ID NO: 528315 - protein, 11 aa, Influenza virus
IRPGYNGQKSW

SEQ ID NO: 528316 - protein, 11 aa, Influenza virus
IRRRVDINPGH

SEQ ID NO: 528317 - protein, 11 aa, Influenza virus
IRRRVDMNPGH

SEQ ID NO: 528318 - protein, 11 aa, Influenza virus
IRRRVDTNPGH

SEQ ID NO: 528319 - protein, 11 aa, Influenza virus
IRRRVDVNPGH

SEQ ID NO: 528320 - protein, 11 aa, Influenza virus
IRSFSRTELIA

SEQ ID NO: 528321 - protein, 11 aa, Influenza virus
IRSFSRTELIP

SEQ ID NO: 528322 - protein, 11 aa, Influenza virus
IRSILANNGKF

SEQ ID NO: 528323 - protein, 11 aa, Influenza virus
IRSWRKQILRT

SEQ ID NO: 528324 - protein, 11 aa, Influenza virus
IRTATREGKHI

SEQ ID NO: 528325 - protein, 11 aa, Influenza virus
IRTDGATSACK

SEQ ID NO: 528326 - protein, 11 aa, Influenza virus
IRTFSFQLILI

SEQ ID NO: 528327 - protein, 11 aa, Influenza virus
IRTFSFQLILL

SEQ ID NO: 528328 - protein, 11 aa, Influenza virus
IRTFSFQLINN

SEQ ID NO: 528329 - protein, 11 aa, Influenza virus
IRTKSGGNTNQ

SEQ ID NO: 528330 - protein, 11 aa, Influenza virus
IRTLTLNTMTK

SEQ ID NO: 528331 - protein, 11 aa, Influenza virus
IRTNGNLIAPE

SEQ ID NO: 528332 - protein, 11 aa, Influenza virus
IRTNGTSKIKM

SEQ ID NO: 528333 - protein, 11 aa, Influenza virus
IRTRGLFGAIA

SEQ ID NO: 528334 - protein, 11 aa, Influenza virus
IRTRSGGNNNQ

SEQ ID NO: 528335 - protein, 11 aa, Influenza virus
IRTRSGGNTNH

SEQ ID NO: 528336 - protein, 11 aa, Influenza virus
IRTRSGGNTNQ

SEQ ID NO: 528337 - protein, 11 aa, Influenza virus
IRTRSGGNTSQ

SEQ ID NO: 528338 - protein, 11 aa, Influenza virus
IRTWAKNILRT

SEQ ID NO: 528339 - protein, 11 aa, Influenza virus
IRVGCVILLNP

SEQ ID NO: 528340 - protein, 11 aa, Influenza virus
IRVGSRGHVFV

SEQ ID NO: 528341 - protein, 11 aa, Influenza virus
IRVKRRPVAKA

SEQ ID NO: 528342 - protein, 11 aa, Influenza virus
IRWETTGRNCT

SEQ ID NO: 528343 - protein, 11 aa, Influenza virus
IRWLTLKSGQF

SEQ ID NO: 528344 - protein, 11 aa, Influenza virus
ISCFLLAALLL

SEQ ID NO: 528345 - protein, 11 aa, Influenza virus
ISCFLLIALLL

SEQ ID NO: 528346 - protein, 11 aa, Influenza virus
ISCFLLVALFL

SEQ ID NO: 528347 - protein, 11 aa, Influenza virus
ISCFLLVALLI

SEQ ID NO: 528348 - protein, 11 aa, Influenza virus
ISCFLLVALLL

SEQ ID NO: 528349 - protein, 11 aa, Influenza virus
ISCSHLECRTF

SEQ ID NO: 528350 - protein, 11 aa, Influenza virus
ISCSHMECRTF

SEQ ID NO: 528351 - protein, 11 aa, Influenza virus
ISCSHSECRTF

SEQ ID NO: 528352 - protein, 11 aa, Influenza virus
ISCSIDECRTF

SEQ ID NO: 528353 - protein, 11 aa, Influenza virus
ISCSINECRTF

SEQ ID NO: 528354 - protein, 11 aa, Influenza virus
ISCSISECRTF

SEQ ID NO: 528355 - protein, 11 aa, Influenza virus
ISCSVSECRTF

SEQ ID NO: 528356 - protein, 11 aa, Influenza virus
ISCSYLECRTF

SEQ ID NO: 528357 - protein, 11 aa, Influenza virus
ISDGGPNLYNI

SEQ ID NO: 528358 - protein, 11 aa, Influenza virus
ISECRTFFLTQ

SEQ ID NO: 528359 - protein, 11 aa, Influenza virus
ISFAISCFLLC

SEQ ID NO: 528360 - protein, 11 aa, Influenza virus
ISFAISCLLLC

SEQ ID NO: 528361 - protein, 11 aa, Influenza virus
ISFAMSCFLLC

SEQ ID NO: 528362 - protein, 11 aa, Influenza virus
ISFATSCFLLC

SEQ ID NO: 528363 - protein, 11 aa, Influenza virus
ISFESNGGLLA

SEQ ID NO: 528364 - protein, 11 aa, Influenza virus
ISFESTGNLIA

SEQ ID NO: 528365 - protein, 11 aa, Influenza virus
ISFESTGNLVA

SEQ ID NO: 528366 - protein, 11 aa, Influenza virus
ISFQGGHIEEC

SEQ ID NO: 528367 - protein, 11 aa, Influenza virus
ISFQSGHIEEC

SEQ ID NO: 528368 - protein, 11 aa, Influenza virus
ISFSISCFLLA

SEQ ID NO: 528369 - protein, 11 aa, Influenza virus
ISFSISCFLLI

SEQ ID NO: 528370 - protein, 11 aa, Influenza virus
ISFSISCFLLV

SEQ ID NO: 528371 - protein, 11 aa, Influenza virus
ISFSMSCFVFV

SEQ ID NO: 528372 - protein, 11 aa, Influenza virus
ISFTITGDNTK

SEQ ID NO: 528373 - protein, 11 aa, Influenza virus
ISFWMCSGHSC

SEQ ID NO: 528374 - protein, 11 aa, Influenza virus
ISFWMCSNGSL

SEQ ID NO: 528375 - protein, 11 aa, Influenza virus
ISFYWTIVDPG

SEQ ID NO: 528376 - protein, 11 aa, Influenza virus
ISFYWTIVEPE

SEQ ID NO: 528377 - protein, 11 aa, Influenza virus
ISFYWTIVEPG

SEQ ID NO: 528378 - protein, 11 aa, Influenza virus
ISFYWTIVVPG

SEQ ID NO: 528379 - protein, 11 aa, Influenza virus
ISGADDDAYAV

SEQ ID NO: 528380 - protein, 11 aa, Influenza virus
ISGFIEGGWPG

SEQ ID NO: 528381 - protein, 11 aa, Influenza virus
ISGPDDGAVAV

SEQ ID NO: 528382 - protein, 11 aa, Influenza virus
ISGPDNEAVAV

SEQ ID NO: 528383 - protein, 11 aa, Influenza virus
ISGPDNGAVAV

SEQ ID NO: 528384 - protein, 11 aa, Influenza virus
ISGPDSGAVAV

SEQ ID NO: 528385 - protein, 11 aa, Influenza virus
ISGPNNNASAI

SEQ ID NO: 528386 - protein, 11 aa, Influenza virus
ISGPNNNASAV

SEQ ID NO: 528387 - protein, 11 aa, Influenza virus
ISGTCAVVMTD

SEQ ID NO: 528388 - protein, 11 aa, Influenza virus
ISGVKLEENST

SEQ ID NO: 528389 - protein, 11 aa, Influenza virus
ISGWTTANSKS

SEQ ID NO: 528390 - protein, 11 aa, Influenza virus
ISHCRATEYIM

SEQ ID NO: 528391 - protein, 11 aa, Influenza virus
ISHISPLSGSA

SEQ ID NO: 528392 - protein, 11 aa, Influenza virus
ISHRTLLMNEL

SEQ ID NO: 528393 - protein, 11 aa, Influenza virus
ISIGSSTYQNN

SEQ ID NO: 528394 - protein, 11 aa, Influenza virus
ISIGTSTLNQR

SEQ ID NO: 528395 - protein, 11 aa, Influenza virus
ISIVPNIGSRP

SEQ ID NO: 528396 - protein, 11 aa, Influenza virus
ISIWMCSNGSL

SEQ ID NO: 528397 - protein, 11 aa, Influenza virus
ISIYWTLVNPG

SEQ ID NO: 528398 - protein, 11 aa, Influenza virus
ISKCKTKEGRR

SEQ ID NO: 528399 - protein, 11 aa, Influenza virus
ISKCRTKEGRR

SEQ ID NO: 528400 - protein, 11 aa, Influenza virus
ISKCRTREGRR

SEQ ID NO: 528401 - protein, 11 aa, Influenza virus
ISKDNGIRIGS

SEQ ID NO: 528402 - protein, 11 aa, Influenza virus
ISKDSRSGYET

SEQ ID NO: 528403 - protein, 11 aa, Influenza virus
ISKRGGSGIMK

SEQ ID NO: 528404 - protein, 11 aa, Influenza virus
ISKRGNSGIMK

SEQ ID NO: 528405 - protein, 11 aa, Influenza virus
ISKRGSSGIMK

SEQ ID NO: 528406 - protein, 11 aa, Influenza virus
ISKRGSSGIVK

SEQ ID NO: 528407 - protein, 11 aa, Influenza virus
ISKRGSSGVMK

SEQ ID NO: 528408 - protein, 11 aa, Influenza virus
ISKSRATEYIM

SEQ ID NO: 528409 - protein, 11 aa, Influenza virus
ISKSRTKEGRR

SEQ ID NO: 528410 - protein, 11 aa, Influenza virus
ISKSTKSTVLK

SEQ ID NO: 528411 - protein, 11 aa, Influenza virus
ISKTNQQFELI

SEQ ID NO: 528412 - protein, 11 aa, Influenza virus
ISLCSIWFSHY

SEQ ID NO: 528413 - protein, 11 aa, Influenza virus
ISLGDCSFAGW

SEQ ID NO: 528414 - protein, 11 aa, Influenza virus
ISLGDCSFTGW

SEQ ID NO: 528415 - protein, 11 aa, Influenza virus
ISLWMCSNGSL

SEQ ID NO: 528416 - protein, 11 aa, Influenza virus
ISMCSSTEFLG

SEQ ID NO: 528417 - protein, 11 aa, Influenza virus
ISMDSRSGYET

SEQ ID NO: 528418 - protein, 11 aa, Influenza virus
ISNEGSYFFGD

SEQ ID NO: 528419 - protein, 11 aa, Influenza virus
ISNETILETGY

SEQ ID NO: 528420 - protein, 11 aa, Influenza virus
ISNVGLNISLH

SEQ ID NO: 528421 - protein, 11 aa, Influenza virus
ISNVGLNVSLH

SEQ ID NO: 528422 - protein, 11 aa, Influenza virus
ISPHSRSGFEM

SEQ ID NO: 528423 - protein, 11 aa, Influenza virus
ISPIHLGDCSF

SEQ ID NO: 528424 - protein, 11 aa, Influenza virus
ISPKLRSGFEM

SEQ ID NO: 528425 - protein, 11 aa, Influenza virus
ISPLAGSAQHV

SEQ ID NO: 528426 - protein, 11 aa, Influenza virus
ISPLAVTWWNR

SEQ ID NO: 528427 - protein, 11 aa, Influenza virus
ISPLMVAYMLE

SEQ ID NO: 528428 - protein, 11 aa, Influenza virus
ISPLSGSAQHI

SEQ ID NO: 528429 - protein, 11 aa, Influenza virus
ISPLSGSAQHV

SEQ ID NO: 528430 - protein, 11 aa, Influenza virus
ISPRLRSGFEM

SEQ ID NO: 528431 - protein, 11 aa, Influenza virus
ISPRSRNGFEM

SEQ ID NO: 528432 - protein, 11 aa, Influenza virus
ISPRSRSGFEM

SEQ ID NO: 528433 - protein, 11 aa, Influenza virus
ISPVHLGDCSF

SEQ ID NO: 528434 - protein, 11 aa, Influenza virus
ISRARIDARID

SEQ ID NO: 528435 - protein, 11 aa, Influenza virus
ISRDSRSGYET

SEQ ID NO: 528436 - protein, 11 aa, Influenza virus
ISSGSLKLAIG

SEQ ID NO: 528437 - protein, 11 aa, Influenza virus
ISSMGEAMVSR

SEQ ID NO: 528438 - protein, 11 aa, Influenza virus
ISSMMEAMVSR

SEQ ID NO: 528439 - protein, 11 aa, Influenza virus
ISSMVEAMISR

SEQ ID NO: 528440 - protein, 11 aa, Influenza virus
ISSMVEAMMSR

SEQ ID NO: 528441 - protein, 11 aa, Influenza virus
ISSMVEAMVSR

SEQ ID NO: 528442 - protein, 11 aa, Influenza virus
ISSSFSFGGFT

SEQ ID NO: 528443 - protein, 11 aa, Influenza virus
ISSSLVLVGLI

SEQ ID NO: 528444 - protein, 11 aa, Influenza virus
ISTPLGSPPIV

SEQ ID NO: 528445 - protein, 11 aa, Influenza virus
ISTPLGSPPMV

SEQ ID NO: 528446 - protein, 11 aa, Influenza virus
ISTPLGSPPVV

SEQ ID NO: 528447 - protein, 11 aa, Influenza virus
ISTPLGTPPTV

SEQ ID NO: 528448 - protein, 11 aa, Influenza virus
ISTTFPYTGDP

SEQ ID NO: 528449 - protein, 11 aa, Influenza virus
ISVESSTYQNN

SEQ ID NO: 528450 - protein, 11 aa, Influenza virus
ISVGSGSFPDG

SEQ ID NO: 528451 - protein, 11 aa, Influenza virus
ISVGSSTYHNS

SEQ ID NO: 528452 - protein, 11 aa, Influenza virus
ISVGSSTYQNN

SEQ ID NO: 528453 - protein, 11 aa, Influenza virus
ISVGSSTYQNS

SEQ ID NO: 528454 - protein, 11 aa, Influenza virus
ISVGTSTLNLR

SEQ ID NO: 528455 - protein, 11 aa, Influenza virus
ISVGTSTLNQR

SEQ ID NO: 528456 - protein, 11 aa, Influenza virus
ISWEMGLAPSP

SEQ ID NO: 528457 - protein, 11 aa, Influenza virus
ISWEMGQAPSP

SEQ ID NO: 528458 - protein, 11 aa, Influenza virus
ISWGMGQAPSP

SEQ ID NO: 528459 - protein, 11 aa, Influenza virus
ISWPLSSPPTV

SEQ ID NO: 528460 - protein, 11 aa, Influenza virus
ISWPQSSPPTV

SEQ ID NO: 528461 - protein, 11 aa, Influenza virus
ITAASLNDDGL

SEQ ID NO: 528462 - protein, 11 aa, Influenza virus
ITCTCRDNWQG

SEQ ID NO: 528463 - protein, 11 aa, Influenza virus
ITCVCRDNWQG

SEQ ID NO: 528464 - protein, 11 aa, Influenza virus
ITDGPSDAQAF

SEQ ID NO: 528465 - protein, 11 aa, Influenza virus
ITDGPSNAQAF

SEQ ID NO: 528466 - protein, 11 aa, Influenza virus
ITDIWAYNAEL

SEQ ID NO: 528467 - protein, 11 aa, Influenza virus
ITDIWTYQAEL

SEQ ID NO: 528468 - protein, 11 aa, Influenza virus
ITDTFKSWKGN

SEQ ID NO: 528469 - protein, 11 aa, Influenza virus
ITDTLKSWKGN

SEQ ID NO: 528470 - protein, 11 aa, Influenza virus
ITDWSGYSGSF

SEQ ID NO: 528471 - protein, 11 aa, Influenza virus
ITEINTWARNI

SEQ ID NO: 528472 - protein, 11 aa, Influenza virus
ITELPFQNLSP

SEQ ID NO: 528473 - protein, 11 aa, Influenza virus
ITENSFEQITF

SEQ ID NO: 528474 - protein, 11 aa, Influenza virus
ITEVWSYNAEL

SEQ ID NO: 528475 - protein, 11 aa, Influenza virus
ITEWSGYSGSF

SEQ ID NO: 528476 - protein, 11 aa, Influenza virus
ITFESNGGFLA

SEQ ID NO: 528477 - protein, 11 aa, Influenza virus
ITFESNGGLLA

SEQ ID NO: 528478 - protein, 11 aa, Influenza virus
ITFIQALQLLL

SEQ ID NO: 528479 - protein, 11 aa, Influenza virus
ITFLHNGGLIA

SEQ ID NO: 528480 - protein, 11 aa, Influenza virus
ITFLQALQLLL

SEQ ID NO: 528481 - protein, 11 aa, Influenza virus
ITFMQALQLLF

SEQ ID NO: 528482 - protein, 11 aa, Influenza virus
ITFMQALQLLL

SEQ ID NO: 528483 - protein, 11 aa, Influenza virus
ITFSDNGGLIA

SEQ ID NO: 528484 - protein, 11 aa, Influenza virus
ITFSFNGAFIA

SEQ ID NO: 528485 - protein, 11 aa, Influenza virus
ITFSHNGGLIA

SEQ ID NO: 528486 - protein, 11 aa, Influenza virus
ITFSHNGGLVA

SEQ ID NO: 528487 - protein, 11 aa, Influenza virus
ITFSHNGGRIA

SEQ ID NO: 528488 - protein, 11 aa, Influenza virus
ITGDDKNATAS

SEQ ID NO: 528489 - protein, 11 aa, Influenza virus
ITGDDRNATAS

SEQ ID NO: 528490 - protein, 11 aa, Influenza virus
ITGDNTKWNEN

SEQ ID NO: 528491 - protein, 11 aa, Influenza virus
ITGFAPFSEDN

SEQ ID NO: 528492 - protein, 11 aa, Influenza virus
ITGFAPFSKDN

SEQ ID NO: 528493 - protein, 11 aa, Influenza virus
ITGIDKVCTKG

SEQ ID NO: 528494 - protein, 11 aa, Influenza virus
ITGINKVCTKG

SEQ ID NO: 528495 - protein, 11 aa, Influenza virus
ITGKLNRFIEK

SEQ ID NO: 528496 - protein, 11 aa, Influenza virus
ITGKLNRIIEK

SEQ ID NO: 528497 - protein, 11 aa, Influenza virus
ITGKLNRLIDK

SEQ ID NO: 528498 - protein, 11 aa, Influenza virus
ITGKLNRLIDR

SEQ ID NO: 528499 - protein, 11 aa, Influenza virus
ITGKLNRLIEK

SEQ ID NO: 528500 - protein, 11 aa, Influenza virus
ITGKLNRLIER

SEQ ID NO: 528501 - protein, 11 aa, Influenza virus
ITGKLNRLIGK

SEQ ID NO: 528502 - protein, 11 aa, Influenza virus
ITGKLNRLISK

SEQ ID NO: 528503 - protein, 11 aa, Influenza virus
ITGKSHGRILK

SEQ ID NO: 528504 - protein, 11 aa, Influenza virus
ITGKSHGRVLK

SEQ ID NO: 528505 - protein, 11 aa, Influenza virus
ITGPDATAVAV

SEQ ID NO: 528506 - protein, 11 aa, Influenza virus
ITGPDSTAVAV

SEQ ID NO: 528507 - protein, 11 aa, Influenza virus
ITGPDTTAVAV

SEQ ID NO: 528508 - protein, 11 aa, Influenza virus
ITGSPGAPGVK

SEQ ID NO: 528509 - protein, 11 aa, Influenza virus
ITGSPSAPGVK

SEQ ID NO: 528510 - protein, 11 aa, Influenza virus
ITIGECPKYVK

SEQ ID NO: 528511 - protein, 11 aa, Influenza virus
ITIGISGPDDG

SEQ ID NO: 528512 - protein, 11 aa, Influenza virus
ITIGISGPDNG

SEQ ID NO: 528513 - protein, 11 aa, Influenza virus
ITIGSVSLIIA

SEQ ID NO: 528514 - protein, 11 aa, Influenza virus
ITIGSVSLTIA

SEQ ID NO: 528515 - protein, 11 aa, Influenza virus
ITIGSVSLTIT

SEQ ID NO: 528516 - protein, 11 aa, Influenza virus
ITLKFAFNMMF

SEQ ID NO: 528517 - protein, 11 aa, Influenza virus
ITNGTTGNPII

SEQ ID NO: 528518 - protein, 11 aa, Influenza virus
ITNKINNIVDK

SEQ ID NO: 528519 - protein, 11 aa, Influenza virus
ITNKINSIIDK

SEQ ID NO: 528520 - protein, 11 aa, Influenza virus
ITNKVNNIVDK

SEQ ID NO: 528521 - protein, 11 aa, Influenza virus
ITNKVNSIIDK

SEQ ID NO: 528522 - protein, 11 aa, Influenza virus
ITNPLIRHENR

SEQ ID NO: 528523 - protein, 11 aa, Influenza virus
ITNWSGYSGSF

SEQ ID NO: 528524 - protein, 11 aa, Influenza virus
ITQGSLLNDKH

SEQ ID NO: 528525 - protein, 11 aa, Influenza virus
ITQTLVSNDDW

SEQ ID NO: 528526 - protein, 11 aa, Influenza virus
ITQTLVSNNDW

SEQ ID NO: 528527 - protein, 11 aa, Influenza virus
ITQTLVSNSDW

SEQ ID NO: 528528 - protein, 11 aa, Influenza virus
ITREPYVSCDN

SEQ ID NO: 528529 - protein, 11 aa, Influenza virus
ITRKLNRLIEK

SEQ ID NO: 528530 - protein, 11 aa, Influenza virus
ITRSGQNHGIC

SEQ ID NO: 528531 - protein, 11 aa, Influenza virus
ITSLCSIWFSH

SEQ ID NO: 528532 - protein, 11 aa, Influenza virus
ITSNLPFQNVN

SEQ ID NO: 528533 - protein, 11 aa, Influenza virus
ITSPLPFQNIN

SEQ ID NO: 528534 - protein, 11 aa, Influenza virus
ITTKINNIIDK

SEQ ID NO: 528535 - protein, 11 aa, Influenza virus
ITTKINNIIEK

SEQ ID NO: 528536 - protein, 11 aa, Influenza virus
ITVDHMAIIKK

SEQ ID NO: 528537 - protein, 11 aa, Influenza virus
ITVGSSKYQQS

SEQ ID NO: 528538 - protein, 11 aa, Influenza virus
ITVGSSKYRQS

SEQ ID NO: 528539 - protein, 11 aa, Influenza virus
ITVTHAQDILE

SEQ ID NO: 528540 - protein, 11 aa, Influenza virus
ITVTHSVELLE

SEQ ID NO: 528541 - protein, 11 aa, Influenza virus
ITVTHSVNLLE

SEQ ID NO: 528542 - protein, 11 aa, Influenza virus
ITYIWTYQAEL

SEQ ID NO: 528543 - protein, 11 aa, Influenza virus
ITYSSPMMWEI

SEQ ID NO: 528544 - protein, 11 aa, Influenza virus
ITYSSSLMWEI

SEQ ID NO: 528545 - protein, 11 aa, Influenza virus
ITYSSSMMWEI

SEQ ID NO: 528546 - protein, 11 aa, Influenza virus
ITYSSSMMWEV

SEQ ID NO: 528547 - protein, 11 aa, Influenza virus
IVAFCGTSGTY

SEQ ID NO: 528548 - protein, 11 aa, Influenza virus
IVAIVFSQEDC

SEQ ID NO: 528549 - protein, 11 aa, Influenza virus
IVALCGSKEQL

SEQ ID NO: 528550 - protein, 11 aa, Influenza virus
IVALCGSKERL

SEQ ID NO: 528551 - protein, 11 aa, Influenza virus
IVALCGSKKRL

SEQ ID NO: 528552 - protein, 11 aa, Influenza virus
IVALCGSRERL

SEQ ID NO: 528553 - protein, 11 aa, Influenza virus
IVAMVFSQEDC

SEQ ID NO: 528554 - protein, 11 aa, Influenza virus
IVAMVFSQEDR

SEQ ID NO: 528555 - protein, 11 aa, Influenza virus
IVAMVFSQEEC

SEQ ID NO: 528556 - protein, 11 aa, Influenza virus
IVAVTDGPAAN

SEQ ID NO: 528557 - protein, 11 aa, Influenza virus
IVDKMNREFEV

SEQ ID NO: 528558 - protein, 11 aa, Influenza virus
IVDKMNREFGV

SEQ ID NO: 528559 - protein, 11 aa, Influenza virus
IVDNKNWSGYS

SEQ ID NO: 528560 - protein, 11 aa, Influenza virus
IVDNNNWSGYS

SEQ ID NO: 528561 - protein, 11 aa, Influenza virus
IVDNQNWSGYS

SEQ ID NO: 528562 - protein, 11 aa, Influenza virus
IVDNSNWSGYS

SEQ ID NO: 528563 - protein, 11 aa, Influenza virus
IVERILEEESD

SEQ ID NO: 528564 - protein, 11 aa, Influenza virus
IVERPKEIEGI

SEQ ID NO: 528565 - protein, 11 aa, Influenza virus
IVERPKEMEGI

SEQ ID NO: 528566 - protein, 11 aa, Influenza virus
IVERPKEMEGV

SEQ ID NO: 528567 - protein, 11 aa, Influenza virus
IVERPSAPEGM

SEQ ID NO: 528568 - protein, 11 aa, Influenza virus
IVERTKEMEGI

SEQ ID NO: 528569 - protein, 11 aa, Influenza virus
IVETGYVCSKF

SEQ ID NO: 528570 - protein, 11 aa, Influenza virus
IVFCGTSGTYG

SEQ ID NO: 528571 - protein, 11 aa, Influenza virus
IVFNTIGNLIA

SEQ ID NO: 528572 - protein, 11 aa, Influenza virus
IVFNTIGNLVA

SEQ ID NO: 528573 - protein, 11 aa, Influenza virus
IVFPNEVGARI

SEQ ID NO: 528574 - protein, 11 aa, Influenza virus
IVGLVFFCLKN

SEQ ID NO: 528575 - protein, 11 aa, Influenza virus
IVGNDNWSGYS

SEQ ID NO: 528576 - protein, 11 aa, Influenza virus
IVGNPSCASNI

SEQ ID NO: 528577 - protein, 11 aa, Influenza virus
IVGNPSCATNI

SEQ ID NO: 528578 - protein, 11 aa, Influenza virus
IVHISPLSGSA

SEQ ID NO: 528579 - protein, 11 aa, Influenza virus
IVILVLGLSMV

SEQ ID NO: 528580 - protein, 11 aa, Influenza virus
IVKGRSHLRND

SEQ ID NO: 528581 - protein, 11 aa, Influenza virus
IVLGIINLLIG

SEQ ID NO: 528582 - protein, 11 aa, Influenza virus
IVLLENQKTLD

SEQ ID NO: 528583 - protein, 11 aa, Influenza virus
IVLNTDWSGYS

SEQ ID NO: 528584 - protein, 11 aa, Influenza virus
IVLTTDWSGYS

SEQ ID NO: 528585 - protein, 11 aa, Influenza virus
IVLVGLILAFI

SEQ ID NO: 528586 - protein, 11 aa, Influenza virus
IVLVMKRKRDS

SEQ ID NO: 528587 - protein, 11 aa, Influenza virus
IVMVGLILAFI

SEQ ID NO: 528588 - protein, 11 aa, Influenza virus
IVNAALGSPGC

SEQ ID NO: 528589 - protein, 11 aa, Influenza virus
IVNGALGSPGC

SEQ ID NO: 528590 - protein, 11 aa, Influenza virus
IVNNQDWSGYS

SEQ ID NO: 528591 - protein, 11 aa, Influenza virus
IVNNQNWSGYS

SEQ ID NO: 528592 - protein, 11 aa, Influenza virus
IVNSALGSPGC

SEQ ID NO: 528593 - protein, 11 aa, Influenza virus
IVNTTLSTIAL

SEQ ID NO: 528594 - protein, 11 aa, Influenza virus
IVPCFWLEMIR

SEQ ID NO: 528595 - protein, 11 aa, Influenza virus
IVPNIGSRPRV

SEQ ID NO: 528596 - protein, 11 aa, Influenza virus
IVPSGPLKAEI

SEQ ID NO: 528597 - protein, 11 aa, Influenza virus
IVQITGKLNRL

SEQ ID NO: 528598 - protein, 11 aa, Influenza virus
IVRRAAVSADP

SEQ ID NO: 528599 - protein, 11 aa, Influenza virus
IVRRAIVSADP

SEQ ID NO: 528600 - protein, 11 aa, Influenza virus
IVRRATVSADP

SEQ ID NO: 528601 - protein, 11 aa, Influenza virus
IVSKDNGIRIG

SEQ ID NO: 528602 - protein, 11 aa, Influenza virus
IVSKDNGIRVG

SEQ ID NO: 528603 - protein, 11 aa, Influenza virus
IVSLGAISFWM

SEQ ID NO: 528604 - protein, 11 aa, Influenza virus
IVSMCSSTEFL

SEQ ID NO: 528605 - protein, 11 aa, Influenza virus
IVSNDNWSGYS

SEQ ID NO: 528606 - protein, 11 aa, Influenza virus
IVSPLAVTWWN

SEQ ID NO: 528607 - protein, 11 aa, Influenza virus
IVSSLPFQNIN

SEQ ID NO: 528608 - protein, 11 aa, Influenza virus
IVSSLPFQNIS

SEQ ID NO: 528609 - protein, 11 aa, Influenza virus
IVSSLPFQSIN

SEQ ID NO: 528610 - protein, 11 aa, Influenza virus
IVSWSQNILRT

SEQ ID NO: 528611 - protein, 11 aa, Influenza virus
IVTFCGLBNEP

SEQ ID NO: 528612 - protein, 11 aa, Influenza virus
IVTFCGLDNEP

SEQ ID NO: 528613 - protein, 11 aa, Influenza virus
IVTFCGLNNEP

SEQ ID NO: 528614 - protein, 11 aa, Influenza virus
IVTREPCVSCD

SEQ ID NO: 528615 - protein, 11 aa, Influenza virus
IVTREPYISCD

SEQ ID NO: 528616 - protein, 11 aa, Influenza virus
IVTREPYVSCD

SEQ ID NO: 528617 - protein, 11 aa, Influenza virus
IVTTVGWSWPD

SEQ ID NO: 528618 - protein, 11 aa, Influenza virus
IVVFCGTSATY

SEQ ID NO: 528619 - protein, 11 aa, Influenza virus
IVVFCGTSGTY

SEQ ID NO: 528620 - protein, 11 aa, Influenza virus
IVVMTDGSASG

SEQ ID NO: 528621 - protein, 11 aa, Influenza virus
IVVTREPYVSC

SEQ ID NO: 528622 - protein, 11 aa, Influenza virus
IVWACQRGNIR

SEQ ID NO: 528623 - protein, 11 aa, Influenza virus
IVWGVHHSSSL

SEQ ID NO: 528624 - protein, 11 aa, Influenza virus
IWASGSSISFC

SEQ ID NO: 528625 - protein, 11 aa, Influenza virus
IWAYNAELIVL

SEQ ID NO: 528626 - protein, 11 aa, Influenza virus
IWAYNAELLVL

SEQ ID NO: 528627 - protein, 11 aa, Influenza virus
IWDANGWVSTD

SEQ ID NO: 528628 - protein, 11 aa, Influenza virus
IWFSHYNQMKQ

SEQ ID NO: 528629 - protein, 11 aa, Influenza virus
IWFSHYNQMTQ

SEQ ID NO: 528630 - protein, 11 aa, Influenza virus
IWFSHYNQVAQ

SEQ ID NO: 528631 - protein, 11 aa, Influenza virus
IWFSHYNQVTQ

SEQ ID NO: 528632 - protein, 11 aa, Influenza virus
IWGVHHPSTDA

SEQ ID NO: 528633 - protein, 11 aa, Influenza virus
IWGVHHPSTDK

SEQ ID NO: 528634 - protein, 11 aa, Influenza virus
IWGVHHPSTDT

SEQ ID NO: 528635 - protein, 11 aa, Influenza virus
IWGVHHPSTST

SEQ ID NO: 528636 - protein, 11 aa, Influenza virus
IWHSNLNDATY

SEQ ID NO: 528637 - protein, 11 aa, Influenza virus
IWHSNLNDTTY

SEQ ID NO: 528638 - protein, 11 aa, Influenza virus
IWITREPYVSC

SEQ ID NO: 528639 - protein, 11 aa, Influenza virus
IWMACHSAAFE

SEQ ID NO: 528640 - protein, 11 aa, Influenza virus
IWMCSNGSLQC

SEQ ID NO: 528641 - protein, 11 aa, Influenza virus
IWSYNAELLVA

SEQ ID NO: 528642 - protein, 11 aa, Influenza virus
IWSYNAKLLVL

SEQ ID NO: 528643 - protein, 11 aa, Influenza virus
IWSYNAQLLVL

SEQ ID NO: 528644 - protein, 11 aa, Influenza virus
IWSYNAQLLVW

SEQ ID NO: 528645 - protein, 11 aa, Influenza virus
IWSYNARLLVL

SEQ ID NO: 528646 - protein, 11 aa, Influenza virus
IWTSASSISFC

SEQ ID NO: 528647 - protein, 11 aa, Influenza virus
IWTSGSIISFC

SEQ ID NO: 528648 - protein, 11 aa, Influenza virus
IWTSGSSIAFC

SEQ ID NO: 528649 - protein, 11 aa, Influenza virus
IWTSGSSISFC

SEQ ID NO: 528650 - protein, 11 aa, Influenza virus
IWTSSSSIVMC

SEQ ID NO: 528651 - protein, 11 aa, Influenza virus
IWTSSSSTVFC

SEQ ID NO: 528652 - protein, 11 aa, Influenza virus
IWTSSSSVVMC

SEQ ID NO: 528653 - protein, 11 aa, Influenza virus
IWTYNAELLIL

SEQ ID NO: 528654 - protein, 11 aa, Influenza virus
IWTYNAELLVL

SEQ ID NO: 528655 - protein, 11 aa, Influenza virus
IWTYQAELLIA

SEQ ID NO: 528656 - protein, 11 aa, Influenza virus
IWTYQAELLVA

SEQ ID NO: 528657 - protein, 11 aa, Influenza virus
IWTYQEELLVA

SEQ ID NO: 528658 - protein, 11 aa, Influenza virus
IWVTRELYVSC

SEQ ID NO: 528659 - protein, 11 aa, Influenza virus
IWVTREPYVSC

SEQ ID NO: 528660 - protein, 11 aa, Influenza virus
IYATVAGSLSL

SEQ ID NO: 528661 - protein, 11 aa, Influenza virus
IYCICRDNWKG

SEQ ID NO: 528662 - protein, 11 aa, Influenza virus
IYCVCRDNWKG

SEQ ID NO: 528663 - protein, 11 aa, Influenza virus
IYGKDNAIRIG

SEQ ID NO: 528664 - protein, 11 aa, Influenza virus
IYGKDNAVRIG

SEQ ID NO: 528665 - protein, 11 aa, Influenza virus
IYGNPKCDIHL

SEQ ID NO: 528666 - protein, 11 aa, Influenza virus
IYGNPKCDTHL

SEQ ID NO: 528667 - protein, 11 aa, Influenza virus
IYGNPKCDVHL

SEQ ID NO: 528668 - protein, 11 aa, Influenza virus
IYIEVLHLTQG

SEQ ID NO: 528669 - protein, 11 aa, Influenza virus
IYKILSIYSCI

SEQ ID NO: 528670 - protein, 11 aa, Influenza virus
IYKILTIYSTV

SEQ ID NO: 528671 - protein, 11 aa, Influenza virus
IYQILAIYATV

SEQ ID NO: 528672 - protein, 11 aa, Influenza virus
IYQILAIYSTV

SEQ ID NO: 528673 - protein, 11 aa, Influenza virus
IYRDEAINNRI

SEQ ID NO: 528674 - protein, 11 aa, Influenza virus
IYSCIASSIVL

SEQ ID NO: 528675 - protein, 11 aa, Influenza virus
IYSCIASSIVM

SEQ ID NO: 528676 - protein, 11 aa, Influenza virus
IYSCIASSLIL

SEQ ID NO: 528677 - protein, 11 aa, Influenza virus
IYSCIASSLVL

SEQ ID NO: 528678 - protein, 11 aa, Influenza virus
IYSCIASSTVL

SEQ ID NO: 528679 - protein, 11 aa, Influenza virus
IYSCIASSTVM

SEQ ID NO: 528680 - protein, 11 aa, Influenza virus
IYSCIASSVVL

SEQ ID NO: 528681 - protein, 11 aa, Influenza virus
IYSSSMMWEIN

SEQ ID NO: 528682 - protein, 11 aa, Influenza virus
IYSSVASSLVL

SEQ ID NO: 528683 - protein, 11 aa, Influenza virus
IYSTAASSLVL

SEQ ID NO: 528684 - protein, 11 aa, Influenza virus
IYSTISSSLVL

SEQ ID NO: 528685 - protein, 11 aa, Influenza virus
IYSTVAASLCL

SEQ ID NO: 528686 - protein, 11 aa, Influenza virus
IYSTVASSLIL

SEQ ID NO: 528687 - protein, 11 aa, Influenza virus
IYSTVASSLVL

SEQ ID NO: 528688 - protein, 11 aa, Influenza virus
IYSTVASSSVL

SEQ ID NO: 528689 - protein, 11 aa, Influenza virus
IYSTVSSSLVL

SEQ ID NO: 528690 - protein, 11 aa, Influenza virus
IYWHLMHPGER

SEQ ID NO: 528691 - protein, 11 aa, Influenza virus
IYWTLVNPGDS

SEQ ID NO: 528692 - protein, 11 aa, Influenza virus
IYWWDGLQSSD

SEQ ID NO: 528693 - protein, 11 aa, Influenza virus
KAAIGLRISSS

SEQ ID NO: 528694 - protein, 11 aa, Influenza virus
KAALGLRISSS

SEQ ID NO: 528695 - protein, 11 aa, Influenza virus
KAAMGLKISSS

SEQ ID NO: 528696 - protein, 11 aa, Influenza virus
KAAMGLRISSS

SEQ ID NO: 528697 - protein, 11 aa, Influenza virus
KAAMGMRISSS

SEQ ID NO: 528698 - protein, 11 aa, Influenza virus
KACNALTGGQS

SEQ ID NO: 528699 - protein, 11 aa, Influenza virus
KACNASTGAQS

SEQ ID NO: 528700 - protein, 11 aa, Influenza virus
KACNASTGGQA

SEQ ID NO: 528701 - protein, 11 aa, Influenza virus
KACNASTGGQS

SEQ ID NO: 528702 - protein, 11 aa, Influenza virus
KACSASTGGQS

SEQ ID NO: 528703 - protein, 11 aa, Influenza virus
KADEICIGYLS

SEQ ID NO: 528704 - protein, 11 aa, Influenza virus
KADHRIYWIKE

SEQ ID NO: 528705 - protein, 11 aa, Influenza virus
KADKICIGYLS

SEQ ID NO: 528706 - protein, 11 aa, Influenza virus
KADLIIERRNS

SEQ ID NO: 528707 - protein, 11 aa, Influenza virus
KAEIAQKLEDV

SEQ ID NO: 528708 - protein, 11 aa, Influenza virus
KAEIAQRLEDV

SEQ ID NO: 528709 - protein, 11 aa, Influenza virus
KAEIAQRLEGV

SEQ ID NO: 528710 - protein, 11 aa, Influenza virus
KAEIAQRLENV

SEQ ID NO: 528711 - protein, 11 aa, Influenza virus
KAEIAQRLESV

SEQ ID NO: 528712 - protein, 11 aa, Influenza virus
KAGFIEGGWPG

SEQ ID NO: 528713 - protein, 11 aa, Influenza virus
KAGFIENGWEG

SEQ ID NO: 528714 - protein, 11 aa, Influenza virus
KAGVKMNPNQK

SEQ ID NO: 528715 - protein, 11 aa, Influenza virus
KAHNGKLCRLS

SEQ ID NO: 528716 - protein, 11 aa, Influenza virus
KAIDEITTKIN

SEQ ID NO: 528717 - protein, 11 aa, Influenza virus
KAIDIMQNKLN

SEQ ID NO: 528718 - protein, 11 aa, Influenza virus
KAIDNMQNKLN

SEQ ID NO: 528719 - protein, 11 aa, Influenza virus
KAIDNMQNRLN

SEQ ID NO: 528720 - protein, 11 aa, Influenza virus
KAIDQITTKIN

SEQ ID NO: 528721 - protein, 11 aa, Influenza virus
KAIDRITTKIN

SEQ ID NO: 528722 - protein, 11 aa, Influenza virus
KAINEITTKIN

SEQ ID NO: 528723 - protein, 11 aa, Influenza virus
KAIWTSGSSIA

SEQ ID NO: 528724 - protein, 11 aa, Influenza virus
KAKLANVVRKM

SEQ ID NO: 528725 - protein, 11 aa, Influenza virus
KALNEITTKIN

SEQ ID NO: 528726 - protein, 11 aa, Influenza virus
KALSIYSCIAS

SEQ ID NO: 528727 - protein, 11 aa, Influenza virus
KAMEQMAGSSE

SEQ ID NO: 528728 - protein, 11 aa, Influenza virus
KAMEQVAGSSE

SEQ ID NO: 528729 - protein, 11 aa, Influenza virus
KAMMDQVRESR

SEQ ID NO: 528730 - protein, 11 aa, Influenza virus
KANQVFPQLNQ

SEQ ID NO: 528731 - protein, 11 aa, Influenza virus
KANVLIGQGDI

SEQ ID NO: 528732 - protein, 11 aa, Influenza virus
KANVLIGQGDV

SEQ ID NO: 528733 - protein, 11 aa, Influenza virus
KAPISLGDCSF

SEQ ID NO: 528734 - protein, 11 aa, Influenza virus
KAPISLGGCSF

SEQ ID NO: 528735 - protein, 11 aa, Influenza virus
KAPQLNPIDGP

SEQ ID NO: 528736 - protein, 11 aa, Influenza virus
KAQGEGTAADY

SEQ ID NO: 528737 - protein, 11 aa, Influenza virus
KAQHIEECSCY

SEQ ID NO: 528738 - protein, 11 aa, Influenza virus
KASKEPEVHEG

SEQ ID NO: 528739 - protein, 11 aa, Influenza virus
KASLRLAVGLR

SEQ ID NO: 528740 - protein, 11 aa, Influenza virus
KASTQKAIDEI

SEQ ID NO: 528741 - protein, 11 aa, Influenza virus
KASTQKAINEI

SEQ ID NO: 528742 - protein, 11 aa, Influenza virus
KATKMEAILVV

SEQ ID NO: 528743 - protein, 11 aa, Influenza virus
KATKMKAIIVV

SEQ ID NO: 528744 - protein, 11 aa, Influenza virus
KATKMKAILVV

SEQ ID NO: 528745 - protein, 11 aa, Influenza virus
KATNGNYGPIN

SEQ ID NO: 528746 - protein, 11 aa, Influenza virus
KAVDLGSCGIL

SEQ ID NO: 528747 - protein, 11 aa, Influenza virus
KAVKLYKKLKR

SEQ ID NO: 528748 - protein, 11 aa, Influenza virus
KAVKLYRKLKR

SEQ ID NO: 528749 - protein, 11 aa, Influenza virus
KAVRGDLNFVN

SEQ ID NO: 528750 - protein, 11 aa, Influenza virus
KAWLHICVTGD

SEQ ID NO: 528751 - protein, 11 aa, Influenza virus
KAWLHVCITGD

SEQ ID NO: 528752 - protein, 11 aa, Influenza virus
KAWLHVCVTGD

SEQ ID NO: 528753 - protein, 11 aa, Influenza virus
KAWLHVCVTGY

SEQ ID NO: 528754 - protein, 11 aa, Influenza virus
KCCNLFEKFFP

SEQ ID NO: 528755 - protein, 11 aa, Influenza virus
KCCSLFEKFFP

SEQ ID NO: 528756 - protein, 11 aa, Influenza virus
KCCTLFEKFFP

SEQ ID NO: 528757 - protein, 11 aa, Influenza virus
KCDDDCMASIR

SEQ ID NO: 528758 - protein, 11 aa, Influenza virus
KCDDHCMESIR

SEQ ID NO: 528759 - protein, 11 aa, Influenza virus
KCDDQCMESIR

SEQ ID NO: 528760 - protein, 11 aa, Influenza virus
KCDLYLNGREW

SEQ ID NO: 528761 - protein, 11 aa, Influenza virus
KCDLYLSGREW

SEQ ID NO: 528762 - protein, 11 aa, Influenza virus
KCDNECMETIK

SEQ ID NO: 528763 - protein, 11 aa, Influenza virus
KCDNKCMETIK

SEQ ID NO: 528764 - protein, 11 aa, Influenza virus
KCDNQCMESIR

SEQ ID NO: 528765 - protein, 11 aa, Influenza virus
KCDPYLNGREW

SEQ ID NO: 528766 - protein, 11 aa, Influenza virus
KCFNPCFYVEL

SEQ ID NO: 528767 - protein, 11 aa, Influenza virus
KCFWKGGSIKT

SEQ ID NO: 528768 - protein, 11 aa, Influenza virus
KCFWKGGSINT

SEQ ID NO: 528769 - protein, 11 aa, Influenza virus
KCFWKSGSINT

SEQ ID NO: 528770 - protein, 11 aa, Influenza virus
KCFWRGGSIIT

SEQ ID NO: 528771 - protein, 11 aa, Influenza virus
KCFWRGGSINT

SEQ ID NO: 528772 - protein, 11 aa, Influenza virus
KCICRDNWKGA

SEQ ID NO: 528773 - protein, 11 aa, Influenza virus
KCICRDNWRGA

SEQ ID NO: 528774 - protein, 11 aa, Influenza virus
KCIERVRNGTY

SEQ ID NO: 528775 - protein, 11 aa, Influenza virus
KCIESIRNGTY

SEQ ID NO: 528776 - protein, 11 aa, Influenza virus
KCITPNGSIPN

SEQ ID NO: 528777 - protein, 11 aa, Influenza virus
KCKTKEGRRKT

SEQ ID NO: 528778 - protein, 11 aa, Influenza virus
KCMESVRNGTY

SEQ ID NO: 528779 - protein, 11 aa, Influenza virus
KCMETIKNGTY

SEQ ID NO: 528780 - protein, 11 aa, Influenza virus
KCNDPYPGNNN

SEQ ID NO: 528781 - protein, 11 aa, Influenza virus
KCNDPYPGSNN

SEQ ID NO: 528782 - protein, 11 aa, Influenza virus
KCNDSCMDTIR

SEQ ID NO: 528783 - protein, 11 aa, Influenza virus
KCNDSCMEAIR

SEQ ID NO: 528784 - protein, 11 aa, Influenza virus
KCNDSCMETIR

SEQ ID NO: 528785 - protein, 11 aa, Influenza virus
KCNEPYPGNNN

SEQ ID NO: 528786 - protein, 11 aa, Influenza virus
KCNNECMETIK

SEQ ID NO: 528787 - protein, 11 aa, Influenza virus
KCNNSCMETIR

SEQ ID NO: 528788 - protein, 11 aa, Influenza virus
KCNNTCMETIR

SEQ ID NO: 528789 - protein, 11 aa, Influenza virus
KCNTKCQTSLG

SEQ ID NO: 528790 - protein, 11 aa, Influenza virus
KCNTKCQTSMG

SEQ ID NO: 528791 - protein, 11 aa, Influenza virus
KCNTKCQTSVG

SEQ ID NO: 528792 - protein, 11 aa, Influenza virus
KCPKYIPSGSL

SEQ ID NO: 528793 - protein, 11 aa, Influenza virus
KCPKYIPSNSL

SEQ ID NO: 528794 - protein, 11 aa, Influenza virus
KCPKYIPSRSL

SEQ ID NO: 528795 - protein, 11 aa, Influenza virus
KCPKYISSGSL

SEQ ID NO: 528796 - protein, 11 aa, Influenza virus
KCPRYIPSGSL

SEQ ID NO: 528797 - protein, 11 aa, Influenza virus
KCPRYVKQSSL

SEQ ID NO: 528798 - protein, 11 aa, Influenza virus
KCQLNEGVMNT

SEQ ID NO: 528799 - protein, 11 aa, Influenza virus
KCQQSFTPSPG

SEQ ID NO: 528800 - protein, 11 aa, Influenza virus
KCQSPLGAINT

SEQ ID NO: 528801 - protein, 11 aa, Influenza virus
KCQTPLGAINT

SEQ ID NO: 528802 - protein, 11 aa, Influenza virus
KCQTPLGALNT

SEQ ID NO: 528803 - protein, 11 aa, Influenza virus
KCQTSVGGIDT

SEQ ID NO: 528804 - protein, 11 aa, Influenza virus
KCQTSVGGINT

SEQ ID NO: 528805 - protein, 11 aa, Influenza virus
KCQTYAGAINS

SEQ ID NO: 528806 - protein, 11 aa, Influenza virus
KCQTYAGAVNS

SEQ ID NO: 528807 - protein, 11 aa, Influenza virus
KCQTYTGAINS

SEQ ID NO: 528808 - protein, 11 aa, Influenza virus
KCRTKEGRRKT

SEQ ID NO: 528809 - protein, 11 aa, Influenza virus
KCRTKEGRRRT

SEQ ID NO: 528810 - protein, 11 aa, Influenza virus
KCRTREGRRKT

SEQ ID NO: 528811 - protein, 11 aa, Influenza virus
KCVCRDNWKGA

SEQ ID NO: 528812 - protein, 11 aa, Influenza virus
KCVCRDNWKGS

SEQ ID NO: 528813 - protein, 11 aa, Influenza virus
KCYNPCFYVEL

SEQ ID NO: 528814 - protein, 11 aa, Influenza virus
KCYQFALGQGA

SEQ ID NO: 528815 - protein, 11 aa, Influenza virus
KCYQFALGQGT

SEQ ID NO: 528816 - protein, 11 aa, Influenza virus
KDAERGKLKRR

SEQ ID NO: 528817 - protein, 11 aa, Influenza virus
KDCSVAGWLLG

SEQ ID NO: 528818 - protein, 11 aa, Influenza virus
KDEGNGCFTFY

SEQ ID NO: 528819 - protein, 11 aa, Influenza virus
KDGDIIFLWGI

SEQ ID NO: 528820 - protein, 11 aa, Influenza virus
KDIILWFSFGA

SEQ ID NO: 528821 - protein, 11 aa, Influenza virus
KDIILWFSFSI

SEQ ID NO: 528822 - protein, 11 aa, Influenza virus
KDIILWISFSI

SEQ ID NO: 528823 - protein, 11 aa, Influenza virus
KDIILWISFSM

SEQ ID NO: 528824 - protein, 11 aa, Influenza virus
KDIILWVSFSI

SEQ ID NO: 528825 - protein, 11 aa, Influenza virus
KDILRTQESEC

SEQ ID NO: 528826 - protein, 11 aa, Influenza virus
KDLDNCHPIGM

SEQ ID NO: 528827 - protein, 11 aa, Influenza virus
KDLGNCHPIGM

SEQ ID NO: 528828 - protein, 11 aa, Influenza virus
KDLGNCHPVGM

SEQ ID NO: 528829 - protein, 11 aa, Influenza virus
KDLGNGCFEFW

SEQ ID NO: 528830 - protein, 11 aa, Influenza virus
KDLGSCHPIGM

SEQ ID NO: 528831 - protein, 11 aa, Influenza virus
KDLRSGYETFK

SEQ ID NO: 528832 - protein, 11 aa, Influenza virus
KDNAIDEGDGC

SEQ ID NO: 528833 - protein, 11 aa, Influenza virus
KDNAIRFGEGE

SEQ ID NO: 528834 - protein, 11 aa, Influenza virus
KDNAIRFGESE

SEQ ID NO: 528835 - protein, 11 aa, Influenza virus
KDNAIRIGEDA

SEQ ID NO: 528836 - protein, 11 aa, Influenza virus
KDNAIRIGEDS

SEQ ID NO: 528837 - protein, 11 aa, Influenza virus
KDNAIRIGEEA

SEQ ID NO: 528838 - protein, 11 aa, Influenza virus
KDNAIRIGEGA

SEQ ID NO: 528839 - protein, 11 aa, Influenza virus
KDNAIRIGENA

SEQ ID NO: 528840 - protein, 11 aa, Influenza virus
KDNAIRIGENS

SEQ ID NO: 528841 - protein, 11 aa, Influenza virus
KDNAIRIGGNS

SEQ ID NO: 528842 - protein, 11 aa, Influenza virus
KDNAIRLGENK

SEQ ID NO: 528843 - protein, 11 aa, Influenza virus
KDNAIRLGENR

SEQ ID NO: 528844 - protein, 11 aa, Influenza virus
KDNAIRPGENK

SEQ ID NO: 528845 - protein, 11 aa, Influenza virus
KDNAKDEGNGC

SEQ ID NO: 528846 - protein, 11 aa, Influenza virus
KDNAKDLGNGC

SEQ ID NO: 528847 - protein, 11 aa, Influenza virus
KDNAKELGNGC

SEQ ID NO: 528848 - protein, 11 aa, Influenza virus
KDNANDLGNGC

SEQ ID NO: 528849 - protein, 11 aa, Influenza virus
KDNARELGNGC

SEQ ID NO: 528850 - protein, 11 aa, Influenza virus
KDNAVRFGESE

SEQ ID NO: 528851 - protein, 11 aa, Influenza virus
KDNAVRIGEDA

SEQ ID NO: 528852 - protein, 11 aa, Influenza virus
KDNAVRIGEDS

SEQ ID NO: 528853 - protein, 11 aa, Influenza virus
KDNAVRIGENS

SEQ ID NO: 528854 - protein, 11 aa, Influenza virus
KDNGIRIGSKG

SEQ ID NO: 528855 - protein, 11 aa, Influenza virus
KDNGIRIGSRG

SEQ ID NO: 528856 - protein, 11 aa, Influenza virus
KDNGIRVGSRG

SEQ ID NO: 528857 - protein, 11 aa, Influenza virus
KDNGVRIGSKG

SEQ ID NO: 528858 - protein, 11 aa, Influenza virus
KDNLEPGTFDL

SEQ ID NO: 528859 - protein, 11 aa, Influenza virus
KDNNIRIGSKG

SEQ ID NO: 528860 - protein, 11 aa, Influenza virus
KDNQVFPQLNQ

SEQ ID NO: 528861 - protein, 11 aa, Influenza virus
KDNSIQLSAGG

SEQ ID NO: 528862 - protein, 11 aa, Influenza virus
KDNSIRIGSKG

SEQ ID NO: 528863 - protein, 11 aa, Influenza virus
KDNSIRIGSRG

SEQ ID NO: 528864 - protein, 11 aa, Influenza virus
KDNSIRLAAGG

SEQ ID NO: 528865 - protein, 11 aa, Influenza virus
KDNSIRLSADG

SEQ ID NO: 528866 - protein, 11 aa, Influenza virus
KDNSIRLSAGG

SEQ ID NO: 528867 - protein, 11 aa, Influenza virus
KDNSIRLSASG

SEQ ID NO: 528868 - protein, 11 aa, Influenza virus
KDNSVRIGSKG

SEQ ID NO: 528869 - protein, 11 aa, Influenza virus
KDNSVRLSAGG

SEQ ID NO: 528870 - protein, 11 aa, Influenza virus
KDNSVRLSASG

SEQ ID NO: 528871 - protein, 11 aa, Influenza virus
KDPKKTGGPIY

SEQ ID NO: 528872 - protein, 11 aa, Influenza virus
KDQAWSYIVER

SEQ ID NO: 528873 - protein, 11 aa, Influenza virus
KDQDWSYIVER

SEQ ID NO: 528874 - protein, 11 aa, Influenza virus
KDQGWSYIVER

SEQ ID NO: 528875 - protein, 11 aa, Influenza virus
KDQSWSYIVER

SEQ ID NO: 528876 - protein, 11 aa, Influenza virus
KDRSPFRALMS

SEQ ID NO: 528877 - protein, 11 aa, Influenza virus
KDRSPFRTLMS

SEQ ID NO: 528878 - protein, 11 aa, Influenza virus
KDRSPHRALMS

SEQ ID NO: 528879 - protein, 11 aa, Influenza virus
KDRSPHRTLMS

SEQ ID NO: 528880 - protein, 11 aa, Influenza virus
KDRSPQRTLMS

SEQ ID NO: 528881 - protein, 11 aa, Influenza virus
KDRSPYRALMS

SEQ ID NO: 528882 - protein, 11 aa, Influenza virus
KDRSPYRTLMS

SEQ ID NO: 528883 - protein, 11 aa, Influenza virus
KDSITDIWTYQ

SEQ ID NO: 528884 - protein, 11 aa, Influenza virus
KDSITYIWTYQ

SEQ ID NO: 528885 - protein, 11 aa, Influenza virus
KDSNGVQDIID

SEQ ID NO: 528886 - protein, 11 aa, Influenza virus
KDSRSGYETFK

SEQ ID NO: 528887 - protein, 11 aa, Influenza virus
KDSRSGYETFR

SEQ ID NO: 528888 - protein, 11 aa, Influenza virus
KDVILWFSFGA

SEQ ID NO: 528889 - protein, 11 aa, Influenza virus
KDVILWFSLGA

SEQ ID NO: 528890 - protein, 11 aa, Influenza virus
KDVILWISFSI

SEQ ID NO: 528891 - protein, 11 aa, Influenza virus
KDWILWISFAI

SEQ ID NO: 528892 - protein, 11 aa, Influenza virus
KDWILWISFAM

SEQ ID NO: 528893 - protein, 11 aa, Influenza virus
KDWILWISFAT

SEQ ID NO: 528894 - protein, 11 aa, Influenza virus
KDWVLWISFAI

SEQ ID NO: 528895 - protein, 11 aa, Influenza virus
KDYEEEAKLER

SEQ ID NO: 528896 - protein, 11 aa, Influenza virus
KDYRYTYRCHK

SEQ ID NO: 528897 - protein, 11 aa, Influenza virus
KDYRYTYRCHR

SEQ ID NO: 528898 - protein, 11 aa, Influenza virus
KEAMQNRIQID

SEQ ID NO: 528899 - protein, 11 aa, Influenza virus
KEAQDVIMEIV

SEQ ID NO: 528900 - protein, 11 aa, Influenza virus
KEAQDVIMEVV

SEQ ID NO: 528901 - protein, 11 aa, Influenza virus
KECFNPCFYVE

SEQ ID NO: 528902 - protein, 11 aa, Influenza virus
KEDEVWWTSNS

SEQ ID NO: 528903 - protein, 11 aa, Influenza virus
KEDKVWWTSNS

SEQ ID NO: 528904 - protein, 11 aa, Influenza virus
KEDRVWWTSNS

SEQ ID NO: 528905 - protein, 11 aa, Influenza virus
KEDSRSGYETF

SEQ ID NO: 528906 - protein, 11 aa, Influenza virus
KEEALKGSARH

SEQ ID NO: 528907 - protein, 11 aa, Influenza virus
KEEALQGSARH

SEQ ID NO: 528908 - protein, 11 aa, Influenza virus
KEECYRACFYV

SEQ ID NO: 528909 - protein, 11 aa, Influenza virus
KEEKVWWTSNS

SEQ ID NO: 528910 - protein, 11 aa, Influenza virus
KEEPLKGSAKH

SEQ ID NO: 528911 - protein, 11 aa, Influenza virus
KEESQLKRQEI

SEQ ID NO: 528912 - protein, 11 aa, Influenza virus
KEETLKGSARH

SEQ ID NO: 528913 - protein, 11 aa, Influenza virus
KEEVINATETV

SEQ ID NO: 528914 - protein, 11 aa, Influenza virus
KEEVLKGSARH

SEQ ID NO: 528915 - protein, 11 aa, Influenza virus
KEEVTNATETV

SEQ ID NO: 528916 - protein, 11 aa, Influenza virus
KEFEQVEGRIQ

SEQ ID NO: 528917 - protein, 11 aa, Influenza virus
KEFEQVEGRTQ

SEQ ID NO: 528918 - protein, 11 aa, Influenza virus
KEFGNLERRLE

SEQ ID NO: 528919 - protein, 11 aa, Influenza virus
KEFGQVEGRIQ

SEQ ID NO: 528920 - protein, 11 aa, Influenza virus
KEFNNLEKRLE

SEQ ID NO: 528921 - protein, 11 aa, Influenza virus
KEFNNLERRLE

SEQ ID NO: 528922 - protein, 11 aa, Influenza virus
KEFSEIEGRIQ

SEQ ID NO: 528923 - protein, 11 aa, Influenza virus
KEFSEVEGRIQ

SEQ ID NO: 528924 - protein, 11 aa, Influenza virus
KEFSNLEKRLE

SEQ ID NO: 528925 - protein, 11 aa, Influenza virus
KEFSNLERRLE

SEQ ID NO: 528926 - protein, 11 aa, Influenza virus
KEFTEVEGRIQ

SEQ ID NO: 528927 - protein, 11 aa, Influenza virus
KEGRRKTNLYG

SEQ ID NO: 528928 - protein, 11 aa, Influenza virus
KEGRRRTNLYG

SEQ ID NO: 528929 - protein, 11 aa, Influenza virus
KEGSYFFGDNA

SEQ ID NO: 528930 - protein, 11 aa, Influenza virus
KEGYSLVGIDP

SEQ ID NO: 528931 - protein, 11 aa, Influenza virus
KEGYSLVGVDP

SEQ ID NO: 528932 - protein, 11 aa, Influenza virus
KEIEGICYPGS

SEQ ID NO: 528933 - protein, 11 aa, Influenza virus
KEIGNGCFEFY

SEQ ID NO: 528934 - protein, 11 aa, Influenza virus
KEIILWFSFGA

SEQ ID NO: 528935 - protein, 11 aa, Influenza virus
KEKAIWTSGSS

SEQ ID NO: 528936 - protein, 11 aa, Influenza virus
KEKEICSVVLE

SEQ ID NO: 528937 - protein, 11 aa, Influenza virus
KEKENSYPKIN

SEQ ID NO: 528938 - protein, 11 aa, Influenza virus
KEKENSYPMIN

SEQ ID NO: 528939 - protein, 11 aa, Influenza virus
KEKTIWTSGSS

SEQ ID NO: 528940 - protein, 11 aa, Influenza virus
KEKVTNATETV

SEQ ID NO: 528941 - protein, 11 aa, Influenza virus
KELGNGCFEFY

SEQ ID NO: 528942 - protein, 11 aa, Influenza virus
KELVETNHTDE

SEQ ID NO: 528943 - protein, 11 aa, Influenza virus
KEMEGICYPGS

SEQ ID NO: 528944 - protein, 11 aa, Influenza virus
KEMEGVCYPGS

SEQ ID NO: 528945 - protein, 11 aa, Influenza virus
KEMGNGCFEFY

SEQ ID NO: 528946 - protein, 11 aa, Influenza virus
KENPAHKSQLV

SEQ ID NO: 528947 - protein, 11 aa, Influenza virus
KENTGSYVRLY

SEQ ID NO: 528948 - protein, 11 aa, Influenza virus
KEPALIVWGVH

SEQ ID NO: 528949 - protein, 11 aa, Influenza virus
KEPDTYDFNEG

SEQ ID NO: 528950 - protein, 11 aa, Influenza virus
KEPISLGDCSF

SEQ ID NO: 528951 - protein, 11 aa, Influenza virus
KEPMGFRYSGI

SEQ ID NO: 528952 - protein, 11 aa, Influenza virus
KEQGSGYAADK

SEQ ID NO: 528953 - protein, 11 aa, Influenza virus
KEQLGSWSWHD

SEQ ID NO: 528954 - protein, 11 aa, Influenza virus
KEQTALYKNAN

SEQ ID NO: 528955 - protein, 11 aa, Influenza virus
KEQTTLYKNAN

SEQ ID NO: 528956 - protein, 11 aa, Influenza virus
KERLGSWSWHD

SEQ ID NO: 528957 - protein, 11 aa, Influenza virus
KERTSIWTSSS

SEQ ID NO: 528958 - protein, 11 aa, Influenza virus
KESKLNRNEIK

SEQ ID NO: 528959 - protein, 11 aa, Influenza virus
KESLRLAIGLR

SEQ ID NO: 528960 - protein, 11 aa, Influenza virus
KESLRLALGLR

SEQ ID NO: 528961 - protein, 11 aa, Influenza virus
KESLRLAVGLR

SEQ ID NO: 528962 - protein, 11 aa, Influenza virus
KESMGFRYSGI

SEQ ID NO: 528963 - protein, 11 aa, Influenza virus
KESRSGYETFK

SEQ ID NO: 528964 - protein, 11 aa, Influenza virus
KESTQKAIDQI

SEQ ID NO: 528965 - protein, 11 aa, Influenza virus
KESTQKAIDRI

SEQ ID NO: 528966 - protein, 11 aa, Influenza virus
KETGNGCFEFY

SEQ ID NO: 528967 - protein, 11 aa, Influenza virus
KETNGNYGPIN

SEQ ID NO: 528968 - protein, 11 aa, Influenza virus
KETRVWWTSNS

SEQ ID NO: 528969 - protein, 11 aa, Influenza virus
KEVGNGCFEFY

SEQ ID NO: 528970 - protein, 11 aa, Influenza virus
KEVILWFSFGA

SEQ ID NO: 528971 - protein, 11 aa, Influenza virus
KEWGNGCFEFY

SEQ ID NO: 528972 - protein, 11 aa, Influenza virus
KEWSGYSGSFV

SEQ ID NO: 528973 - protein, 11 aa, Influenza virus
KEWSKRYELEI

SEQ ID NO: 528974 - protein, 11 aa, Influenza virus
KEWSRRYELEI

SEQ ID NO: 528975 - protein, 11 aa, Influenza virus
KEYEEEAKLEK

SEQ ID NO: 528976 - protein, 11 aa, Influenza virus
KEYEEEAKLER

SEQ ID NO: 528977 - protein, 11 aa, Influenza virus
KFCYPGELDNN

SEQ ID NO: 528978 - protein, 11 aa, Influenza virus
KFEAVAWSATA

SEQ ID NO: 528979 - protein, 11 aa, Influenza virus
KFESVAWSASA

SEQ ID NO: 528980 - protein, 11 aa, Influenza virus
KFESVAWSATA

SEQ ID NO: 528981 - protein, 11 aa, Influenza virus
KFFPSSSYRRP

SEQ ID NO: 528982 - protein, 11 aa, Influenza virus
KFHQIEKEFSE

SEQ ID NO: 528983 - protein, 11 aa, Influenza virus
KFHQIEKEFTE

SEQ ID NO: 528984 - protein, 11 aa, Influenza virus
KFHSDTPRPAD

SEQ ID NO: 528985 - protein, 11 aa, Influenza virus
KFHSDTPRPDD

SEQ ID NO: 528986 - protein, 11 aa, Influenza virus
KFHSDTPRPSD

SEQ ID NO: 528987 - protein, 11 aa, Influenza virus
KFHSDTPRPTD

SEQ ID NO: 528988 - protein, 11 aa, Influenza virus
KFHSDTPRPVD

SEQ ID NO: 528989 - protein, 11 aa, Influenza virus
KFKADLIIERR

SEQ ID NO: 528990 - protein, 11 aa, Influenza virus
KFLLMDALKLS

SEQ ID NO: 528991 - protein, 11 aa, Influenza virus
KFLLMDSLKLS

SEQ ID NO: 528992 - protein, 11 aa, Influenza virus
KFQTAAQKAMM

SEQ ID NO: 528993 - protein, 11 aa, Influenza virus
KFQTAAQRAMM

SEQ ID NO: 528994 - protein, 11 aa, Influenza virus
KFQTAAQRAMV

SEQ ID NO: 528995 - protein, 11 aa, Influenza virus
KFTNEEALRQI

SEQ ID NO: 528996 - protein, 11 aa, Influenza virus
KFYIQMCTELK

SEQ ID NO: 528997 - protein, 11 aa, Influenza virus
KGCFDILHKCD

SEQ ID NO: 528998 - protein, 11 aa, Influenza virus
KGCINRCFYVE

SEQ ID NO: 528999 - protein, 11 aa, Influenza virus
KGDCYRACFYV

SEQ ID NO: 529000 - protein, 11 aa, Influenza virus
KGDIFVIREPF

SEQ ID NO: 529001 - protein, 11 aa, Influenza virus
KGDIFVMREPF

SEQ ID NO: 529002 - protein, 11 aa, Influenza virus
KGDKICLGHHA

SEQ ID NO: 529003 - protein, 11 aa, Influenza virus
KGDQICIGYHA

SEQ ID NO: 529004 - protein, 11 aa, Influenza virus
KGDRICIGYHA

SEQ ID NO: 529005 - protein, 11 aa, Influenza virus
KGDVFVIREPF

SEQ ID NO: 529006 - protein, 11 aa, Influenza virus
KGDVFVMREPF

SEQ ID NO: 529007 - protein, 11 aa, Influenza virus
KGDYNNTTGRD

SEQ ID NO: 529008 - protein, 11 aa, Influenza virus
KGECYRACFYV

SEQ ID NO: 529009 - protein, 11 aa, Influenza virus
KGEKANVLIGQ

SEQ ID NO: 529010 - protein, 11 aa, Influenza virus
KGEYNNTTGRD

SEQ ID NO: 529011 - protein, 11 aa, Influenza virus
KGFAPFSKDNG

SEQ ID NO: 529012 - protein, 11 aa, Influenza virus
KGFAPFSKDNS

SEQ ID NO: 529013 - protein, 11 aa, Influenza virus
KGFFPFHKDNA

SEQ ID NO: 529014 - protein, 11 aa, Influenza virus
KGFGFRQGDDV

SEQ ID NO: 529015 - protein, 11 aa, Influenza virus
KGFGFRQGNDV

SEQ ID NO: 529016 - protein, 11 aa, Influenza virus
KGFGFRQGNNV

SEQ ID NO: 529017 - protein, 11 aa, Influenza virus
KGFGFRQGNSV

SEQ ID NO: 529018 - protein, 11 aa, Influenza virus
KGFGFRQGSDV

SEQ ID NO: 529019 - protein, 11 aa, Influenza virus
KGFGFRQGTDV

SEQ ID NO: 529020 - protein, 11 aa, Influenza virus
KGFGFRQGTSV

SEQ ID NO: 529021 - protein, 11 aa, Influenza virus
KGFSFRYGDGV

SEQ ID NO: 529022 - protein, 11 aa, Influenza virus
KGGPGVKGFGF

SEQ ID NO: 529023 - protein, 11 aa, Influenza virus
KGGSIKTKLPF

SEQ ID NO: 529024 - protein, 11 aa, Influenza virus
KGGSINTKLPF

SEQ ID NO: 529025 - protein, 11 aa, Influenza virus
KGHVFVIREPF

SEQ ID NO: 529026 - protein, 11 aa, Influenza virus
KGIEVVNATET

SEQ ID NO: 529027 - protein, 11 aa, Influenza virus
KGILEDEQMYQ

SEQ ID NO: 529028 - protein, 11 aa, Influenza virus
KGILGFVFTLT

SEQ ID NO: 529029 - protein, 11 aa, Influenza virus
KGKFQTAAQKA

SEQ ID NO: 529030 - protein, 11 aa, Influenza virus
KGKFQTAAQRA

SEQ ID NO: 529031 - protein, 11 aa, Influenza virus
KGKKAVDLGSC

SEQ ID NO: 529032 - protein, 11 aa, Influenza virus
KGLCTINSWHI

SEQ ID NO: 529033 - protein, 11 aa, Influenza virus
KGLFGAIAGFI

SEQ ID NO: 529034 - protein, 11 aa, Influenza virus
KGLILGNPKCD

SEQ ID NO: 529035 - protein, 11 aa, Influenza virus
KGLWDSFRQSE

SEQ ID NO: 529036 - protein, 11 aa, Influenza virus
KGMLGFVFTLT

SEQ ID NO: 529037 - protein, 11 aa, Influenza virus
KGNAKDEGNGC

SEQ ID NO: 529038 - protein, 11 aa, Influenza virus
KGNGCFEIFHK

SEQ ID NO: 529039 - protein, 11 aa, Influenza virus
KGNGCFEIFHQ

SEQ ID NO: 529040 - protein, 11 aa, Influenza virus
KGNGCFEIFHR

SEQ ID NO: 529041 - protein, 11 aa, Influenza virus
KGNIMRTQESE

SEQ ID NO: 529042 - protein, 11 aa, Influenza virus
KGNPGVKGWAF

SEQ ID NO: 529043 - protein, 11 aa, Influenza virus
KGNQGVKGWAF

SEQ ID NO: 529044 - protein, 11 aa, Influenza virus
KGNSARLIHHT

SEQ ID NO: 529045 - protein, 11 aa, Influenza virus
KGRGLFGAIAG

SEQ ID NO: 529046 - protein, 11 aa, Influenza virus
KGRHANGTIHD

SEQ ID NO: 529047 - protein, 11 aa, Influenza virus
KGRLCNPLNPF

SEQ ID NO: 529048 - protein, 11 aa, Influenza virus
KGRSHLRNDTD

SEQ ID NO: 529049 - protein, 11 aa, Influenza virus
KGRYGVKGFSF

SEQ ID NO: 529050 - protein, 11 aa, Influenza virus
KGSAKHIEECS

SEQ ID NO: 529051 - protein, 11 aa, Influenza virus
KGSARHIEECS

SEQ ID NO: 529052 - protein, 11 aa, Influenza virus
KGSARHIEEWS

SEQ ID NO: 529053 - protein, 11 aa, Influenza virus
KGSARHVEECS

SEQ ID NO: 529054 - protein, 11 aa, Influenza virus
KGSIQSDKPFQ

SEQ ID NO: 529055 - protein, 11 aa, Influenza virus
KGSNRPIIDIN

SEQ ID NO: 529056 - protein, 11 aa, Influenza virus
KGSNRPVIDIN

SEQ ID NO: 529057 - protein, 11 aa, Influenza virus
KGSNRPVIDVN

SEQ ID NO: 529058 - protein, 11 aa, Influenza virus
KGSNRPVVDIN

SEQ ID NO: 529059 - protein, 11 aa, Influenza virus
KGSNRPWIRIN

SEQ ID NO: 529060 - protein, 11 aa, Influenza virus
KGSNRPWMRIN

SEQ ID NO: 529061 - protein, 11 aa, Influenza virus
KGSNRPWMRIS

SEQ ID NO: 529062 - protein, 11 aa, Influenza virus
KGSNRPWVRMN

SEQ ID NO: 529063 - protein, 11 aa, Influenza virus
KGSWPDGANIN

SEQ ID NO: 529064 - protein, 11 aa, Influenza virus
KGSYNNTNGEQ

SEQ ID NO: 529065 - protein, 11 aa, Influenza virus
KGSYNNTSGEQ

SEQ ID NO: 529066 - protein, 11 aa, Influenza virus
KGVELSSMGVY

SEQ ID NO: 529067 - protein, 11 aa, Influenza virus
KGVEVVNATET

SEQ ID NO: 529068 - protein, 11 aa, Influenza virus
KGVKLSNMGIY

SEQ ID NO: 529069 - protein, 11 aa, Influenza virus
KGVKLSNMGVY

SEQ ID NO: 529070 - protein, 11 aa, Influenza virus
KGVKLSSMGIY

SEQ ID NO: 529071 - protein, 11 aa, Influenza virus
KGVKLSSMGVY

SEQ ID NO: 529072 - protein, 11 aa, Influenza virus
KGVYINTALLN

SEQ ID NO: 529073 - protein, 11 aa, Influenza virus
KGVYINTAMLN

SEQ ID NO: 529074 - protein, 11 aa, Influenza virus
KGVYMNTALLN

SEQ ID NO: 529075 - protein, 11 aa, Influenza virus
KGVYVNTALLN

SEQ ID NO: 529076 - protein, 11 aa, Influenza virus
KGWAPLSKDNG

SEQ ID NO: 529077 - protein, 11 aa, Influenza virus
KGYGVKGFGFR

SEQ ID NO: 529078 - protein, 11 aa, Influenza virus
KHDRIPHRTLL

SEQ ID NO: 529079 - protein, 11 aa, Influenza virus
KHDSNVKNLFD

SEQ ID NO: 529080 - protein, 11 aa, Influenza virus
KHENRMVLAST

SEQ ID NO: 529081 - protein, 11 aa, Influenza virus
KHIEECSCYGE

SEQ ID NO: 529082 - protein, 11 aa, Influenza virus
KHIEECSCYGH

SEQ ID NO: 529083 - protein, 11 aa, Influenza virus
KHIEECSCYGK

SEQ ID NO: 529084 - protein, 11 aa, Influenza virus
KHIEECSCYGV

SEQ ID NO: 529085 - protein, 11 aa, Influenza virus
KHIVERILEEE

SEQ ID NO: 529086 - protein, 11 aa, Influenza virus
KHLAYCNTDLG

SEQ ID NO: 529087 - protein, 11 aa, Influenza virus
KHLEECSCYVD

SEQ ID NO: 529088 - protein, 11 aa, Influenza virus
KHPAYCNTDLG

SEQ ID NO: 529089 - protein, 11 aa, Influenza virus
KHQNAQGEGTA

SEQ ID NO: 529090 - protein, 11 aa, Influenza virus
KHRFEIIEGRD

SEQ ID NO: 529091 - protein, 11 aa, Influenza virus
KHSAYCNTDLG

SEQ ID NO: 529092 - protein, 11 aa, Influenza virus
KHSNGTIHDRA

SEQ ID NO: 529093 - protein, 11 aa, Influenza virus
KHSNGTIHDRI

SEQ ID NO: 529094 - protein, 11 aa, Influenza virus
KHSNGTIHDRS

SEQ ID NO: 529095 - protein, 11 aa, Influenza virus
KHSNGTIHDRT

SEQ ID NO: 529096 - protein, 11 aa, Influenza virus
KHSNGTIKDRS

SEQ ID NO: 529097 - protein, 11 aa, Influenza virus
KHSNGTMKDRS

SEQ ID NO: 529098 - protein, 11 aa, Influenza virus
KHSNGTTHDRT

SEQ ID NO: 529099 - protein, 11 aa, Influenza virus
KHSNGTVKDRS

SEQ ID NO: 529100 - protein, 11 aa, Influenza virus
KHSNNTVKDRS

SEQ ID NO: 529101 - protein, 11 aa, Influenza virus
KHSNSTTHDRT

SEQ ID NO: 529102 - protein, 11 aa, Influenza virus
KHSSGTVKDRS

SEQ ID NO: 529103 - protein, 11 aa, Influenza virus
KHTSQYICSPV

SEQ ID NO: 529104 - protein, 11 aa, Influenza virus
KHTSQYLCTGV

SEQ ID NO: 529105 - protein, 11 aa, Influenza virus
KHWSGYSGSFT

SEQ ID NO: 529106 - protein, 11 aa, Influenza virus
KHYIGKCPKYI

SEQ ID NO: 529107 - protein, 11 aa, Influenza virus
KHYIGKCPRYI

SEQ ID NO: 529108 - protein, 11 aa, Influenza virus
KICIGYHANNS

SEQ ID NO: 529109 - protein, 11 aa, Influenza virus
KICIGYLSNNA

SEQ ID NO: 529110 - protein, 11 aa, Influenza virus
KICIGYLSNNS

SEQ ID NO: 529111 - protein, 11 aa, Influenza virus
KICIGYQTNNS

SEQ ID NO: 529112 - protein, 11 aa, Influenza virus
KICLGHHAIPN

SEQ ID NO: 529113 - protein, 11 aa, Influenza virus
KICLGHHAVAN

SEQ ID NO: 529114 - protein, 11 aa, Influenza virus
KICLGHHAVPN

SEQ ID NO: 529115 - protein, 11 aa, Influenza virus
KICLGHHAVSN

SEQ ID NO: 529116 - protein, 11 aa, Influenza virus
KICLGHHAVTN

SEQ ID NO: 529117 - protein, 11 aa, Influenza virus
KICVGYLSTNS

SEQ ID NO: 529118 - protein, 11 aa, Influenza virus
KIDDQIEDLWA

SEQ ID NO: 529119 - protein, 11 aa, Influenza virus
KIDDQIEELWA

SEQ ID NO: 529120 - protein, 11 aa, Influenza virus
KIDDQIEGLWA

SEQ ID NO: 529121 - protein, 11 aa, Influenza virus
KIDDQIENLWA

SEQ ID NO: 529122 - protein, 11 aa, Influenza virus
KIDLWSYNADV

SEQ ID NO: 529123 - protein, 11 aa, Influenza virus
KIDLWSYNAEL

SEQ ID NO: 529124 - protein, 11 aa, Influenza virus
KIDLWSYNAGL

SEQ ID NO: 529125 - protein, 11 aa, Influenza virus
KIDPVKLSSGY

SEQ ID NO: 529126 - protein, 11 aa, Influenza virus
KIDTILERNVT

SEQ ID NO: 529127 - protein, 11 aa, Influenza virus
KIDTLTETGVP

SEQ ID NO: 529128 - protein, 11 aa, Influenza virus
KIEAVIYGNPK

SEQ ID NO: 529129 - protein, 11 aa, Influenza virus
KIEFEPFQSLV

SEQ ID NO: 529130 - protein, 11 aa, Influenza virus
KIEKIEKIRPL

SEQ ID NO: 529131 - protein, 11 aa, Influenza virus
KIHTRGLFGAI

SEQ ID NO: 529132 - protein, 11 aa, Influenza virus
KIIQNEDIPIG

SEQ ID NO: 529133 - protein, 11 aa, Influenza virus
KIIRVGCVILL

SEQ ID NO: 529134 - protein, 11 aa, Influenza virus
KIITIGSASLG

SEQ ID NO: 529135 - protein, 11 aa, Influenza virus
KIITIGSISLG

SEQ ID NO: 529136 - protein, 11 aa, Influenza virus
KIITIGSISLT

SEQ ID NO: 529137 - protein, 11 aa, Influenza virus
KIITIGSVSLA

SEQ ID NO: 529138 - protein, 11 aa, Influenza virus
KIITIGSVSLI

SEQ ID NO: 529139 - protein, 11 aa, Influenza virus
KIITIGSVSLT

SEQ ID NO: 529140 - protein, 11 aa, Influenza virus
KIKHLEECSCY

SEQ ID NO: 529141 - protein, 11 aa, Influenza virus
KIKMKWGMELR

SEQ ID NO: 529142 - protein, 11 aa, Influenza virus
KIKMKWGMEMR

SEQ ID NO: 529143 - protein, 11 aa, Influenza virus
KIKTNGNLIAP

SEQ ID NO: 529144 - protein, 11 aa, Influenza virus
KILDEHDSNVK

SEQ ID NO: 529145 - protein, 11 aa, Influenza virus
KILKIKKGKIM

SEQ ID NO: 529146 - protein, 11 aa, Influenza virus
KILKIKKGKIV

SEQ ID NO: 529147 - protein, 11 aa, Influenza virus
KILKIRKGKIM

SEQ ID NO: 529148 - protein, 11 aa, Influenza virus
KILKIRKGKIV

SEQ ID NO: 529149 - protein, 11 aa, Influenza virus
KILRTQESECV

SEQ ID NO: 529150 - protein, 11 aa, Influenza virus
KILRTQESSCV

SEQ ID NO: 529151 - protein, 11 aa, Influenza virus
KILSIYSCIAS

SEQ ID NO: 529152 - protein, 11 aa, Influenza virus
KILSIYSCVAS

SEQ ID NO: 529153 - protein, 11 aa, Influenza virus
KILSIYSSVAS

SEQ ID NO: 529154 - protein, 11 aa, Influenza virus
KILSIYSTVAA

SEQ ID NO: 529155 - protein, 11 aa, Influenza virus
KILSIYSTVAS

SEQ ID NO: 529156 - protein, 11 aa, Influenza virus
KILTIYSTAAS

SEQ ID NO: 529157 - protein, 11 aa, Influenza virus
KILTIYSTVAS

SEQ ID NO: 529158 - protein, 11 aa, Influenza virus
KIMESGGIDKI

SEQ ID NO: 529159 - protein, 11 aa, Influenza virus
KIMESGGIDKV

SEQ ID NO: 529160 - protein, 11 aa, Influenza virus
KIMESGGISKI

SEQ ID NO: 529161 - protein, 11 aa, Influenza virus
KIMESGGISKM

SEQ ID NO: 529162 - protein, 11 aa, Influenza virus
KIMTIGSVSLA

SEQ ID NO: 529163 - protein, 11 aa, Influenza virus
KINDQIEDLWA

SEQ ID NO: 529164 - protein, 11 aa, Influenza virus
KINEVKLEENT

SEQ ID NO: 529165 - protein, 11 aa, Influenza virus
KINGKLNRLIE

SEQ ID NO: 529166 - protein, 11 aa, Influenza virus
KINGVILEENT

SEQ ID NO: 529167 - protein, 11 aa, Influenza virus
KINGVKLEENS

SEQ ID NO: 529168 - protein, 11 aa, Influenza virus
KINGVKLEENT

SEQ ID NO: 529169 - protein, 11 aa, Influenza virus
KINGVRLEENT

SEQ ID NO: 529170 - protein, 11 aa, Influenza virus
KINNIIDKMNG

SEQ ID NO: 529171 - protein, 11 aa, Influenza virus
KINNIIEKMNG

SEQ ID NO: 529172 - protein, 11 aa, Influenza virus
KINNIVDKMNR

SEQ ID NO: 529173 - protein, 11 aa, Influenza virus
KINPVTLTMGY

SEQ ID NO: 529174 - protein, 11 aa, Influenza virus
KINSIIDKMNT

SEQ ID NO: 529175 - protein, 11 aa, Influenza virus
KINTLTERGVE

SEQ ID NO: 529176 - protein, 11 aa, Influenza virus
KIPNAETDPNS

SEQ ID NO: 529177 - protein, 11 aa, Influenza virus
KIPNAETDPSS

SEQ ID NO: 529178 - protein, 11 aa, Influenza virus
KIPNAGIDPNS

SEQ ID NO: 529179 - protein, 11 aa, Influenza virus
KIPNAGTDPNS

SEQ ID NO: 529180 - protein, 11 aa, Influenza virus
KIQHLEECSCY

SEQ ID NO: 529181 - protein, 11 aa, Influenza virus
KIQTNGNLIAP

SEQ ID NO: 529182 - protein, 11 aa, Influenza virus
KIQTSGNLIAP

SEQ ID NO: 529183 - protein, 11 aa, Influenza virus
KIRHLEECSCY

SEQ ID NO: 529184 - protein, 11 aa, Influenza virus
KIRLQLRDNAK

SEQ ID NO: 529185 - protein, 11 aa, Influenza virus
KIRNGTYDHKE

SEQ ID NO: 529186 - protein, 11 aa, Influenza virus
KIRRRVDINPG

SEQ ID NO: 529187 - protein, 11 aa, Influenza virus
KIRRRVDMNPG

SEQ ID NO: 529188 - protein, 11 aa, Influenza virus
KIRRRVDTNPG

SEQ ID NO: 529189 - protein, 11 aa, Influenza virus
KIRRRVDVNPG

SEQ ID NO: 529190 - protein, 11 aa, Influenza virus
KIRTNGNLIAP

SEQ ID NO: 529191 - protein, 11 aa, Influenza virus
KIRTRGLFGAI

SEQ ID NO: 529192 - protein, 11 aa, Influenza virus
KIRVKRRPVAK

SEQ ID NO: 529193 - protein, 11 aa, Influenza virus
KISGVKLEENS

SEQ ID NO: 529194 - protein, 11 aa, Influenza virus
KISKRGGSGIM

SEQ ID NO: 529195 - protein, 11 aa, Influenza virus
KISKRGSSGIM

SEQ ID NO: 529196 - protein, 11 aa, Influenza virus
KISKRGSSGVM

SEQ ID NO: 529197 - protein, 11 aa, Influenza virus
KISKSTKSTVL

SEQ ID NO: 529198 - protein, 11 aa, Influenza virus
KISSSFSFGGF

SEQ ID NO: 529199 - protein, 11 aa, Influenza virus
KITCVCRDNWQ

SEQ ID NO: 529200 - protein, 11 aa, Influenza virus
KITENSFEQIT

SEQ ID NO: 529201 - protein, 11 aa, Influenza virus
KITGFAPFSKD

SEQ ID NO: 529202 - protein, 11 aa, Influenza virus
KITLKFAFNMM

SEQ ID NO: 529203 - protein, 11 aa, Influenza virus
KITNKINNIVD

SEQ ID NO: 529204 - protein, 11 aa, Influenza virus
KITNKVNNIVD

SEQ ID NO: 529205 - protein, 11 aa, Influenza virus
KITVDHMAIIK

SEQ ID NO: 529206 - protein, 11 aa, Influenza virus
KIVTTVGWSWP

SEQ ID NO: 529207 - protein, 11 aa, Influenza virus
KIYWHLMHPGE

SEQ ID NO: 529208 - protein, 11 aa, Influenza virus
KKAKLANVVRK

SEQ ID NO: 529209 - protein, 11 aa, Influenza virus
KKASLRLAVGL

SEQ ID NO: 529210 - protein, 11 aa, Influenza virus
KKAVDLGSCGI

SEQ ID NO: 529211 - protein, 11 aa, Influenza virus
KKCFNPCFYVE

SEQ ID NO: 529212 - protein, 11 aa, Influenza virus
KKEPDTYDFNE

SEQ ID NO: 529213 - protein, 11 aa, Influenza virus
KKESLRLAIGL

SEQ ID NO: 529214 - protein, 11 aa, Influenza virus
KKESLRLALGL

SEQ ID NO: 529215 - protein, 11 aa, Influenza virus
KKESLRLAVGL

SEQ ID NO: 529216 - protein, 11 aa, Influenza virus
KKHPAYCNTDL

SEQ ID NO: 529217 - protein, 11 aa, Influenza virus
KKILRTQESSC

SEQ ID NO: 529218 - protein, 11 aa, Influenza virus
KKKKKKRGLFG

SEQ ID NO: 529219 - protein, 11 aa, Influenza virus
KKKKKRGLFGA

SEQ ID NO: 529220 - protein, 11 aa, Influenza virus
KKKKRGLFGAI

SEQ ID NO: 529221 - protein, 11 aa, Influenza virus
KKKNPEAYNFN

SEQ ID NO: 529222 - protein, 11 aa, Influenza virus
KKKPDIYDFNE

SEQ ID NO: 529223 - protein, 11 aa, Influenza virus
KKKPDTYDFNE

SEQ ID NO: 529224 - protein, 11 aa, Influenza virus
KKKRGLFGAIA

SEQ ID NO: 529225 - protein, 11 aa, Influenza virus
KKKSYINKTGT

SEQ ID NO: 529226 - protein, 11 aa, Influenza virus
KKKSYINRTGT

SEQ ID NO: 529227 - protein, 11 aa, Influenza virus
KKLKREITFHG

SEQ ID NO: 529228 - protein, 11 aa, Influenza virus
KKLKREMTFHG

SEQ ID NO: 529229 - protein, 11 aa, Influenza virus
KKMEDGFLDVW

SEQ ID NO: 529230 - protein, 11 aa, Influenza virus
KKMEDGFLNVW

SEQ ID NO: 529231 - protein, 11 aa, Influenza virus
KKMTITFLILL

SEQ ID NO: 529232 - protein, 11 aa, Influenza virus
KKNPEAYNFNE

SEQ ID NO: 529233 - protein, 11 aa, Influenza virus
KKPDIYDFNEG

SEQ ID NO: 529234 - protein, 11 aa, Influenza virus
KKPDTYDFNEG

SEQ ID NO: 529235 - protein, 11 aa, Influenza virus
KKQEIEGIKLK

SEQ ID NO: 529236 - protein, 11 aa, Influenza virus
KKQILRTQESS

SEQ ID NO: 529237 - protein, 11 aa, Influenza virus
KKQLRENAEED

SEQ ID NO: 529238 - protein, 11 aa, Influenza virus
KKRGLFGAIAG

SEQ ID NO: 529239 - protein, 11 aa, Influenza virus
KKRKKRGLFGA

SEQ ID NO: 529240 - protein, 11 aa, Influenza virus
KKRLGSWSWHD

SEQ ID NO: 529241 - protein, 11 aa, Influenza virus
KKSYINKTGTF

SEQ ID NO: 529242 - protein, 11 aa, Influenza virus
KKSYINRTGTF

SEQ ID NO: 529243 - protein, 11 aa, Influenza virus
KKTNEKFHQIE

SEQ ID NO: 529244 - protein, 11 aa, Influenza virus
KKYERVKMFDF

SEQ ID NO: 529245 - protein, 11 aa, Influenza virus
KKYGPALSINE

SEQ ID NO: 529246 - protein, 11 aa, Influenza virus
KKYTSARQEKN

SEQ ID NO: 529247 - protein, 11 aa, Influenza virus
KKYTSGRQEKN

SEQ ID NO: 529248 - protein, 11 aa, Influenza virus
KLAIGLRNVPQ

SEQ ID NO: 529249 - protein, 11 aa, Influenza virus
KLAIGPRNVPA

SEQ ID NO: 529250 - protein, 11 aa, Influenza virus
KLAIGPRNVPQ

SEQ ID NO: 529251 - protein, 11 aa, Influenza virus
KLANVVRKMMT

SEQ ID NO: 529252 - protein, 11 aa, Influenza virus
KLAQGYKDIIL

SEQ ID NO: 529253 - protein, 11 aa, Influenza virus
KLASGLRNVPA

SEQ ID NO: 529254 - protein, 11 aa, Influenza virus
KLATGLKNVPA

SEQ ID NO: 529255 - protein, 11 aa, Influenza virus
KLATGLRNIPA

SEQ ID NO: 529256 - protein, 11 aa, Influenza virus
KLATGLRNVPA

SEQ ID NO: 529257 - protein, 11 aa, Influenza virus
KLATGLRNVPI

SEQ ID NO: 529258 - protein, 11 aa, Influenza virus
KLATGLRNVPQ

SEQ ID NO: 529259 - protein, 11 aa, Influenza virus
KLATGLRNVPS

SEQ ID NO: 529260 - protein, 11 aa, Influenza virus
KLATGLRNVPT

SEQ ID NO: 529261 - protein, 11 aa, Influenza virus
KLATGMRNIPE

SEQ ID NO: 529262 - protein, 11 aa, Influenza virus
KLATGMRNVPE

SEQ ID NO: 529263 - protein, 11 aa, Influenza virus
KLATGPRNVPA

SEQ ID NO: 529264 - protein, 11 aa, Influenza virus
KLCFPGELDNN

SEQ ID NO: 529265 - protein, 11 aa, Influenza virus
KLCFPGEVDNN

SEQ ID NO: 529266 - protein, 11 aa, Influenza virus
KLCKLNGIPPL

SEQ ID NO: 529267 - protein, 11 aa, Influenza virus
KLCRLRGIPPL

SEQ ID NO: 529268 - protein, 11 aa, Influenza virus
KLCRLSGIPPL

SEQ ID NO: 529269 - protein, 11 aa, Influenza virus
KLCYPGELDNN

SEQ ID NO: 529270 - protein, 11 aa, Influenza virus
KLCYPGEVDNN

SEQ ID NO: 529271 - protein, 11 aa, Influenza virus
KLDINMADYSI

SEQ ID NO: 529272 - protein, 11 aa, Influenza virus
KLEENSTYKIL

SEQ ID NO: 529273 - protein, 11 aa, Influenza virus
KLEENTSYKIL

SEQ ID NO: 529274 - protein, 11 aa, Influenza virus
KLEENTTYKIL

SEQ ID NO: 529275 - protein, 11 aa, Influenza virus
KLEENTTYRIL

SEQ ID NO: 529276 - protein, 11 aa, Influenza virus
KLEFEPFQSLV

SEQ ID NO: 529277 - protein, 11 aa, Influenza virus
KLEKSRINGVK

SEQ ID NO: 529278 - protein, 11 aa, Influenza virus
KLEQSGLPVGG

SEQ ID NO: 529279 - protein, 11 aa, Influenza virus
KLERSKINEVK

SEQ ID NO: 529280 - protein, 11 aa, Influenza virus
KLERSKINGVI

SEQ ID NO: 529281 - protein, 11 aa, Influenza virus
KLERSKINGVK

SEQ ID NO: 529282 - protein, 11 aa, Influenza virus
KLERSKINGVR

SEQ ID NO: 529283 - protein, 11 aa, Influenza virus
KLFALSGVAIA

SEQ ID NO: 529284 - protein, 11 aa, Influenza virus
KLFALSGVAIS

SEQ ID NO: 529285 - protein, 11 aa, Influenza virus
KLFALSGVAVA

SEQ ID NO: 529286 - protein, 11 aa, Influenza virus
KLFASSGIAIA

SEQ ID NO: 529287 - protein, 11 aa, Influenza virus
KLFASSGIAIV

SEQ ID NO: 529288 - protein, 11 aa, Influenza virus
KLFERVKRQLR

SEQ ID NO: 529289 - protein, 11 aa, Influenza virus
KLFERVRHQLR

SEQ ID NO: 529290 - protein, 11 aa, Influenza virus
KLFERVRRQLR

SEQ ID NO: 529291 - protein, 11 aa, Influenza virus
KLFTLSGVAIA

SEQ ID NO: 529292 - protein, 11 aa, Influenza virus
KLGQFPVQTDE

SEQ ID NO: 529293 - protein, 11 aa, Influenza virus
KLGSPLVLDDC

SEQ ID NO: 529294 - protein, 11 aa, Influenza virus
KLIQGYKDIIL

SEQ ID NO: 529295 - protein, 11 aa, Influenza virus
KLITVGSSKYQ

SEQ ID NO: 529296 - protein, 11 aa, Influenza virus
KLITVGSSKYR

SEQ ID NO: 529297 - protein, 11 aa, Influenza virus
KLKREITFHGA

SEQ ID NO: 529298 - protein, 11 aa, Influenza virus
KLKREMTFHGA

SEQ ID NO: 529299 - protein, 11 aa, Influenza virus
KLKRNEIKGVE

SEQ ID NO: 529300 - protein, 11 aa, Influenza virus
KLKRNEIKGVK

SEQ ID NO: 529301 - protein, 11 aa, Influenza virus
KLKRQEIDGIK

SEQ ID NO: 529302 - protein, 11 aa, Influenza virus
KLKRQEIEGIK

SEQ ID NO: 529303 - protein, 11 aa, Influenza virus
KLKRQEIEGIR

SEQ ID NO: 529304 - protein, 11 aa, Influenza virus
KLKRQEINGIK

SEQ ID NO: 529305 - protein, 11 aa, Influenza virus
KLKRRAIATPG

SEQ ID NO: 529306 - protein, 11 aa, Influenza virus
KLKSEDNVYKV

SEQ ID NO: 529307 - protein, 11 aa, Influenza virus
KLKTEDNIYKI

SEQ ID NO: 529308 - protein, 11 aa, Influenza virus
KLKTEDNVYKI

SEQ ID NO: 529309 - protein, 11 aa, Influenza virus
KLKTEDNVYKV

SEQ ID NO: 529310 - protein, 11 aa, Influenza virus
KLLGINMSKKK

SEQ ID NO: 529311 - protein, 11 aa, Influenza virus
KLLKERGFFGA

SEQ ID NO: 529312 - protein, 11 aa, Influenza virus
KLLKIRKGKIV

SEQ ID NO: 529313 - protein, 11 aa, Influenza virus
KLLPFAAAPPE

SEQ ID NO: 529314 - protein, 11 aa, Influenza virus
KLLPFAAAPPK

SEQ ID NO: 529315 - protein, 11 aa, Influenza virus
KLLPFAAAPPV

SEQ ID NO: 529316 - protein, 11 aa, Influenza virus
KLLPFASAPPE

SEQ ID NO: 529317 - protein, 11 aa, Influenza virus
KLLVLIENDRT

SEQ ID NO: 529318 - protein, 11 aa, Influenza virus
KLLVLLENDKT

SEQ ID NO: 529319 - protein, 11 aa, Influenza virus
KLLVLLENDRT

SEQ ID NO: 529320 - protein, 11 aa, Influenza virus
KLLVLLENGRT

SEQ ID NO: 529321 - protein, 11 aa, Influenza virus
KLNGIPPLELG

SEQ ID NO: 529322 - protein, 11 aa, Influenza virus
KLNHLIGKTNQ

SEQ ID NO: 529323 - protein, 11 aa, Influenza virus
KLNKNEIKGVK

SEQ ID NO: 529324 - protein, 11 aa, Influenza virus
KLNNVIDKMNK

SEQ ID NO: 529325 - protein, 11 aa, Influenza virus
KLNNVIDKMNN

SEQ ID NO: 529326 - protein, 11 aa, Influenza virus
KLNNVIDKMYK

SEQ ID NO: 529327 - protein, 11 aa, Influenza virus
KLNRFIEKTNQ

SEQ ID NO: 529328 - protein, 11 aa, Influenza virus
KLNRIIEKTNQ

SEQ ID NO: 529329 - protein, 11 aa, Influenza virus
KLNRLIDKTNQ

SEQ ID NO: 529330 - protein, 11 aa, Influenza virus
KLNRLIDRTNH

SEQ ID NO: 529331 - protein, 11 aa, Influenza virus
KLNRLIEKTND

SEQ ID NO: 529332 - protein, 11 aa, Influenza virus
KLNRLIEKTNE

SEQ ID NO: 529333 - protein, 11 aa, Influenza virus
KLNRLIEKTNK

SEQ ID NO: 529334 - protein, 11 aa, Influenza virus
KLNRLIEKTNQ

SEQ ID NO: 529335 - protein, 11 aa, Influenza virus
KLNRLIEKTNT

SEQ ID NO: 529336 - protein, 11 aa, Influenza virus
KLNRLIERTNE

SEQ ID NO: 529337 - protein, 11 aa, Influenza virus
KLNRLIERTNQ

SEQ ID NO: 529338 - protein, 11 aa, Influenza virus
KLNRLIGKTNQ

SEQ ID NO: 529339 - protein, 11 aa, Influenza virus
KLNRLISKTNQ

SEQ ID NO: 529340 - protein, 11 aa, Influenza virus
KLNRNEIKGVK

SEQ ID NO: 529341 - protein, 11 aa, Influenza virus
KLPFQNLSPRT

SEQ ID NO: 529342 - protein, 11 aa, Influenza virus
KLRSGFEMLKI

SEQ ID NO: 529343 - protein, 11 aa, Influenza virus
KLSGGYKDIIL

SEQ ID NO: 529344 - protein, 11 aa, Influenza virus
KLSGGYKDVIL

SEQ ID NO: 529345 - protein, 11 aa, Influenza virus
KLSIEDPDHEG

SEQ ID NO: 529346 - protein, 11 aa, Influenza virus
KLSIEDPNHEG

SEQ ID NO: 529347 - protein, 11 aa, Influenza virus
KLSIEDPSHEG

SEQ ID NO: 529348 - protein, 11 aa, Influenza virus
KLSIEEPSHEG

SEQ ID NO: 529349 - protein, 11 aa, Influenza virus
KLSIENPSHEG

SEQ ID NO: 529350 - protein, 11 aa, Influenza virus
KLSNMGIYQIL

SEQ ID NO: 529351 - protein, 11 aa, Influenza virus
KLSNMGVYQIL

SEQ ID NO: 529352 - protein, 11 aa, Influenza virus
KLSSGYKDIIL

SEQ ID NO: 529353 - protein, 11 aa, Influenza virus
KLSSGYKDVIL

SEQ ID NO: 529354 - protein, 11 aa, Influenza virus
KLSSMGIYQIL

SEQ ID NO: 529355 - protein, 11 aa, Influenza virus
KLSSMGVYQIL

SEQ ID NO: 529356 - protein, 11 aa, Influenza virus
KLTIIYSSSMM

SEQ ID NO: 529357 - protein, 11 aa, Influenza virus
KLTITYSSPMM

SEQ ID NO: 529358 - protein, 11 aa, Influenza virus
KLTITYSSSLM

SEQ ID NO: 529359 - protein, 11 aa, Influenza virus
KLTITYSSSMM

SEQ ID NO: 529360 - protein, 11 aa, Influenza virus
KLTQGRQTFDW

SEQ ID NO: 529361 - protein, 11 aa, Influenza virus
KLTQGRQTYDW

SEQ ID NO: 529362 - protein, 11 aa, Influenza virus
KLTQGYKDIIL

SEQ ID NO: 529363 - protein, 11 aa, Influenza virus
KLVDGQDCDLI

SEQ ID NO: 529364 - protein, 11 aa, Influenza virus
KLVGINMSKKK

SEQ ID NO: 529365 - protein, 11 aa, Influenza virus
KLVGINMSKRK

SEQ ID NO: 529366 - protein, 11 aa, Influenza virus
KLVLATGLRNA

SEQ ID NO: 529367 - protein, 11 aa, Influenza virus
KLVLATGLRNV

SEQ ID NO: 529368 - protein, 11 aa, Influenza virus
KLVLATGPRNV

SEQ ID NO: 529369 - protein, 11 aa, Influenza virus
KLYEKVRRQLR

SEQ ID NO: 529370 - protein, 11 aa, Influenza virus
KLYERVKKQLR

SEQ ID NO: 529371 - protein, 11 aa, Influenza virus
KLYERVKRQLR

SEQ ID NO: 529372 - protein, 11 aa, Influenza virus
KLYERVRKQLR

SEQ ID NO: 529373 - protein, 11 aa, Influenza virus
KLYERVRRQLR

SEQ ID NO: 529374 - protein, 11 aa, Influenza virus
KLYGAGNKLIT

SEQ ID NO: 529375 - protein, 11 aa, Influenza virus
KLYGTGNKLIT

SEQ ID NO: 529376 - protein, 11 aa, Influenza virus
KLYKKLKREIT

SEQ ID NO: 529377 - protein, 11 aa, Influenza virus
KLYKKLKREMT

SEQ ID NO: 529378 - protein, 11 aa, Influenza virus
KLYKNTNTLSS

SEQ ID NO: 529379 - protein, 11 aa, Influenza virus
KLYRKLKREIT

SEQ ID NO: 529380 - protein, 11 aa, Influenza virus
KLYTRVKRQLR

SEQ ID NO: 529381 - protein, 11 aa, Influenza virus
KLYVNKNPYTL

SEQ ID NO: 529382 - protein, 11 aa, Influenza virus
KLYWHLMHPGE

SEQ ID NO: 529383 - protein, 11 aa, Influenza virus
KLYWHLMRPGE

SEQ ID NO: 529384 - protein, 11 aa, Influenza virus
KLYWHLMSPGE

SEQ ID NO: 529385 - protein, 11 aa, Influenza virus
KMARLGKGYMF

SEQ ID NO: 529386 - protein, 11 aa, Influenza virus
KMARLGRGYMF

SEQ ID NO: 529387 - protein, 11 aa, Influenza virus
KMEAILVVLLY

SEQ ID NO: 529388 - protein, 11 aa, Influenza virus
KMEDGFLDVWT

SEQ ID NO: 529389 - protein, 11 aa, Influenza virus
KMEFEPFQSLI

SEQ ID NO: 529390 - protein, 11 aa, Influenza virus
KMEFEPFQSLV

SEQ ID NO: 529391 - protein, 11 aa, Influenza virus
KMEKIVLLLAI

SEQ ID NO: 529392 - protein, 11 aa, Influenza virus
KMEKIVLLLAT

SEQ ID NO: 529393 - protein, 11 aa, Influenza virus
KMESRGLFGAI

SEQ ID NO: 529394 - protein, 11 aa, Influenza virus
KMFDFIKWNVT

SEQ ID NO: 529395 - protein, 11 aa, Influenza virus
KMFDFSKWNVT

SEQ ID NO: 529396 - protein, 11 aa, Influenza virus
KMFDFTKWNVT

SEQ ID NO: 529397 - protein, 11 aa, Influenza virus
KMKAIIVVLLY

SEQ ID NO: 529398 - protein, 11 aa, Influenza virus
KMKAILVVLLY

SEQ ID NO: 529399 - protein, 11 aa, Influenza virus
KMKWGMELRRC

SEQ ID NO: 529400 - protein, 11 aa, Influenza virus
KMKWGMEMRRC

SEQ ID NO: 529401 - protein, 11 aa, Influenza virus
KMNGNYDSIRG

SEQ ID NO: 529402 - protein, 11 aa, Influenza virus
KMNIQFEAVGR

SEQ ID NO: 529403 - protein, 11 aa, Influenza virus
KMNIQILILAL

SEQ ID NO: 529404 - protein, 11 aa, Influenza virus
KMNNQILILAL

SEQ ID NO: 529405 - protein, 11 aa, Influenza virus
KMNPNKKIITI

SEQ ID NO: 529406 - protein, 11 aa, Influenza virus
KMNPNQKIIII

SEQ ID NO: 529407 - protein, 11 aa, Influenza virus
KMNPNQKIITI

SEQ ID NO: 529408 - protein, 11 aa, Influenza virus
KMNPNQKIMTI

SEQ ID NO: 529409 - protein, 11 aa, Influenza virus
KMNREFEVMNH

SEQ ID NO: 529410 - protein, 11 aa, Influenza virus
KMNREFEVVDH

SEQ ID NO: 529411 - protein, 11 aa, Influenza virus
KMNREFEVVNH

SEQ ID NO: 529412 - protein, 11 aa, Influenza virus
KMNREFGVVNH

SEQ ID NO: 529413 - protein, 11 aa, Influenza virus
KMNTKILVLAL

SEQ ID NO: 529414 - protein, 11 aa, Influenza virus
KMNTQFEAIGR

SEQ ID NO: 529415 - protein, 11 aa, Influenza virus
KMNTQFEAVGK

SEQ ID NO: 529416 - protein, 11 aa, Influenza virus
KMNTQFEAVGR

SEQ ID NO: 529417 - protein, 11 aa, Influenza virus
KMNTQFETVGK

SEQ ID NO: 529418 - protein, 11 aa, Influenza virus
KMNTQILIFAL

SEQ ID NO: 529419 - protein, 11 aa, Influenza virus
KMNTQILIFTL

SEQ ID NO: 529420 - protein, 11 aa, Influenza virus
KMNTQILILAL

SEQ ID NO: 529421 - protein, 11 aa, Influenza virus
KMNTQILVFAL

SEQ ID NO: 529422 - protein, 11 aa, Influenza virus
KMNTRILILTL

SEQ ID NO: 529423 - protein, 11 aa, Influenza virus
KMPASRYLTDM

SEQ ID NO: 529424 - protein, 11 aa, Influenza virus
KMQFSSLTVNV

SEQ ID NO: 529425 - protein, 11 aa, Influenza virus
KMSLLTEVETY

SEQ ID NO: 529426 - protein, 11 aa, Influenza virus
KMTIASDILKR

SEQ ID NO: 529427 - protein, 11 aa, Influenza virus
KMTIASDILTR

SEQ ID NO: 529428 - protein, 11 aa, Influenza virus
KMTITFLILLF

SEQ ID NO: 529429 - protein, 11 aa, Influenza virus
KMVLSAFDERR

SEQ ID NO: 529430 - protein, 11 aa, Influenza virus
KMYALHQGTTI

SEQ ID NO: 529431 - protein, 11 aa, Influenza virus
KNADLEALMEW

SEQ ID NO: 529432 - protein, 11 aa, Influenza virus
KNALGDCPKYI

SEQ ID NO: 529433 - protein, 11 aa, Influenza virus
KNALGECPKYI

SEQ ID NO: 529434 - protein, 11 aa, Influenza virus
KNALYGTQSLS

SEQ ID NO: 529435 - protein, 11 aa, Influenza virus
KNANTLSSVNT

SEQ ID NO: 529436 - protein, 11 aa, Influenza virus
KNANTLSSVTT

SEQ ID NO: 529437 - protein, 11 aa, Influenza virus
KNANTLTSVTT

SEQ ID NO: 529438 - protein, 11 aa, Influenza virus
KNATATVYYDR

SEQ ID NO: 529439 - protein, 11 aa, Influenza virus
KNCINRCFYVE

SEQ ID NO: 529440 - protein, 11 aa, Influenza virus
KNCTLIDALLG

SEQ ID NO: 529441 - protein, 11 aa, Influenza virus
KNDLYGAQSLS

SEQ ID NO: 529442 - protein, 11 aa, Influenza virus
KNDLYGTQPLS

SEQ ID NO: 529443 - protein, 11 aa, Influenza virus
KNDLYGTQSLS

SEQ ID NO: 529444 - protein, 11 aa, Influenza virus
KNELYGTQSLS

SEQ ID NO: 529445 - protein, 11 aa, Influenza virus
KNGNHAVHYCI

SEQ ID NO: 529446 - protein, 11 aa, Influenza virus
KNGNLRCTICI

SEQ ID NO: 529447 - protein, 11 aa, Influenza virus
KNGNMQCTICI

SEQ ID NO: 529448 - protein, 11 aa, Influenza virus
KNGNMRCTICI

SEQ ID NO: 529449 - protein, 11 aa, Influenza virus
KNGNMRGTNWI

SEQ ID NO: 529450 - protein, 11 aa, Influenza virus
KNGTYDHKDYE

SEQ ID NO: 529451 - protein, 11 aa, Influenza virus
KNGTYDHKEYE

SEQ ID NO: 529452 - protein, 11 aa, Influenza virus
KNGTYDYPKYE

SEQ ID NO: 529453 - protein, 11 aa, Influenza virus
KNGTYDYPKYS

SEQ ID NO: 529454 - protein, 11 aa, Influenza virus
KNGTYDYSKYE

SEQ ID NO: 529455 - protein, 11 aa, Influenza virus
KNGTYNHKDYE

SEQ ID NO: 529456 - protein, 11 aa, Influenza virus
KNGTYNHKEYE

SEQ ID NO: 529457 - protein, 11 aa, Influenza virus
KNGTYNRKEYE

SEQ ID NO: 529458 - protein, 11 aa, Influenza virus
KNGTYNYPKYS

SEQ ID NO: 529459 - protein, 11 aa, Influenza virus
KNGTYYYPKYE

SEQ ID NO: 529460 - protein, 11 aa, Influenza virus
KNILRTQESEC

SEQ ID NO: 529461 - protein, 11 aa, Influenza virus
KNITVTHAQDI

SEQ ID NO: 529462 - protein, 11 aa, Influenza virus
KNITVTHSVEL

SEQ ID NO: 529463 - protein, 11 aa, Influenza virus
KNITVTHSVNL

SEQ ID NO: 529464 - protein, 11 aa, Influenza virus
KNLFDEVKRRL

SEQ ID NO: 529465 - protein, 11 aa, Influenza virus
KNLFDEVRRRL

SEQ ID NO: 529466 - protein, 11 aa, Influenza virus
KNLYDKVRLQL

SEQ ID NO: 529467 - protein, 11 aa, Influenza virus
KNLYDKVRMQL

SEQ ID NO: 529468 - protein, 11 aa, Influenza virus
KNLYDRVRLQL

SEQ ID NO: 529469 - protein, 11 aa, Influenza virus
KNLYEKVRLQL

SEQ ID NO: 529470 - protein, 11 aa, Influenza virus
KNLYEKVRMQL

SEQ ID NO: 529471 - protein, 11 aa, Influenza virus
KNLYNKVRMQL

SEQ ID NO: 529472 - protein, 11 aa, Influenza virus
KNNAIDEGDGC

SEQ ID NO: 529473 - protein, 11 aa, Influenza virus
KNNAKDEGNGC

SEQ ID NO: 529474 - protein, 11 aa, Influenza virus
KNNMINNDLGP

SEQ ID NO: 529475 - protein, 11 aa, Influenza virus
KNNQVILCEPT

SEQ ID NO: 529476 - protein, 11 aa, Influenza virus
KNNQVILCEQT

SEQ ID NO: 529477 - protein, 11 aa, Influenza virus
KNNQVILCGPT

SEQ ID NO: 529478 - protein, 11 aa, Influenza virus
KNNWSGYSGIF

SEQ ID NO: 529479 - protein, 11 aa, Influenza virus
KNPALRMKWMM

SEQ ID NO: 529480 - protein, 11 aa, Influenza virus
KNPAYCNTDLG

SEQ ID NO: 529481 - protein, 11 aa, Influenza virus
KNPSLRMKWMM

SEQ ID NO: 529482 - protein, 11 aa, Influenza virus
KNPYTLVSTKE

SEQ ID NO: 529483 - protein, 11 aa, Influenza virus
KNQEELRSLFS

SEQ ID NO: 529484 - protein, 11 aa, Influenza virus
KNRSPYRALMS

SEQ ID NO: 529485 - protein, 11 aa, Influenza virus
KNSDLEALMEW

SEQ ID NO: 529486 - protein, 11 aa, Influenza virus
KNSFYAELKWL

SEQ ID NO: 529487 - protein, 11 aa, Influenza virus
KNSNGVQDIID

SEQ ID NO: 529488 - protein, 11 aa, Influenza virus
KNSRSGYETFR

SEQ ID NO: 529489 - protein, 11 aa, Influenza virus
KNSWSYIVEKP

SEQ ID NO: 529490 - protein, 11 aa, Influenza virus
KNTDLEALMEW

SEQ ID NO: 529491 - protein, 11 aa, Influenza virus
KNTDLEVLMEW

SEQ ID NO: 529492 - protein, 11 aa, Influenza virus
KNTNTLSSVTT

SEQ ID NO: 529493 - protein, 11 aa, Influenza virus
KNTYVNNTTII

SEQ ID NO: 529494 - protein, 11 aa, Influenza virus
KNVAVTHSVNL

SEQ ID NO: 529495 - protein, 11 aa, Influenza virus
KNVILWFSFGA

SEQ ID NO: 529496 - protein, 11 aa, Influenza virus
KNVPEKIHTRG

SEQ ID NO: 529497 - protein, 11 aa, Influenza virus
KNVPEKIRTRG

SEQ ID NO: 529498 - protein, 11 aa, Influenza virus
KNVPEKIRVKR

SEQ ID NO: 529499 - protein, 11 aa, Influenza virus
KNVTVTHAKDI

SEQ ID NO: 529500 - protein, 11 aa, Influenza virus
KNVTVTHAQDI

SEQ ID NO: 529501 - protein, 11 aa, Influenza virus
KNVTVTHAQNI

SEQ ID NO: 529502 - protein, 11 aa, Influenza virus
KNVTVTHSIEL

SEQ ID NO: 529503 - protein, 11 aa, Influenza virus
KNVTVTHSINL

SEQ ID NO: 529504 - protein, 11 aa, Influenza virus
KNVTVTHSVDL

SEQ ID NO: 529505 - protein, 11 aa, Influenza virus
KNVTVTHSVEL

SEQ ID NO: 529506 - protein, 11 aa, Influenza virus
KNVTVTHSVNI

SEQ ID NO: 529507 - protein, 11 aa, Influenza virus
KNVTVTHSVNL

SEQ ID NO: 529508 - protein, 11 aa, Influenza virus
KNWILWISFAI

SEQ ID NO: 529509 - protein, 11 aa, Influenza virus
KNWSGYSGAFT

SEQ ID NO: 529510 - protein, 11 aa, Influenza virus
KNWSGYSGSFI

SEQ ID NO: 529511 - protein, 11 aa, Influenza virus
KNWSGYSGSFT

SEQ ID NO: 529512 - protein, 11 aa, Influenza virus
KPCFWVELIRG

SEQ ID NO: 529513 - protein, 11 aa, Influenza virus
KPFQNICKPYI

SEQ ID NO: 529514 - protein, 11 aa, Influenza virus
KPFQNTSKHYI

SEQ ID NO: 529515 - protein, 11 aa, Influenza virus
KPFQNTSRHYI

SEQ ID NO: 529516 - protein, 11 aa, Influenza virus
KPFQNVNKITY

SEQ ID NO: 529517 - protein, 11 aa, Influenza virus
KPFQNVNKVTY

SEQ ID NO: 529518 - protein, 11 aa, Influenza virus
KPFQNVNRITY

SEQ ID NO: 529519 - protein, 11 aa, Influenza virus
KPFQNVSRIAI

SEQ ID NO: 529520 - protein, 11 aa, Influenza virus
KPGETLKVESN

SEQ ID NO: 529521 - protein, 11 aa, Influenza virus
KPGETLNIESN

SEQ ID NO: 529522 - protein, 11 aa, Influenza virus
KPGETLNVESN

SEQ ID NO: 529523 - protein, 11 aa, Influenza virus
KPGQTVKIKTN

SEQ ID NO: 529524 - protein, 11 aa, Influenza virus
KPGQTVKIQTN

SEQ ID NO: 529525 - protein, 11 aa, Influenza virus
KPGQTVKIQTS

SEQ ID NO: 529526 - protein, 11 aa, Influenza virus
KPKFLPDLYDY

SEQ ID NO: 529527 - protein, 11 aa, Influenza virus
KPKSLPDLYDY

SEQ ID NO: 529528 - protein, 11 aa, Influenza virus
KPKYLPDLYDY

SEQ ID NO: 529529 - protein, 11 aa, Influenza virus
KPLCAVNSWHI

SEQ ID NO: 529530 - protein, 11 aa, Influenza virus
KPLCEVNSWHI

SEQ ID NO: 529531 - protein, 11 aa, Influenza virus
KPLCEVSSWHI

SEQ ID NO: 529532 - protein, 11 aa, Influenza virus
KPLILKDCSVA

SEQ ID NO: 529533 - protein, 11 aa, Influenza virus
KPLILRDCSVA

SEQ ID NO: 529534 - protein, 11 aa, Influenza virus
KPLQNTSKHYI

SEQ ID NO: 529535 - protein, 11 aa, Influenza virus
KPNIGPRPFVR

SEQ ID NO: 529536 - protein, 11 aa, Influenza virus
KPNIGPRPLVM

SEQ ID NO: 529537 - protein, 11 aa, Influenza virus
KPNIGPRPLVR

SEQ ID NO: 529538 - protein, 11 aa, Influenza virus
KPQCEITGFAP

SEQ ID NO: 529539 - protein, 11 aa, Influenza virus
KPQCHITGFAP

SEQ ID NO: 529540 - protein, 11 aa, Influenza virus
KPQCKITGFAP

SEQ ID NO: 529541 - protein, 11 aa, Influenza virus
KPQCQIAGFAP

SEQ ID NO: 529542 - protein, 11 aa, Influenza virus
KPQCQITGFAP

SEQ ID NO: 529543 - protein, 11 aa, Influenza virus
KPQCQVTGFAP

SEQ ID NO: 529544 - protein, 11 aa, Influenza virus
KPRFLPDLYDY

SEQ ID NO: 529545 - protein, 11 aa, Influenza virus
KPRGLFGAIAG

SEQ ID NO: 529546 - protein, 11 aa, Influenza virus
KPRPRRGLFGA

SEQ ID NO: 529547 - protein, 11 aa, Influenza virus
KPRYLPDLYDY

SEQ ID NO: 529548 - protein, 11 aa, Influenza virus
KPWARNILRTQ

SEQ ID NO: 529549 - protein, 11 aa, Influenza virus
KPYIGKCPKYI

SEQ ID NO: 529550 - protein, 11 aa, Influenza virus
KQAKGLFGAIA

SEQ ID NO: 529551 - protein, 11 aa, Influenza virus
KQDGKSSACKR

SEQ ID NO: 529552 - protein, 11 aa, Influenza virus
KQEFKMNPNKK

SEQ ID NO: 529553 - protein, 11 aa, Influenza virus
KQEFKMNPNQK

SEQ ID NO: 529554 - protein, 11 aa, Influenza virus
KQEIEGIKLKT

SEQ ID NO: 529555 - protein, 11 aa, Influenza virus
KQEIKMNPNQK

SEQ ID NO: 529556 - protein, 11 aa, Influenza virus
KQESLLLATGM

SEQ ID NO: 529557 - protein, 11 aa, Influenza virus
KQESLMLATGM

SEQ ID NO: 529558 - protein, 11 aa, Influenza virus
KQFELIDNEFT

SEQ ID NO: 529559 - protein, 11 aa, Influenza virus
KQGKTKATKME

SEQ ID NO: 529560 - protein, 11 aa, Influenza virus
KQGKTKATKMK

SEQ ID NO: 529561 - protein, 11 aa, Influenza virus
KQGNSVWAGRT

SEQ ID NO: 529562 - protein, 11 aa, Influenza virus
KQGSLKLATGM

SEQ ID NO: 529563 - protein, 11 aa, Influenza virus
KQGSLMLATGM

SEQ ID NO: 529564 - protein, 11 aa, Influenza virus
KQGSLRLATGM

SEQ ID NO: 529565 - protein, 11 aa, Influenza virus
KQIGNVINWTR

SEQ ID NO: 529566 - protein, 11 aa, Influenza virus
KQILRTQESSC

SEQ ID NO: 529567 - protein, 11 aa, Influenza virus
KQKSLLLATGM

SEQ ID NO: 529568 - protein, 11 aa, Influenza virus
KQKTLKLATGM

SEQ ID NO: 529569 - protein, 11 aa, Influenza virus
KQLGNVINWTR

SEQ ID NO: 529570 - protein, 11 aa, Influenza virus
KQLRENAEDLG

SEQ ID NO: 529571 - protein, 11 aa, Influenza virus
KQLRENAEDMG

SEQ ID NO: 529572 - protein, 11 aa, Influenza virus
KQLRENAEEDG

SEQ ID NO: 529573 - protein, 11 aa, Influenza virus
KQLRENAEEMG

SEQ ID NO: 529574 - protein, 11 aa, Influenza virus
KQLRQNAEEDG

SEQ ID NO: 529575 - protein, 11 aa, Influenza virus
KQLTHHMRKKR

SEQ ID NO: 529576 - protein, 11 aa, Influenza virus
KQMTRGLFGAI

SEQ ID NO: 529577 - protein, 11 aa, Influenza virus
KQNGKSGACKR

SEQ ID NO: 529578 - protein, 11 aa, Influenza virus
KQNGKSSACKR

SEQ ID NO: 529579 - protein, 11 aa, Influenza virus
KQNTLKLATGM

SEQ ID NO: 529580 - protein, 11 aa, Influenza virus
KQPISLGDCSF

SEQ ID NO: 529581 - protein, 11 aa, Influenza virus
KQSSLPLALGM

SEQ ID NO: 529582 - protein, 11 aa, Influenza virus
KQSTLKLATGM

SEQ ID NO: 529583 - protein, 11 aa, Influenza virus
KQTKTMTITFL

SEQ ID NO: 529584 - protein, 11 aa, Influenza virus
KQTRGIFGAIA

SEQ ID NO: 529585 - protein, 11 aa, Influenza virus
KQTRGLFGAIA

SEQ ID NO: 529586 - protein, 11 aa, Influenza virus
KQTSLLLATGM

SEQ ID NO: 529587 - protein, 11 aa, Influenza virus
KQVCAAWSSSS

SEQ ID NO: 529588 - protein, 11 aa, Influenza virus
KQVCIAWSSSS

SEQ ID NO: 529589 - protein, 11 aa, Influenza virus
KQVCMAWSSSS

SEQ ID NO: 529590 - protein, 11 aa, Influenza virus
KQVCVAWSSSS

SEQ ID NO: 529591 - protein, 11 aa, Influenza virus
KRCINRCFYVE

SEQ ID NO: 529592 - protein, 11 aa, Influenza virus
KRDSSILTDSQ

SEQ ID NO: 529593 - protein, 11 aa, Influenza virus
KREITFHGAKE

SEQ ID NO: 529594 - protein, 11 aa, Influenza virus
KREITFYGAKE

SEQ ID NO: 529595 - protein, 11 aa, Influenza virus
KREMTFHGAKE

SEQ ID NO: 529596 - protein, 11 aa, Influenza virus
KRFADQELGDA

SEQ ID NO: 529597 - protein, 11 aa, Influenza virus
KRGETLKIRTN

SEQ ID NO: 529598 - protein, 11 aa, Influenza virus
KRGGSGIMKTE

SEQ ID NO: 529599 - protein, 11 aa, Influenza virus
KRGINDRNFWR

SEQ ID NO: 529600 - protein, 11 aa, Influenza virus
KRGLFGAIAGF

SEQ ID NO: 529601 - protein, 11 aa, Influenza virus
KRGSSGIMKTE

SEQ ID NO: 529602 - protein, 11 aa, Influenza virus
KRGSSGIMKTG

SEQ ID NO: 529603 - protein, 11 aa, Influenza virus
KRGSSGVMKTE

SEQ ID NO: 529604 - protein, 11 aa, Influenza virus
KRGVNDRNFWR

SEQ ID NO: 529605 - protein, 11 aa, Influenza virus
KRIENLNKKME

SEQ ID NO: 529606 - protein, 11 aa, Influenza virus
KRIGSCTSPCL

SEQ ID NO: 529607 - protein, 11 aa, Influenza virus
KRINMIADRVD

SEQ ID NO: 529608 - protein, 11 aa, Influenza virus
KRINMLADRID

SEQ ID NO: 529609 - protein, 11 aa, Influenza virus
KRINMLADRVD

SEQ ID NO: 529610 - protein, 11 aa, Influenza virus
KRINMLADWVD

SEQ ID NO: 529611 - protein, 11 aa, Influenza virus
KRIRLFDYSGW

SEQ ID NO: 529612 - protein, 11 aa, Influenza virus
KRIRLFDYSKW

SEQ ID NO: 529613 - protein, 11 aa, Influenza virus
KRIRLFDYSRW

SEQ ID NO: 529614 - protein, 11 aa, Influenza virus
KRIRMAINWGR

SEQ ID NO: 529615 - protein, 11 aa, Influenza virus
KRIRMATNECR

SEQ ID NO: 529616 - protein, 11 aa, Influenza virus
KRKKRGLFGAI

SEQ ID NO: 529617 - protein, 11 aa, Influenza virus
KRKRDSSILTD

SEQ ID NO: 529618 - protein, 11 aa, Influenza virus
KRKRGLFGAIA

SEQ ID NO: 529619 - protein, 11 aa, Influenza virus
KRKRKTRGLFG

SEQ ID NO: 529620 - protein, 11 aa, Influenza virus
KRKRNSSILTD

SEQ ID NO: 529621 - protein, 11 aa, Influenza virus
KRKTRGLFGAI

SEQ ID NO: 529622 - protein, 11 aa, Influenza virus
KRLAVLGKDAG

SEQ ID NO: 529623 - protein, 11 aa, Influenza virus
KRLCTINSWHI

SEQ ID NO: 529624 - protein, 11 aa, Influenza virus
KRLGSWSWHDG

SEQ ID NO: 529625 - protein, 11 aa, Influenza virus
KRLLRENAEED

SEQ ID NO: 529626 - protein, 11 aa, Influenza virus
KRLTIIGKDAG

SEQ ID NO: 529627 - protein, 11 aa, Influenza virus
KRLTILGKDAG

SEQ ID NO: 529628 - protein, 11 aa, Influenza virus
KRLTTTIKTWA

SEQ ID NO: 529629 - protein, 11 aa, Influenza virus
KRLTVLGKDAG

SEQ ID NO: 529630 - protein, 11 aa, Influenza virus
KRMTRGLFGAI

SEQ ID NO: 529631 - protein, 11 aa, Influenza virus
KRNEIKGVELS

SEQ ID NO: 529632 - protein, 11 aa, Influenza virus
KRNEIKGVKLS

SEQ ID NO: 529633 - protein, 11 aa, Influenza virus
KRNITEIVYLN

SEQ ID NO: 529634 - protein, 11 aa, Influenza virus
KRNRSILNTSQ

SEQ ID NO: 529635 - protein, 11 aa, Influenza virus
KRNSSILTDSQ

SEQ ID NO: 529636 - protein, 11 aa, Influenza virus
KRQEIDGIKLK

SEQ ID NO: 529637 - protein, 11 aa, Influenza virus
KRQEIEGIKLE

SEQ ID NO: 529638 - protein, 11 aa, Influenza virus
KRQEIEGIKLK

SEQ ID NO: 529639 - protein, 11 aa, Influenza virus
KRQEIEGIRLK

SEQ ID NO: 529640 - protein, 11 aa, Influenza virus
KRQEINGIKLK

SEQ ID NO: 529641 - protein, 11 aa, Influenza virus
KRQLRENAEDK

SEQ ID NO: 529642 - protein, 11 aa, Influenza virus
KRQLRENAEED

SEQ ID NO: 529643 - protein, 11 aa, Influenza virus
KRQLRENAEKD

SEQ ID NO: 529644 - protein, 11 aa, Influenza virus
KRRAIATPGMQ

SEQ ID NO: 529645 - protein, 11 aa, Influenza virus
KRRKKRGLFGA

SEQ ID NO: 529646 - protein, 11 aa, Influenza virus
KRRPVAKAGFI

SEQ ID NO: 529647 - protein, 11 aa, Influenza virus
KRSHEQMETGG

SEQ ID NO: 529648 - protein, 11 aa, Influenza virus
KRSYEQMETDG

SEQ ID NO: 529649 - protein, 11 aa, Influenza virus
KRSYEQMETGE

SEQ ID NO: 529650 - protein, 11 aa, Influenza virus
KRSYEQMETGG

SEQ ID NO: 529651 - protein, 11 aa, Influenza virus
KRSYEQMETSG

SEQ ID NO: 529652 - protein, 11 aa, Influenza virus
KRSYNNTSGEQ

SEQ ID NO: 529653 - protein, 11 aa, Influenza virus
KRTVSSFYSEM

SEQ ID NO: 529654 - protein, 11 aa, Influenza virus
KRVRLFDYSRW

SEQ ID NO: 529655 - protein, 11 aa, Influenza virus
KRYELEIGARI

SEQ ID NO: 529656 - protein, 11 aa, Influenza virus
KRYELEIGTRI

SEQ ID NO: 529657 - protein, 11 aa, Influenza virus
KRYERVKMFDF

SEQ ID NO: 529658 - protein, 11 aa, Influenza virus
KRYGPALSINE

SEQ ID NO: 529659 - protein, 11 aa, Influenza virus
KRYGPALSISE

SEQ ID NO: 529660 - protein, 11 aa, Influenza virus
KSCINRCFYVE

SEQ ID NO: 529661 - protein, 11 aa, Influenza virus
KSCLPACAYGP

SEQ ID NO: 529662 - protein, 11 aa, Influenza virus
KSCLPACIYGL

SEQ ID NO: 529663 - protein, 11 aa, Influenza virus
KSCLPACVYGL

SEQ ID NO: 529664 - protein, 11 aa, Influenza virus
KSCLPACVYGP

SEQ ID NO: 529665 - protein, 11 aa, Influenza virus
KSCVNRCFYVE

SEQ ID NO: 529666 - protein, 11 aa, Influenza virus
KSDKICIGYHA

SEQ ID NO: 529667 - protein, 11 aa, Influenza virus
KSDKICLGHHA

SEQ ID NO: 529668 - protein, 11 aa, Influenza virus
KSDKRIGSCTS

SEQ ID NO: 529669 - protein, 11 aa, Influenza virus
KSDQLKLATGL

SEQ ID NO: 529670 - protein, 11 aa, Influenza virus
KSDRICIGYHA

SEQ ID NO: 529671 - protein, 11 aa, Influenza virus
KSDVLVTREPY

SEQ ID NO: 529672 - protein, 11 aa, Influenza virus
KSEDNVYKVLS

SEQ ID NO: 529673 - protein, 11 aa, Influenza virus
KSEQFPVQTDE

SEQ ID NO: 529674 - protein, 11 aa, Influenza virus
KSFSRTELIAP

SEQ ID NO: 529675 - protein, 11 aa, Influenza virus
KSFSRTQLIAP

SEQ ID NO: 529676 - protein, 11 aa, Influenza virus
KSGQFPVQTDE

SEQ ID NO: 529677 - protein, 11 aa, Influenza virus
KSGQLKLATGL

SEQ ID NO: 529678 - protein, 11 aa, Influenza virus
KSHGRILKNDL

SEQ ID NO: 529679 - protein, 11 aa, Influenza virus
KSHGRILKNNL

SEQ ID NO: 529680 - protein, 11 aa, Influenza virus
KSHGRVLKNNL

SEQ ID NO: 529681 - protein, 11 aa, Influenza virus
KSILLATGMRN

SEQ ID NO: 529682 - protein, 11 aa, Influenza virus
KSITQTLVSND

SEQ ID NO: 529683 - protein, 11 aa, Influenza virus
KSITQTLVSNN

SEQ ID NO: 529684 - protein, 11 aa, Influenza virus
KSITQTLVSNS

SEQ ID NO: 529685 - protein, 11 aa, Influenza virus
KSKLFTLSGVA

SEQ ID NO: 529686 - protein, 11 aa, Influenza virus
KSLCEVNSWHI

SEQ ID NO: 529687 - protein, 11 aa, Influenza virus
KSLCKIEGWVV

SEQ ID NO: 529688 - protein, 11 aa, Influenza virus
KSLCKVEEWVV

SEQ ID NO: 529689 - protein, 11 aa, Influenza virus
KSLCKVEGWVV

SEQ ID NO: 529690 - protein, 11 aa, Influenza virus
KSLCNVEGWVV

SEQ ID NO: 529691 - protein, 11 aa, Influenza virus
KSLCSVEGWVV

SEQ ID NO: 529692 - protein, 11 aa, Influenza virus
KSLESRRGFEM

SEQ ID NO: 529693 - protein, 11 aa, Influenza virus
KSLESRSGFEM

SEQ ID NO: 529694 - protein, 11 aa, Influenza virus
KSLFSSIKKYE

SEQ ID NO: 529695 - protein, 11 aa, Influenza virus
KSLGIQSDAQI

SEQ ID NO: 529696 - protein, 11 aa, Influenza virus
KSLIWLWLVLR

SEQ ID NO: 529697 - protein, 11 aa, Influenza virus
KSLKLAIGPRN

SEQ ID NO: 529698 - protein, 11 aa, Influenza virus
KSLKLASGLRN

SEQ ID NO: 529699 - protein, 11 aa, Influenza virus
KSLKLATGLRN

SEQ ID NO: 529700 - protein, 11 aa, Influenza virus
KSLKLATGPRN

SEQ ID NO: 529701 - protein, 11 aa, Influenza virus
KSLLLATGMRN

SEQ ID NO: 529702 - protein, 11 aa, Influenza virus
KSLMLATGMRN

SEQ ID NO: 529703 - protein, 11 aa, Influenza virus
KSLRGRGSTLG

SEQ ID NO: 529704 - protein, 11 aa, Influenza virus
KSLTQTLVSNN

SEQ ID NO: 529705 - protein, 11 aa, Influenza virus
KSLYDKVRMQL

SEQ ID NO: 529706 - protein, 11 aa, Influenza virus
KSNAIDEGDGC

SEQ ID NO: 529707 - protein, 11 aa, Influenza virus
KSQLIWMACHS

SEQ ID NO: 529708 - protein, 11 aa, Influenza virus
KSQLVWMACHS

SEQ ID NO: 529709 - protein, 11 aa, Influenza virus
KSQLVWMACNS

SEQ ID NO: 529710 - protein, 11 aa, Influenza virus
KSRGYKMNIQI

SEQ ID NO: 529711 - protein, 11 aa, Influenza virus
KSRGYKMNNQI

SEQ ID NO: 529712 - protein, 11 aa, Influenza virus
KSRGYKMNTKI

SEQ ID NO: 529713 - protein, 11 aa, Influenza virus
KSRGYKMNTQI

SEQ ID NO: 529714 - protein, 11 aa, Influenza virus
KSRGYKMNTRI

SEQ ID NO: 529715 - protein, 11 aa, Influenza virus
KSRINGVKLEE

SEQ ID NO: 529716 - protein, 11 aa, Influenza virus
KSRSIIFNMER

SEQ ID NO: 529717 - protein, 11 aa, Influenza virus
KSRSNIFNMER

SEQ ID NO: 529718 - protein, 11 aa, Influenza virus
KSRTKEGRRKT

SEQ ID NO: 529719 - protein, 11 aa, Influenza virus
KSRVDNHSMSD

SEQ ID NO: 529720 - protein, 11 aa, Influenza virus
KSTKSTVLKSD

SEQ ID NO: 529721 - protein, 11 aa, Influenza virus
KSTPSAIDQIT

SEQ ID NO: 529722 - protein, 11 aa, Influenza virus
KSTQAAIDQIN

SEQ ID NO: 529723 - protein, 11 aa, Influenza virus
KSTQAAIDQIT

SEQ ID NO: 529724 - protein, 11 aa, Influenza virus
KSTQAAVDQIT

SEQ ID NO: 529725 - protein, 11 aa, Influenza virus
KSTQATIDQIT

SEQ ID NO: 529726 - protein, 11 aa, Influenza virus
KSTQEAIDKIT

SEQ ID NO: 529727 - protein, 11 aa, Influenza virus
KSTQEAIEKIT

SEQ ID NO: 529728 - protein, 11 aa, Influenza virus
KSTQEAIGKIT

SEQ ID NO: 529729 - protein, 11 aa, Influenza virus
KSTQEAINKIT

SEQ ID NO: 529730 - protein, 11 aa, Influenza virus
KSTQKTIDQVT

SEQ ID NO: 529731 - protein, 11 aa, Influenza virus
KSTQSAIDQIT

SEQ ID NO: 529732 - protein, 11 aa, Influenza virus
KSTQSAIDQVT

SEQ ID NO: 529733 - protein, 11 aa, Influenza virus
KSTQSAINQIT

SEQ ID NO: 529734 - protein, 11 aa, Influenza virus
KSTQSAVDQIT

SEQ ID NO: 529735 - protein, 11 aa, Influenza virus
KSTQSAVNQIT

SEQ ID NO: 529736 - protein, 11 aa, Influenza virus
KSTVLKSDKRI

SEQ ID NO: 529737 - protein, 11 aa, Influenza virus
KSVTQTLVSNN

SEQ ID NO: 529738 - protein, 11 aa, Influenza virus
KSWKGNIMRTQ

SEQ ID NO: 529739 - protein, 11 aa, Influenza virus
KSWRKDILRTQ

SEQ ID NO: 529740 - protein, 11 aa, Influenza virus
KSWRRDILRTQ

SEQ ID NO: 529741 - protein, 11 aa, Influenza virus
KSYFANLKGTR

SEQ ID NO: 529742 - protein, 11 aa, Influenza virus
KSYINKTGTFE

SEQ ID NO: 529743 - protein, 11 aa, Influenza virus
KSYINRTGTFE

SEQ ID NO: 529744 - protein, 11 aa, Influenza virus
KTAYELTDSSW

SEQ ID NO: 529745 - protein, 11 aa, Influenza virus
KTDGATSACKR

SEQ ID NO: 529746 - protein, 11 aa, Influenza virus
KTEDNIYKILS

SEQ ID NO: 529747 - protein, 11 aa, Influenza virus
KTEDNVYKILS

SEQ ID NO: 529748 - protein, 11 aa, Influenza virus
KTEDNVYKVLA

SEQ ID NO: 529749 - protein, 11 aa, Influenza virus
KTEDNVYKVLS

SEQ ID NO: 529750 - protein, 11 aa, Influenza virus
KTFFLTQGALL

SEQ ID NO: 529751 - protein, 11 aa, Influenza virus
KTFFLTQGSLL

SEQ ID NO: 529752 - protein, 11 aa, Influenza virus
KTFQNIDKNAL

SEQ ID NO: 529753 - protein, 11 aa, Influenza virus
KTFQNIDRNAI

SEQ ID NO: 529754 - protein, 11 aa, Influenza virus
KTFQNIEKNAL

SEQ ID NO: 529755 - protein, 11 aa, Influenza virus
KTFQNIERNAL

SEQ ID NO: 529756 - protein, 11 aa, Influenza virus
KTGTFEFTSFF

SEQ ID NO: 529757 - protein, 11 aa, Influenza virus
KTHNGKLCKLN

SEQ ID NO: 529758 - protein, 11 aa, Influenza virus
KTHNGKLCRLR

SEQ ID NO: 529759 - protein, 11 aa, Influenza virus
KTHNGKLCRLS

SEQ ID NO: 529760 - protein, 11 aa, Influenza virus
KTHNGRLCKLN

SEQ ID NO: 529761 - protein, 11 aa, Influenza virus
KTIDQVTGKLN

SEQ ID NO: 529762 - protein, 11 aa, Influenza virus
KTIWTSGSSIA

SEQ ID NO: 529763 - protein, 11 aa, Influenza virus
KTKATKMEAIL

SEQ ID NO: 529764 - protein, 11 aa, Influenza virus
KTKATKMKAII

SEQ ID NO: 529765 - protein, 11 aa, Influenza virus
KTKATKMKAIL

SEQ ID NO: 529766 - protein, 11 aa, Influenza virus
KTKKMTITFLI

SEQ ID NO: 529767 - protein, 11 aa, Influenza virus
KTKLPFQNLSP

SEQ ID NO: 529768 - protein, 11 aa, Influenza virus
KTLDEHDANVR

SEQ ID NO: 529769 - protein, 11 aa, Influenza virus
KTLDEHDSNVE

SEQ ID NO: 529770 - protein, 11 aa, Influenza virus
KTLDEHDSNVK

SEQ ID NO: 529771 - protein, 11 aa, Influenza virus
KTLDKHDSNVK

SEQ ID NO: 529772 - protein, 11 aa, Influenza virus
KTLDLHDANVR

SEQ ID NO: 529773 - protein, 11 aa, Influenza virus
KTLDLHDSNVR

SEQ ID NO: 529774 - protein, 11 aa, Influenza virus
KTLDLHDSNVT

SEQ ID NO: 529775 - protein, 11 aa, Influenza virus
KTLDMHDANVK

SEQ ID NO: 529776 - protein, 11 aa, Influenza virus
KTLDMHDANVR

SEQ ID NO: 529777 - protein, 11 aa, Influenza virus
KTLKLATGMRN

SEQ ID NO: 529778 - protein, 11 aa, Influenza virus
KTLNMHDANVR

SEQ ID NO: 529779 - protein, 11 aa, Influenza virus
KTLTDNHVEVV

SEQ ID NO: 529780 - protein, 11 aa, Influenza virus
KTMTITFLILL

SEQ ID NO: 529781 - protein, 11 aa, Influenza virus
KTNDKYHQIEK

SEQ ID NO: 529782 - protein, 11 aa, Influenza virus
KTNEKFHQIEK

SEQ ID NO: 529783 - protein, 11 aa, Influenza virus
KTNEKYHQIEK

SEQ ID NO: 529784 - protein, 11 aa, Influenza virus
KTNGNLIAPEY

SEQ ID NO: 529785 - protein, 11 aa, Influenza virus
KTNKQFELIDN

SEQ ID NO: 529786 - protein, 11 aa, Influenza virus
KTNLYGFIIKG

SEQ ID NO: 529787 - protein, 11 aa, Influenza virus
KTNLYGFIVKG

SEQ ID NO: 529788 - protein, 11 aa, Influenza virus
KTNQQFELIDN

SEQ ID NO: 529789 - protein, 11 aa, Influenza virus
KTNQQFEMIDN

SEQ ID NO: 529790 - protein, 11 aa, Influenza virus
KTNQQFKLIDN

SEQ ID NO: 529791 - protein, 11 aa, Influenza virus
KTNTEFESIES

SEQ ID NO: 529792 - protein, 11 aa, Influenza virus
KTNTQFELIDN

SEQ ID NO: 529793 - protein, 11 aa, Influenza virus
KTPYRSLIRFP

SEQ ID NO: 529794 - protein, 11 aa, Influenza virus
KTQCQITGFAP

SEQ ID NO: 529795 - protein, 11 aa, Influenza virus
KTRFLPVAGGT

SEQ ID NO: 529796 - protein, 11 aa, Influenza virus
KTRFLPVSGGT

SEQ ID NO: 529797 - protein, 11 aa, Influenza virus
KTRFLPVTGGT

SEQ ID NO: 529798 - protein, 11 aa, Influenza virus
KTRFLPVVGGT

SEQ ID NO: 529799 - protein, 11 aa, Influenza virus
KTRGLFGAIAG

SEQ ID NO: 529800 - protein, 11 aa, Influenza virus
KTRLFTIRQEL

SEQ ID NO: 529801 - protein, 11 aa, Influenza virus
KTRLFTIRQEM

SEQ ID NO: 529802 - protein, 11 aa, Influenza virus
KTRPILSPLTK

SEQ ID NO: 529803 - protein, 11 aa, Influenza virus
KTSTQKAINEI

SEQ ID NO: 529804 - protein, 11 aa, Influenza virus
KTSWSYIVEKL

SEQ ID NO: 529805 - protein, 11 aa, Influenza virus
KTSWSYIVEKP

SEQ ID NO: 529806 - protein, 11 aa, Influenza virus
KTSWSYIVEKS

SEQ ID NO: 529807 - protein, 11 aa, Influenza virus
KTSWSYIVERP

SEQ ID NO: 529808 - protein, 11 aa, Influenza virus
KTTVDHMAIIK

SEQ ID NO: 529809 - protein, 11 aa, Influenza virus
KTTVDHMAIIR

SEQ ID NO: 529810 - protein, 11 aa, Influenza virus
KTVINNITTTI

SEQ ID NO: 529811 - protein, 11 aa, Influenza virus
KTVVHLNSTTI

SEQ ID NO: 529812 - protein, 11 aa, Influenza virus
KTWAGKILRTQ

SEQ ID NO: 529813 - protein, 11 aa, Influenza virus
KTWAGNILRTQ

SEQ ID NO: 529814 - protein, 11 aa, Influenza virus
KTWAKNILRTQ

SEQ ID NO: 529815 - protein, 11 aa, Influenza virus
KTWARNILRTQ

SEQ ID NO: 529816 - protein, 11 aa, Influenza virus
KTYNNTTGRDV

SEQ ID NO: 529817 - protein, 11 aa, Influenza virus
KVARLGKGYMF

SEQ ID NO: 529818 - protein, 11 aa, Influenza virus
KVATGRVTVST

SEQ ID NO: 529819 - protein, 11 aa, Influenza virus
KVCRALLAKSV

SEQ ID NO: 529820 - protein, 11 aa, Influenza virus
KVCRTLLAKSV

SEQ ID NO: 529821 - protein, 11 aa, Influenza virus
KVCTKGKKAVD

SEQ ID NO: 529822 - protein, 11 aa, Influenza virus
KVDGSSSACLR

SEQ ID NO: 529823 - protein, 11 aa, Influenza virus
KVDLWSYNAEL

SEQ ID NO: 529824 - protein, 11 aa, Influenza virus
KVDTIIENNVT

SEQ ID NO: 529825 - protein, 11 aa, Influenza virus
KVDTIIESNIT

SEQ ID NO: 529826 - protein, 11 aa, Influenza virus
KVDTIIESNVT

SEQ ID NO: 529827 - protein, 11 aa, Influenza virus
KVDTILERNVT

SEQ ID NO: 529828 - protein, 11 aa, Influenza virus
KVDTLTEKGIE

SEQ ID NO: 529829 - protein, 11 aa, Influenza virus
KVDTLTENGVP

SEQ ID NO: 529830 - protein, 11 aa, Influenza virus
KVDTLTETGVP

SEQ ID NO: 529831 - protein, 11 aa, Influenza virus
KVDTNLERNVT

SEQ ID NO: 529832 - protein, 11 aa, Influenza virus
KVEAVIYGNPK

SEQ ID NO: 529833 - protein, 11 aa, Influenza virus
KVECICRDNWT

SEQ ID NO: 529834 - protein, 11 aa, Influenza virus
KVECIGWSSTS

SEQ ID NO: 529835 - protein, 11 aa, Influenza virus
KVECVCRDNWN

SEQ ID NO: 529836 - protein, 11 aa, Influenza virus
KVECVCRDNWT

SEQ ID NO: 529837 - protein, 11 aa, Influenza virus
KVEFEPFQSLV

SEQ ID NO: 529838 - protein, 11 aa, Influenza virus
KVEGWVVVAKD

SEQ ID NO: 529839 - protein, 11 aa, Influenza virus
KVESNGNLIAP

SEQ ID NO: 529840 - protein, 11 aa, Influenza virus
KVGYLCAGIPT

SEQ ID NO: 529841 - protein, 11 aa, Influenza virus
KVKMKWGMEMR

SEQ ID NO: 529842 - protein, 11 aa, Influenza virus
KVKMQLRDNAK

SEQ ID NO: 529843 - protein, 11 aa, Influenza virus
KVLAIYSCIAS

SEQ ID NO: 529844 - protein, 11 aa, Influenza virus
KVLSIYSCIAS

SEQ ID NO: 529845 - protein, 11 aa, Influenza virus
KVNGQAGRIDF

SEQ ID NO: 529846 - protein, 11 aa, Influenza virus
KVNGVKLEENS

SEQ ID NO: 529847 - protein, 11 aa, Influenza virus
KVNNIVDKMNR

SEQ ID NO: 529848 - protein, 11 aa, Influenza virus
KVNSIIDKMNT

SEQ ID NO: 529849 - protein, 11 aa, Influenza virus
KVNSIIGKMNT

SEQ ID NO: 529850 - protein, 11 aa, Influenza virus
KVNSIINKMNT

SEQ ID NO: 529851 - protein, 11 aa, Influenza virus
KVNTIIENNVT

SEQ ID NO: 529852 - protein, 11 aa, Influenza virus
KVNTLTEKGIE

SEQ ID NO: 529853 - protein, 11 aa, Influenza virus
KVNTLTEKGVE

SEQ ID NO: 529854 - protein, 11 aa, Influenza virus
KVNTLTEREVE

SEQ ID NO: 529855 - protein, 11 aa, Influenza virus
KVNTLTERGIE

SEQ ID NO: 529856 - protein, 11 aa, Influenza virus
KVNTLTERGVE

SEQ ID NO: 529857 - protein, 11 aa, Influenza virus
KVPEWSYIVEK

SEQ ID NO: 529858 - protein, 11 aa, Influenza virus
KVPNAGTDPNS

SEQ ID NO: 529859 - protein, 11 aa, Influenza virus
KVPNALIDDRS

SEQ ID NO: 529860 - protein, 11 aa, Influenza virus
KVPNALTDDKS

SEQ ID NO: 529861 - protein, 11 aa, Influenza virus
KVPNALTDDRS

SEQ ID NO: 529862 - protein, 11 aa, Influenza virus
KVPNALTDNRS

SEQ ID NO: 529863 - protein, 11 aa, Influenza virus
KVPNALTNDRS

SEQ ID NO: 529864 - protein, 11 aa, Influenza virus
KVPVTQTMELV

SEQ ID NO: 529865 - protein, 11 aa, Influenza virus
KVQEWSYIVEK

SEQ ID NO: 529866 - protein, 11 aa, Influenza virus
KVQHLEECSCY

SEQ ID NO: 529867 - protein, 11 aa, Influenza virus
KVRLQLKDNAK

SEQ ID NO: 529868 - protein, 11 aa, Influenza virus
KVRLQLRDNAK

SEQ ID NO: 529869 - protein, 11 aa, Influenza virus
KVRMQLKDNAK

SEQ ID NO: 529870 - protein, 11 aa, Influenza virus
KVRMQLRDNAK

SEQ ID NO: 529871 - protein, 11 aa, Influenza virus
KVRMQLRDNVK

SEQ ID NO: 529872 - protein, 11 aa, Influenza virus
KVRNGTYDHKE

SEQ ID NO: 529873 - protein, 11 aa, Influenza virus
KVRRQLRENAE

SEQ ID NO: 529874 - protein, 11 aa, Influenza virus
KVSTQKAINEI

SEQ ID NO: 529875 - protein, 11 aa, Influenza virus
KVSTQKALNEI

SEQ ID NO: 529876 - protein, 11 aa, Influenza virus
KVTCICRDNWQ

SEQ ID NO: 529877 - protein, 11 aa, Influenza virus
KVTCVCRDNWQ

SEQ ID NO: 529878 - protein, 11 aa, Influenza virus
KVTNATETVES

SEQ ID NO: 529879 - protein, 11 aa, Influenza virus
KVWWTSNSIIS

SEQ ID NO: 529880 - protein, 11 aa, Influenza virus
KVWWTSNSIVS

SEQ ID NO: 529881 - protein, 11 aa, Influenza virus
KVWWTSNSIVV

SEQ ID NO: 529882 - protein, 11 aa, Influenza virus
KWALGENMAPE

SEQ ID NO: 529883 - protein, 11 aa, Influenza virus
KWGDILDGVTA

SEQ ID NO: 529884 - protein, 11 aa, Influenza virus
KWGDILEGTTA

SEQ ID NO: 529885 - protein, 11 aa, Influenza virus
KWGDVLDGVTA

SEQ ID NO: 529886 - protein, 11 aa, Influenza virus
KWGMELRRCLL

SEQ ID NO: 529887 - protein, 11 aa, Influenza virus
KWGMEMRRCLL

SEQ ID NO: 529888 - protein, 11 aa, Influenza virus
KWGNVLDGVTA

SEQ ID NO: 529889 - protein, 11 aa, Influenza virus
KWLLSSKANQV

SEQ ID NO: 529890 - protein, 11 aa, Influenza virus
KWLLSSKDNQV

SEQ ID NO: 529891 - protein, 11 aa, Influenza virus
KWLSSSGNNQV

SEQ ID NO: 529892 - protein, 11 aa, Influenza virus
KWLSSSMNNQV

SEQ ID NO: 529893 - protein, 11 aa, Influenza virus
KWLTLKSGQFP

SEQ ID NO: 529894 - protein, 11 aa, Influenza virus
KWMMAMKYPIT

SEQ ID NO: 529895 - protein, 11 aa, Influenza virus
KWMMAMRYPIT

SEQ ID NO: 529896 - protein, 11 aa, Influenza virus
KWNENQNPRIF

SEQ ID NO: 529897 - protein, 11 aa, Influenza virus
KWNENQNPRMF

SEQ ID NO: 529898 - protein, 11 aa, Influenza virus
KWNENQNPRVF

SEQ ID NO: 529899 - protein, 11 aa, Influenza virus
KWNVTHTGTSK

SEQ ID NO: 529900 - protein, 11 aa, Influenza virus
KWNVTYTGISK

SEQ ID NO: 529901 - protein, 11 aa, Influenza virus
KWNVTYTGTSK

SEQ ID NO: 529902 - protein, 11 aa, Influenza virus
KWNVTYTGTSR

SEQ ID NO: 529903 - protein, 11 aa, Influenza virus
KWREQLSQKFE

SEQ ID NO: 529904 - protein, 11 aa, Influenza virus
KWSGYSGSFID

SEQ ID NO: 529905 - protein, 11 aa, Influenza virus
KWTLGENMAPE

SEQ ID NO: 529906 - protein, 11 aa, Influenza virus
KWVLGENMAPE

SEQ ID NO: 529907 - protein, 11 aa, Influenza virus
KWWVWLWLVLR

SEQ ID NO: 529908 - protein, 11 aa, Influenza virus
KYDNGVWIGRT

SEQ ID NO: 529909 - protein, 11 aa, Influenza virus
KYEEESKLKRN

SEQ ID NO: 529910 - protein, 11 aa, Influenza virus
KYEEESKLKRQ

SEQ ID NO: 529911 - protein, 11 aa, Influenza virus
KYEEESKLNRN

SEQ ID NO: 529912 - protein, 11 aa, Influenza virus
KYEEESKLNRS

SEQ ID NO: 529913 - protein, 11 aa, Influenza virus
KYEEESKLNRT

SEQ ID NO: 529914 - protein, 11 aa, Influenza virus
KYEEESRLNRN

SEQ ID NO: 529915 - protein, 11 aa, Influenza virus
KYEKESKLNRN

SEQ ID NO: 529916 - protein, 11 aa, Influenza virus
KYERVKMFDFI

SEQ ID NO: 529917 - protein, 11 aa, Influenza virus
KYERVKMFDFS

SEQ ID NO: 529918 - protein, 11 aa, Influenza virus
KYERVKMFDFT

SEQ ID NO: 529919 - protein, 11 aa, Influenza virus
KYGDGVWIGRT

SEQ ID NO: 529920 - protein, 11 aa, Influenza virus
KYGNGAWIGRT

SEQ ID NO: 529921 - protein, 11 aa, Influenza virus
KYGNGVWIGRT

SEQ ID NO: 529922 - protein, 11 aa, Influenza virus
KYGNGVWMGRT

SEQ ID NO: 529923 - protein, 11 aa, Influenza virus
KYGPALSINEL

SEQ ID NO: 529924 - protein, 11 aa, Influenza virus
KYGSGRIFQSG

SEQ ID NO: 529925 - protein, 11 aa, Influenza virus
KYGTGRIFQSG

SEQ ID NO: 529926 - protein, 11 aa, Influenza virus
KYGTGRIFQSR

SEQ ID NO: 529927 - protein, 11 aa, Influenza virus
KYGYIIEEYGK

SEQ ID NO: 529928 - protein, 11 aa, Influenza virus
KYHQIEKEFEQ

SEQ ID NO: 529929 - protein, 11 aa, Influenza virus
KYHQIEKEFGQ

SEQ ID NO: 529930 - protein, 11 aa, Influenza virus
KYHWNLALDIV

SEQ ID NO: 529931 - protein, 11 aa, Influenza virus
KYIKQGSLKLA

SEQ ID NO: 529932 - protein, 11 aa, Influenza virus
KYIKSDQLKLA

SEQ ID NO: 529933 - protein, 11 aa, Influenza virus
KYIKSGQLKLA

SEQ ID NO: 529934 - protein, 11 aa, Influenza virus
KYIPSGSLKLA

SEQ ID NO: 529935 - protein, 11 aa, Influenza virus
KYIPSNSLKLA

SEQ ID NO: 529936 - protein, 11 aa, Influenza virus
KYIPSRSLKLA

SEQ ID NO: 529937 - protein, 11 aa, Influenza virus
KYISSGSLKLA

SEQ ID NO: 529938 - protein, 11 aa, Influenza virus
KYKIFKNGKKG

SEQ ID NO: 529939 - protein, 11 aa, Influenza virus
KYMNVKSLKLA

SEQ ID NO: 529940 - protein, 11 aa, Influenza virus
KYNGIITDTFK

SEQ ID NO: 529941 - protein, 11 aa, Influenza virus
KYNGIITDTLK

SEQ ID NO: 529942 - protein, 11 aa, Influenza virus
KYNGVITDTLK

SEQ ID NO: 529943 - protein, 11 aa, Influenza virus
KYQQSFSPSPG

SEQ ID NO: 529944 - protein, 11 aa, Influenza virus
KYQQSFTPSPE

SEQ ID NO: 529945 - protein, 11 aa, Influenza virus
KYQQSFTPSPG

SEQ ID NO: 529946 - protein, 11 aa, Influenza virus
KYREEAMQNRI

SEQ ID NO: 529947 - protein, 11 aa, Influenza virus
KYRQSFSPSPG

SEQ ID NO: 529948 - protein, 11 aa, Influenza virus
KYRTESLQNRI

SEQ ID NO: 529949 - protein, 11 aa, Influenza virus
KYSRADKICIG

SEQ ID NO: 529950 - protein, 11 aa, Influenza virus
KYTSARQEKNP

SEQ ID NO: 529951 - protein, 11 aa, Influenza virus
KYTSGRQEKNP

SEQ ID NO: 529952 - protein, 11 aa, Influenza virus
KYVEDTKIDLW

SEQ ID NO: 529953 - protein, 11 aa, Influenza virus
KYVEDTKVDLW

SEQ ID NO: 529954 - protein, 11 aa, Influenza virus
KYVEWTSNSLI

SEQ ID NO: 529955 - protein, 11 aa, Influenza virus
KYVKQGSLKLA

SEQ ID NO: 529956 - protein, 11 aa, Influenza virus
KYVKQGSLMLA

SEQ ID NO: 529957 - protein, 11 aa, Influenza virus
KYVKQGSLRLA

SEQ ID NO: 529958 - protein, 11 aa, Influenza virus
KYVKSDRLVLA

SEQ ID NO: 529959 - protein, 11 aa, Influenza virus
KYVKSEKLVLA

SEQ ID NO: 529960 - protein, 11 aa, Influenza virus
KYVKSERLVLA

SEQ ID NO: 529961 - protein, 11 aa, Influenza virus
KYVKSKRLVLA

SEQ ID NO: 529962 - protein, 11 aa, Influenza virus
KYVNIKSLKLA

SEQ ID NO: 529963 - protein, 11 aa, Influenza virus
KYVNVKSLKLA

SEQ ID NO: 529964 - protein, 11 aa, Influenza virus
KYVNVRSLKLA

SEQ ID NO: 529965 - protein, 11 aa, Influenza virus
KYVRSEKLVLA

SEQ ID NO: 529966 - protein, 11 aa, Influenza virus
KYVWWASNSLI

SEQ ID NO: 529967 - protein, 11 aa, Influenza virus
KYVWWTSNSLI

SEQ ID NO: 529968 - protein, 11 aa, Influenza virus
KYVWWTSNSLV

SEQ ID NO: 529969 - protein, 11 aa, Influenza virus
KYWAIRTRSGG

SEQ ID NO: 529970 - protein, 11 aa, Influenza virus
LAADYKSTQAA

SEQ ID NO: 529971 - protein, 11 aa, Influenza virus
LAAGGAIWVTR

SEQ ID NO: 529972 - protein, 11 aa, Influenza virus
LAAGGDIWVTR

SEQ ID NO: 529973 - protein, 11 aa, Influenza virus
LAATVTLHFKQ

SEQ ID NO: 529974 - protein, 11 aa, Influenza virus
LADQSLPPNFP

SEQ ID NO: 529975 - protein, 11 aa, Influenza virus
LADQSLPPNFS

SEQ ID NO: 529976 - protein, 11 aa, Influenza virus
LADRIDDAVTD

SEQ ID NO: 529977 - protein, 11 aa, Influenza virus
LADRVDDAVTD

SEQ ID NO: 529978 - protein, 11 aa, Influenza virus
LADSEMLNLYE

SEQ ID NO: 529979 - protein, 11 aa, Influenza virus
LADSEMNKLYE

SEQ ID NO: 529980 - protein, 11 aa, Influenza virus
LADWVDDAVTD

SEQ ID NO: 529981 - protein, 11 aa, Influenza virus
LAEKAMKEHGE

SEQ ID NO: 529982 - protein, 11 aa, Influenza virus
LAEKAMKEYGE

SEQ ID NO: 529983 - protein, 11 aa, Influenza virus
LAEKTMKEYGE

SEQ ID NO: 529984 - protein, 11 aa, Influenza virus
LAERAMKEYGE

SEQ ID NO: 529985 - protein, 11 aa, Influenza virus
LAFICIKNGNM

SEQ ID NO: 529986 - protein, 11 aa, Influenza virus
LAFILWACSSG

SEQ ID NO: 529987 - protein, 11 aa, Influenza virus
LAFIMWACSNG

SEQ ID NO: 529988 - protein, 11 aa, Influenza virus
LAFIMWACSSG

SEQ ID NO: 529989 - protein, 11 aa, Influenza virus
LAGSAQHVEEC

SEQ ID NO: 529990 - protein, 11 aa, Influenza virus
LAGTAKHIEEC

SEQ ID NO: 529991 - protein, 11 aa, Influenza virus
LAHALKLVVAM

SEQ ID NO: 529992 - protein, 11 aa, Influenza virus
LAIAMGLIFMC

SEQ ID NO: 529993 - protein, 11 aa, Influenza virus
LAIGECPKYVK

SEQ ID NO: 529994 - protein, 11 aa, Influenza virus
LAIGLRNTPSI

SEQ ID NO: 529995 - protein, 11 aa, Influenza virus
LAIGLRNVPQA

SEQ ID NO: 529996 - protein, 11 aa, Influenza virus
LAIGLRNVPQI

SEQ ID NO: 529997 - protein, 11 aa, Influenza virus
LAIGLRNVPQV

SEQ ID NO: 529998 - protein, 11 aa, Influenza virus
LAIGPRNVPQA

SEQ ID NO: 529999 - protein, 11 aa, Influenza virus
LAIGPRNVPQV

SEQ ID NO: 530000 - protein, 11 aa, Influenza virus
LAIIIAGLSFW

SEQ ID NO: 530001 - protein, 11 aa, Influenza virus
LAILIAGGLIL

SEQ ID NO: 530002 - protein, 11 aa, Influenza virus
LAILVAGGLIL

SEQ ID NO: 530003 - protein, 11 aa, Influenza virus
LAIMIAGLFFW

SEQ ID NO: 530004 - protein, 11 aa, Influenza virus
LAIMIAGLSFW

SEQ ID NO: 530005 - protein, 11 aa, Influenza virus
LAIMMAGLSFW

SEQ ID NO: 530006 - protein, 11 aa, Influenza virus
LAIMVAGLSFW

SEQ ID NO: 530007 - protein, 11 aa, Influenza virus
LAIYATVAGSL

SEQ ID NO: 530008 - protein, 11 aa, Influenza virus
LAIYSCIASSI

SEQ ID NO: 530009 - protein, 11 aa, Influenza virus
LAIYSTAASSL

SEQ ID NO: 530010 - protein, 11 aa, Influenza virus
LAIYSTISSSL

SEQ ID NO: 530011 - protein, 11 aa, Influenza virus
LAIYSTVASSL

SEQ ID NO: 530012 - protein, 11 aa, Influenza virus
LAIYSTVASSS

SEQ ID NO: 530013 - protein, 11 aa, Influenza virus
LAIYSTVSSSL

SEQ ID NO: 530014 - protein, 11 aa, Influenza virus
LAKCNTKCQTS

SEQ ID NO: 530015 - protein, 11 aa, Influenza virus
LAKGEKANVLI

SEQ ID NO: 530016 - protein, 11 aa, Influenza virus
LAKSVFNCLYA

SEQ ID NO: 530017 - protein, 11 aa, Influenza virus
LAKSVFNNLYA

SEQ ID NO: 530018 - protein, 11 aa, Influenza virus
LAKSVFNSIYA

SEQ ID NO: 530019 - protein, 11 aa, Influenza virus
LAKSVFNSLYA

SEQ ID NO: 530020 - protein, 11 aa, Influenza virus
LAKSVFNSLYS

SEQ ID NO: 530021 - protein, 11 aa, Influenza virus
LALGLRNTPSI

SEQ ID NO: 530022 - protein, 11 aa, Influenza virus
LALGMKNVPEK

SEQ ID NO: 530023 - protein, 11 aa, Influenza virus
LALSHTAYSQI

SEQ ID NO: 530024 - protein, 11 aa, Influenza virus
LANNGKFEFIA

SEQ ID NO: 530025 - protein, 11 aa, Influenza virus
LANNGKFEFIV

SEQ ID NO: 530026 - protein, 11 aa, Influenza virus
LANNGKLEFIA

SEQ ID NO: 530027 - protein, 11 aa, Influenza virus
LANNGRFEFIA

SEQ ID NO: 530028 - protein, 11 aa, Influenza virus
LANQSLPPNFS

SEQ ID NO: 530029 - protein, 11 aa, Influenza virus
LANTIEIFRSN

SEQ ID NO: 530030 - protein, 11 aa, Influenza virus
LANTIEVFKSN

SEQ ID NO: 530031 - protein, 11 aa, Influenza virus
LANTIEVFRLN

SEQ ID NO: 530032 - protein, 11 aa, Influenza virus
LANTIEVFRMN

SEQ ID NO: 530033 - protein, 11 aa, Influenza virus
LANTIEVFRSN

SEQ ID NO: 530034 - protein, 11 aa, Influenza virus
LANVVRKMMTN

SEQ ID NO: 530035 - protein, 11 aa, Influenza virus
LANVVRKMMTS

SEQ ID NO: 530036 - protein, 11 aa, Influenza virus
LANYSLPPNFS

SEQ ID NO: 530037 - protein, 11 aa, Influenza virus
LAPKYGYIIEE

SEQ ID NO: 530038 - protein, 11 aa, Influenza virus
LAPRYGYIIEE

SEQ ID NO: 530039 - protein, 11 aa, Influenza virus
LAPRYGYIIEK

SEQ ID NO: 530040 - protein, 11 aa, Influenza virus
LAQGALLGTKH

SEQ ID NO: 530041 - protein, 11 aa, Influenza virus
LAQGALLGTNH

SEQ ID NO: 530042 - protein, 11 aa, Influenza virus
LAQGALLGTRH

SEQ ID NO: 530043 - protein, 11 aa, Influenza virus
LAQGALVGTKH

SEQ ID NO: 530044 - protein, 11 aa, Influenza virus
LAQGVLLGTKH

SEQ ID NO: 530045 - protein, 11 aa, Influenza virus
LAQGYKDIILW

SEQ ID NO: 530046 - protein, 11 aa, Influenza virus
LARCICEKLEQ

SEQ ID NO: 530047 - protein, 11 aa, Influenza virus
LARGEKANVLI

SEQ ID NO: 530048 - protein, 11 aa, Influenza virus
LARNICEKLEQ

SEQ ID NO: 530049 - protein, 11 aa, Influenza virus
LARRICEKLEQ

SEQ ID NO: 530050 - protein, 11 aa, Influenza virus
LARSALILRGA

SEQ ID NO: 530051 - protein, 11 aa, Influenza virus
LARSALILRGS

SEQ ID NO: 530052 - protein, 11 aa, Influenza virus
LARSICEKLEQ

SEQ ID NO: 530053 - protein, 11 aa, Influenza virus
LASCMGLIYNR

SEQ ID NO: 530054 - protein, 11 aa, Influenza virus
LASLLEMCHGT

SEQ ID NO: 530055 - protein, 11 aa, Influenza virus
LASLLEMCHST

SEQ ID NO: 530056 - protein, 11 aa, Influenza virus
LASSGSLEFIA

SEQ ID NO: 530057 - protein, 11 aa, Influenza virus
LASTNAHDRIC

SEQ ID NO: 530058 - protein, 11 aa, Influenza virus
LASTNAYDRIC

SEQ ID NO: 530059 - protein, 11 aa, Influenza virus
LASTTAKAMEQ

SEQ ID NO: 530060 - protein, 11 aa, Influenza virus
LATGLRNAHKM

SEQ ID NO: 530061 - protein, 11 aa, Influenza virus
LATGLRNIPQI

SEQ ID NO: 530062 - protein, 11 aa, Influenza virus
LATGLRNVPIP

SEQ ID NO: 530063 - protein, 11 aa, Influenza virus
LATGLRNVPQI

SEQ ID NO: 530064 - protein, 11 aa, Influenza virus
LATGLRNVPQM

SEQ ID NO: 530065 - protein, 11 aa, Influenza virus
LATGLRNVPSI

SEQ ID NO: 530066 - protein, 11 aa, Influenza virus
LATGLRNVPSV

SEQ ID NO: 530067 - protein, 11 aa, Influenza virus
LATGMKNVPEI

SEQ ID NO: 530068 - protein, 11 aa, Influenza virus
LATGMKNVPET

SEQ ID NO: 530069 - protein, 11 aa, Influenza virus
LATGMRNIPEK

SEQ ID NO: 530070 - protein, 11 aa, Influenza virus
LATGMRNIPEN

SEQ ID NO: 530071 - protein, 11 aa, Influenza virus
LATGMRNIPER

SEQ ID NO: 530072 - protein, 11 aa, Influenza virus
LATGMRNIPGK

SEQ ID NO: 530073 - protein, 11 aa, Influenza virus
LATGMRNVPEI

SEQ ID NO: 530074 - protein, 11 aa, Influenza virus
LATGMRNVPEK

SEQ ID NO: 530075 - protein, 11 aa, Influenza virus
LATGMRNVPEN

SEQ ID NO: 530076 - protein, 11 aa, Influenza virus
LATGMRNVPER

SEQ ID NO: 530077 - protein, 11 aa, Influenza virus
LATGMRNVPET

SEQ ID NO: 530078 - protein, 11 aa, Influenza virus
LATGMRNVPEV

SEQ ID NO: 530079 - protein, 11 aa, Influenza virus
LATGPRNVPQI

SEQ ID NO: 530080 - protein, 11 aa, Influenza virus
LATRGVQIASN

SEQ ID NO: 530081 - protein, 11 aa, Influenza virus
LATTITLHFKQ

SEQ ID NO: 530082 - protein, 11 aa, Influenza virus
LATTVTLHFKQ

SEQ ID NO: 530083 - protein, 11 aa, Influenza virus
LAVGLRNTPSI

SEQ ID NO: 530084 - protein, 11 aa, Influenza virus
LAVGLRNTPSV

SEQ ID NO: 530085 - protein, 11 aa, Influenza virus
LAVLIAGGLIL

SEQ ID NO: 530086 - protein, 11 aa, Influenza virus
LAVNVRGSGMR

SEQ ID NO: 530087 - protein, 11 aa, Influenza virus
LAVTWWNRKGP

SEQ ID NO: 530088 - protein, 11 aa, Influenza virus
LAVTWWNRNGP

SEQ ID NO: 530089 - protein, 11 aa, Influenza virus
LAVTWWNRSGP

SEQ ID NO: 530090 - protein, 11 aa, Influenza virus
LAYCNTDLGTP

SEQ ID NO: 530091 - protein, 11 aa, Influenza virus
LAYDKICIGYQ

SEQ ID NO: 530092 - protein, 11 aa, Influenza virus
LBNEPGSGNWP

SEQ ID NO: 530093 - protein, 11 aa, Influenza virus
LCAGIPSDTPR

SEQ ID NO: 530094 - protein, 11 aa, Influenza virus
LCAGIPTDTPR

SEQ ID NO: 530095 - protein, 11 aa, Influenza virus
LCAGLPSDTPR

SEQ ID NO: 530096 - protein, 11 aa, Influenza virus
LCAVNSWHILS

SEQ ID NO: 530097 - protein, 11 aa, Influenza virus
LCEVNSWHIFS

SEQ ID NO: 530098 - protein, 11 aa, Influenza virus
LCEVNSWHILS

SEQ ID NO: 530099 - protein, 11 aa, Influenza virus
LCEVSSWHILS

SEQ ID NO: 530100 - protein, 11 aa, Influenza virus
LCFPGELDNNG

SEQ ID NO: 530101 - protein, 11 aa, Influenza virus
LCFPGEVDNNG

SEQ ID NO: 530102 - protein, 11 aa, Influenza virus
LCGSKEQLGSW

SEQ ID NO: 530103 - protein, 11 aa, Influenza virus
LCGSKERLGSW

SEQ ID NO: 530104 - protein, 11 aa, Influenza virus
LCGSKKRLGSW

SEQ ID NO: 530105 - protein, 11 aa, Influenza virus
LCGSPFPVGSG

SEQ ID NO: 530106 - protein, 11 aa, Influenza virus
LCGSPISVGSG

SEQ ID NO: 530107 - protein, 11 aa, Influenza virus
LCGSPVPVGSG

SEQ ID NO: 530108 - protein, 11 aa, Influenza virus
LCGSPVSVGSG

SEQ ID NO: 530109 - protein, 11 aa, Influenza virus
LCGSRERLGSW

SEQ ID NO: 530110 - protein, 11 aa, Influenza virus
LCIDYHAHNST

SEQ ID NO: 530111 - protein, 11 aa, Influenza virus
LCIGYHANNST

SEQ ID NO: 530112 - protein, 11 aa, Influenza virus
LCIINSWHIYG

SEQ ID NO: 530113 - protein, 11 aa, Influenza virus
LCKLNGIPPLE

SEQ ID NO: 530114 - protein, 11 aa, Influenza virus
LCKVEGWVVVA

SEQ ID NO: 530115 - protein, 11 aa, Influenza virus
LCLAILIAGGL

SEQ ID NO: 530116 - protein, 11 aa, Influenza virus
LCLAILVAGGL

SEQ ID NO: 530117 - protein, 11 aa, Influenza virus
LCLAVLIAGGL

SEQ ID NO: 530118 - protein, 11 aa, Influenza virus
LCLGHHAVANG

SEQ ID NO: 530119 - protein, 11 aa, Influenza virus
LCLGHHAVPNG

SEQ ID NO: 530120 - protein, 11 aa, Influenza virus
LCLGHHAVQNG

SEQ ID NO: 530121 - protein, 11 aa, Influenza virus
LCLGHHAVSNG

SEQ ID NO: 530122 - protein, 11 aa, Influenza virus
LCNPLNPFVGH

SEQ ID NO: 530123 - protein, 11 aa, Influenza virus
LCNPLNPFVNH

SEQ ID NO: 530124 - protein, 11 aa, Influenza virus
LCNPLNPFVSH

SEQ ID NO: 530125 - protein, 11 aa, Influenza virus
LCNPLNPFVTH

SEQ ID NO: 530126 - protein, 11 aa, Influenza virus
LCNPMNPFVSH

SEQ ID NO: 530127 - protein, 11 aa, Influenza virus
LCNVEGWVVIA

SEQ ID NO: 530128 - protein, 11 aa, Influenza virus
LCPFKGFFPFH

SEQ ID NO: 530129 - protein, 11 aa, Influenza virus
LCPFQGFFPFH

SEQ ID NO: 530130 - protein, 11 aa, Influenza virus
LCPFRGFFPFH

SEQ ID NO: 530131 - protein, 11 aa, Influenza virus
LCPIKGWAPLS

SEQ ID NO: 530132 - protein, 11 aa, Influenza virus
LCPIRGWAPLS

SEQ ID NO: 530133 - protein, 11 aa, Influenza virus
LCPSPLKLVDG

SEQ ID NO: 530134 - protein, 11 aa, Influenza virus
LCPVKGWAPLS

SEQ ID NO: 530135 - protein, 11 aa, Influenza virus
LCQVECVCRDN

SEQ ID NO: 530136 - protein, 11 aa, Influenza virus
LCRLRGIPPLE

SEQ ID NO: 530137 - protein, 11 aa, Influenza virus
LCRLSGIPPLE

SEQ ID NO: 530138 - protein, 11 aa, Influenza virus
LCSGLVGDTPR

SEQ ID NO: 530139 - protein, 11 aa, Influenza virus
LCSIWFSHYNQ

SEQ ID NO: 530140 - protein, 11 aa, Influenza virus
LCSKILTDTSR

SEQ ID NO: 530141 - protein, 11 aa, Influenza virus
LCSKTLTDTSR

SEQ ID NO: 530142 - protein, 11 aa, Influenza virus
LCSKVLTDTSR

SEQ ID NO: 530143 - protein, 11 aa, Influenza virus
LCSRILTDTSR

SEQ ID NO: 530144 - protein, 11 aa, Influenza virus
LCSRVLTDTSR

SEQ ID NO: 530145 - protein, 11 aa, Influenza virus
LCSVEGWVVIA

SEQ ID NO: 530146 - protein, 11 aa, Influenza virus
LCSVEYASKTR

SEQ ID NO: 530147 - protein, 11 aa, Influenza virus
LCTGILTDTSR

SEQ ID NO: 530148 - protein, 11 aa, Influenza virus
LCTGVLTDTSK

SEQ ID NO: 530149 - protein, 11 aa, Influenza virus
LCTGVLTDTSR

SEQ ID NO: 530150 - protein, 11 aa, Influenza virus
LCTINSWHIFG

SEQ ID NO: 530151 - protein, 11 aa, Influenza virus
LCTINSWHIYG

SEQ ID NO: 530152 - protein, 11 aa, Influenza virus
LCVGWSSTSCH

SEQ ID NO: 530153 - protein, 11 aa, Influenza virus
LCYPGELDNNG

SEQ ID NO: 530154 - protein, 11 aa, Influenza virus
LCYPGELNNNG

SEQ ID NO: 530155 - protein, 11 aa, Influenza virus
LCYPGEVDNNG

SEQ ID NO: 530156 - protein, 11 aa, Influenza virus
LCYPGNFNDYE

SEQ ID NO: 530157 - protein, 11 aa, Influenza virus
LCYPGSFNDYE

SEQ ID NO: 530158 - protein, 11 aa, Influenza virus
LCYPGSFNNYE

SEQ ID NO: 530159 - protein, 11 aa, Influenza virus
LCYPGSLNDYE

SEQ ID NO: 530160 - protein, 11 aa, Influenza virus
LDDCSLEGIIL

SEQ ID NO: 530161 - protein, 11 aa, Influenza virus
LDDCSLEGLIL

SEQ ID NO: 530162 - protein, 11 aa, Influenza virus
LDDCSLEGLVL

SEQ ID NO: 530163 - protein, 11 aa, Influenza virus
LDDCSLKGLIL

SEQ ID NO: 530164 - protein, 11 aa, Influenza virus
LDEESRARIKT

SEQ ID NO: 530165 - protein, 11 aa, Influenza virus
LDEHDANVRNL

SEQ ID NO: 530166 - protein, 11 aa, Influenza virus
LDEHDSNVENL

SEQ ID NO: 530167 - protein, 11 aa, Influenza virus
LDEHDSNVKNL

SEQ ID NO: 530168 - protein, 11 aa, Influenza virus
LDEIGEDIAPI

SEQ ID NO: 530169 - protein, 11 aa, Influenza virus
LDEIGEDLAPI

SEQ ID NO: 530170 - protein, 11 aa, Influenza virus
LDEIGEDVAPI

SEQ ID NO: 530171 - protein, 11 aa, Influenza virus
LDEQNKLYGAG

SEQ ID NO: 530172 - protein, 11 aa, Influenza virus
LDEQNKLYGTG

SEQ ID NO: 530173 - protein, 11 aa, Influenza virus
LDFHDSNVKNL

SEQ ID NO: 530174 - protein, 11 aa, Influenza virus
LDFHDSNVKSL

SEQ ID NO: 530175 - protein, 11 aa, Influenza virus
LDFHDSNVRNL

SEQ ID NO: 530176 - protein, 11 aa, Influenza virus
LDFHDSSVKNL

SEQ ID NO: 530177 - protein, 11 aa, Influenza virus
LDGVTASCLDK

SEQ ID NO: 530178 - protein, 11 aa, Influenza virus
LDGVTASCLDR

SEQ ID NO: 530179 - protein, 11 aa, Influenza virus
LDGVTASCRDN

SEQ ID NO: 530180 - protein, 11 aa, Influenza virus
LDIRTATREGK

SEQ ID NO: 530181 - protein, 11 aa, Influenza virus
LDIWTYNAELL

SEQ ID NO: 530182 - protein, 11 aa, Influenza virus
LDKHDSNVKNL

SEQ ID NO: 530183 - protein, 11 aa, Influenza virus
LDKICLGHHAV

SEQ ID NO: 530184 - protein, 11 aa, Influenza virus
LDLHDANVKNL

SEQ ID NO: 530185 - protein, 11 aa, Influenza virus
LDLHDANVRNL

SEQ ID NO: 530186 - protein, 11 aa, Influenza virus
LDLHDSNVKNL

SEQ ID NO: 530187 - protein, 11 aa, Influenza virus
LDLHDSNVRNL

SEQ ID NO: 530188 - protein, 11 aa, Influenza virus
LDLHDSNVRSL

SEQ ID NO: 530189 - protein, 11 aa, Influenza virus
LDLHDSNVTNL

SEQ ID NO: 530190 - protein, 11 aa, Influenza virus
LDLNMGQPFYS

SEQ ID NO: 530191 - protein, 11 aa, Influenza virus
LDMHDANVKNL

SEQ ID NO: 530192 - protein, 11 aa, Influenza virus
LDMHDANVRNL

SEQ ID NO: 530193 - protein, 11 aa, Influenza virus
LDNEPGSGDWP

SEQ ID NO: 530194 - protein, 11 aa, Influenza virus
LDNEPGSGNWP

SEQ ID NO: 530195 - protein, 11 aa, Influenza virus
LDNKHSNDTIH

SEQ ID NO: 530196 - protein, 11 aa, Influenza virus
LDNKHSNDTVH

SEQ ID NO: 530197 - protein, 11 aa, Influenza virus
LDNKHSNGTIH

SEQ ID NO: 530198 - protein, 11 aa, Influenza virus
LDNLQAYQKRM

SEQ ID NO: 530199 - protein, 11 aa, Influenza virus
LDNNGELRHLF

SEQ ID NO: 530200 - protein, 11 aa, Influenza virus
LDPGDTVTFTF

SEQ ID NO: 530201 - protein, 11 aa, Influenza virus
LDRICLGHHAV

SEQ ID NO: 530202 - protein, 11 aa, Influenza virus
LDRLRRDQKSL

SEQ ID NO: 530203 - protein, 11 aa, Influenza virus
LDTGDGCFEIL

SEQ ID NO: 530204 - protein, 11 aa, Influenza virus
LDTINFESTGN

SEQ ID NO: 530205 - protein, 11 aa, Influenza virus
LDVWTYNAELL

SEQ ID NO: 530206 - protein, 11 aa, Influenza virus
LDVWTYNTELL

SEQ ID NO: 530207 - protein, 11 aa, Influenza virus
LDYHDSNVKNL

SEQ ID NO: 530208 - protein, 11 aa, Influenza virus
LDYQIGYICSG

SEQ ID NO: 530209 - protein, 11 aa, Influenza virus
LDYQIGYVCSG

SEQ ID NO: 530210 - protein, 11 aa, Influenza virus
LEALMEWIKTR

SEQ ID NO: 530211 - protein, 11 aa, Influenza virus
LEALMEWLKTR

SEQ ID NO: 530212 - protein, 11 aa, Influenza virus
LECKTFFLTQG

SEQ ID NO: 530213 - protein, 11 aa, Influenza virus
LECRTFFLTHG

SEQ ID NO: 530214 - protein, 11 aa, Influenza virus
LECRTFFLTQG

SEQ ID NO: 530215 - protein, 11 aa, Influenza virus
LEDEQMYQKCC

SEQ ID NO: 530216 - protein, 11 aa, Influenza virus
LEDEQMYQRCC

SEQ ID NO: 530217 - protein, 11 aa, Influenza virus
LEECSCYMDID

SEQ ID NO: 530218 - protein, 11 aa, Influenza virus
LEECSCYVDID

SEQ ID NO: 530219 - protein, 11 aa, Influenza virus
LEECSCYVDTD

SEQ ID NO: 530220 - protein, 11 aa, Influenza virus
LEECSCYVDVD

SEQ ID NO: 530221 - protein, 11 aa, Influenza virus
LEEESDEALKM

SEQ ID NO: 530222 - protein, 11 aa, Influenza virus
LEEHPNAGKDP

SEQ ID NO: 530223 - protein, 11 aa, Influenza virus
LEEHPSAGKDP

SEQ ID NO: 530224 - protein, 11 aa, Influenza virus
LEEHPSAGRDP

SEQ ID NO: 530225 - protein, 11 aa, Influenza virus
LEEHPSTGKDP

SEQ ID NO: 530226 - protein, 11 aa, Influenza virus
LEELRFVFSIA

SEQ ID NO: 530227 - protein, 11 aa, Influenza virus
LEELRFVFSNA

SEQ ID NO: 530228 - protein, 11 aa, Influenza virus
LEELRFVFSSA

SEQ ID NO: 530229 - protein, 11 aa, Influenza virus
LEENPSAGKDP

SEQ ID NO: 530230 - protein, 11 aa, Influenza virus
LEENSTYKILS

SEQ ID NO: 530231 - protein, 11 aa, Influenza virus
LEENTSYKILS

SEQ ID NO: 530232 - protein, 11 aa, Influenza virus
LEENTTYKILS

SEQ ID NO: 530233 - protein, 11 aa, Influenza virus
LEENTTYRILS

SEQ ID NO: 530234 - protein, 11 aa, Influenza virus
LEEYVEDTKID

SEQ ID NO: 530235 - protein, 11 aa, Influenza virus
LEFEPFQSLVP

SEQ ID NO: 530236 - protein, 11 aa, Influenza virus
LEFIAEQFTWN

SEQ ID NO: 530237 - protein, 11 aa, Influenza virus
LEFKADLIIER

SEQ ID NO: 530238 - protein, 11 aa, Influenza virus
LEGFSAESRKL

SEQ ID NO: 530239 - protein, 11 aa, Influenza virus
LEGFSAESRKM

SEQ ID NO: 530240 - protein, 11 aa, Influenza virus
LEGIILGNPKC

SEQ ID NO: 530241 - protein, 11 aa, Influenza virus
LEGLILGNPKC

SEQ ID NO: 530242 - protein, 11 aa, Influenza virus
LEGLILSNPKC

SEQ ID NO: 530243 - protein, 11 aa, Influenza virus
LEGLVLGNPKC

SEQ ID NO: 530244 - protein, 11 aa, Influenza virus
LEGTTASCQNR

SEQ ID NO: 530245 - protein, 11 aa, Influenza virus
LEHTSKYVCTG

SEQ ID NO: 530246 - protein, 11 aa, Influenza virus
LEHTSRYICTG

SEQ ID NO: 530247 - protein, 11 aa, Influenza virus
LEHTSRYVCTG

SEQ ID NO: 530248 - protein, 11 aa, Influenza virus
LEICFMYSDFH

SEQ ID NO: 530249 - protein, 11 aa, Influenza virus
LEIGARIGEGQ

SEQ ID NO: 530250 - protein, 11 aa, Influenza virus
LEIGTRIGDGQ

SEQ ID NO: 530251 - protein, 11 aa, Influenza virus
LEKAHNGKLCR

SEQ ID NO: 530252 - protein, 11 aa, Influenza virus
LEKNITVTHSV

SEQ ID NO: 530253 - protein, 11 aa, Influenza virus
LEKNVTVTHAQ

SEQ ID NO: 530254 - protein, 11 aa, Influenza virus
LEKNVTVTHSI

SEQ ID NO: 530255 - protein, 11 aa, Influenza virus
LEKNVTVTHSV

SEQ ID NO: 530256 - protein, 11 aa, Influenza virus
LEKRIENLNKK

SEQ ID NO: 530257 - protein, 11 aa, Influenza virus
LEKRLENLDKK

SEQ ID NO: 530258 - protein, 11 aa, Influenza virus
LEKRLENLNKK

SEQ ID NO: 530259 - protein, 11 aa, Influenza virus
LEKRLGNLNKK

SEQ ID NO: 530260 - protein, 11 aa, Influenza virus
LEKSRINGVKL

SEQ ID NO: 530261 - protein, 11 aa, Influenza virus
LEKTHNGKLCK

SEQ ID NO: 530262 - protein, 11 aa, Influenza virus
LEKTHNGKLCR

SEQ ID NO: 530263 - protein, 11 aa, Influenza virus
LEKYIEDTKID

SEQ ID NO: 530264 - protein, 11 aa, Influenza virus
LEKYVEDTKID

SEQ ID NO: 530265 - protein, 11 aa, Influenza virus
LEKYVEDTKVD

SEQ ID NO: 530266 - protein, 11 aa, Influenza virus
LELGDCSIAGW

SEQ ID NO: 530267 - protein, 11 aa, Influenza virus
LELGNCSIAGW

SEQ ID NO: 530268 - protein, 11 aa, Influenza virus
LELIRMIKRGI

SEQ ID NO: 530269 - protein, 11 aa, Influenza virus
LELRDCKIEAV

SEQ ID NO: 530270 - protein, 11 aa, Influenza virus
LELRDCKVEAV

SEQ ID NO: 530271 - protein, 11 aa, Influenza virus
LELRDCSIAGW

SEQ ID NO: 530272 - protein, 11 aa, Influenza virus
LELRSGYWAIR

SEQ ID NO: 530273 - protein, 11 aa, Influenza virus
LELRSKYWAIR

SEQ ID NO: 530274 - protein, 11 aa, Influenza virus
LELRSRYWAIR

SEQ ID NO: 530275 - protein, 11 aa, Influenza virus
LEMCHGTQIGG

SEQ ID NO: 530276 - protein, 11 aa, Influenza virus
LEMCHSTQIGG

SEQ ID NO: 530277 - protein, 11 aa, Influenza virus
LEMCHSTQVGG

SEQ ID NO: 530278 - protein, 11 aa, Influenza virus
LEMCHSTRIGG

SEQ ID NO: 530279 - protein, 11 aa, Influenza virus
LEMIRGKPEEG

SEQ ID NO: 530280 - protein, 11 aa, Influenza virus
LEMIRGKPEER

SEQ ID NO: 530281 - protein, 11 aa, Influenza virus
LEMIRGKPKER

SEQ ID NO: 530282 - protein, 11 aa, Influenza virus
LEMIRGRPEER

SEQ ID NO: 530283 - protein, 11 aa, Influenza virus
LENDKTLDLHD

SEQ ID NO: 530284 - protein, 11 aa, Influenza virus
LENDKTLDMHD

SEQ ID NO: 530285 - protein, 11 aa, Influenza virus
LENDKTLNMHD

SEQ ID NO: 530286 - protein, 11 aa, Influenza virus
LENDRTLDLHD

SEQ ID NO: 530287 - protein, 11 aa, Influenza virus
LENEKTLDLHD

SEQ ID NO: 530288 - protein, 11 aa, Influenza virus
LENERTLDFHD

SEQ ID NO: 530289 - protein, 11 aa, Influenza virus
LENERTLDLHD

SEQ ID NO: 530290 - protein, 11 aa, Influenza virus
LENERTLDYHD

SEQ ID NO: 530291 - protein, 11 aa, Influenza virus
LENGRTLDLHD

SEQ ID NO: 530292 - protein, 11 aa, Influenza virus
LENGRTLGLHD

SEQ ID NO: 530293 - protein, 11 aa, Influenza virus
LENKHSNGTKH

SEQ ID NO: 530294 - protein, 11 aa, Influenza virus
LENLNKKMEDG

SEQ ID NO: 530295 - protein, 11 aa, Influenza virus
LENLNKKVEDG

SEQ ID NO: 530296 - protein, 11 aa, Influenza virus
LENLNKRMEDG

SEQ ID NO: 530297 - protein, 11 aa, Influenza virus
LENLQAYQKRM

SEQ ID NO: 530298 - protein, 11 aa, Influenza virus
LENLQAYQNRM

SEQ ID NO: 530299 - protein, 11 aa, Influenza virus
LENLQTYQKRM

SEQ ID NO: 530300 - protein, 11 aa, Influenza virus
LENLSKRMEDG

SEQ ID NO: 530301 - protein, 11 aa, Influenza virus
LENQHTIDLAD

SEQ ID NO: 530302 - protein, 11 aa, Influenza virus
LENQHTIDLTD

SEQ ID NO: 530303 - protein, 11 aa, Influenza virus
LENQHTIDMTD

SEQ ID NO: 530304 - protein, 11 aa, Influenza virus
LENQHTIDVTD

SEQ ID NO: 530305 - protein, 11 aa, Influenza virus
LENQHTIHLTD

SEQ ID NO: 530306 - protein, 11 aa, Influenza virus
LENQKILDEHD

SEQ ID NO: 530307 - protein, 11 aa, Influenza virus
LENQKTLDEHD

SEQ ID NO: 530308 - protein, 11 aa, Influenza virus
LENQKTLDKHD

SEQ ID NO: 530309 - protein, 11 aa, Influenza virus
LENQNTIDLTD

SEQ ID NO: 530310 - protein, 11 aa, Influenza virus
LEPGTFDIEGL

SEQ ID NO: 530311 - protein, 11 aa, Influenza virus
LEPGTFDIGGL

SEQ ID NO: 530312 - protein, 11 aa, Influenza virus
LEPGTFDLEGL

SEQ ID NO: 530313 - protein, 11 aa, Influenza virus
LEPGTFDLGGL

SEQ ID NO: 530314 - protein, 11 aa, Influenza virus
LEQNVTVTHAK

SEQ ID NO: 530315 - protein, 11 aa, Influenza virus
LEQSGLPVGGN

SEQ ID NO: 530316 - protein, 11 aa, Influenza virus
LERELVRKTRF

SEQ ID NO: 530317 - protein, 11 aa, Influenza virus
LERNVTVTHAK

SEQ ID NO: 530318 - protein, 11 aa, Influenza virus
LERNVTVTHAQ

SEQ ID NO: 530319 - protein, 11 aa, Influenza virus
LERNVTVTHSV

SEQ ID NO: 530320 - protein, 11 aa, Influenza virus
LERRIENLNKK

SEQ ID NO: 530321 - protein, 11 aa, Influenza virus
LERRIENLNRK

SEQ ID NO: 530322 - protein, 11 aa, Influenza virus
LERRIESLNKK

SEQ ID NO: 530323 - protein, 11 aa, Influenza virus
LERRLENLNKK

SEQ ID NO: 530324 - protein, 11 aa, Influenza virus
LERRLENLSKR

SEQ ID NO: 530325 - protein, 11 aa, Influenza virus
LERSKINEVKL

SEQ ID NO: 530326 - protein, 11 aa, Influenza virus
LERSKINGVIL

SEQ ID NO: 530327 - protein, 11 aa, Influenza virus
LERSKINGVKL

SEQ ID NO: 530328 - protein, 11 aa, Influenza virus
LERSKINGVRL

SEQ ID NO: 530329 - protein, 11 aa, Influenza virus
LERTHNGKLCK

SEQ ID NO: 530330 - protein, 11 aa, Influenza virus
LERYVEDTKID

SEQ ID NO: 530331 - protein, 11 aa, Influenza virus
LESRSGFEMIW

SEQ ID NO: 530332 - protein, 11 aa, Influenza virus
LESRSGFEMVW

SEQ ID NO: 530333 - protein, 11 aa, Influenza virus
LETGYICSKFH

SEQ ID NO: 530334 - protein, 11 aa, Influenza virus
LETGYVCGKFH

SEQ ID NO: 530335 - protein, 11 aa, Influenza virus
LETGYVCSKFH

SEQ ID NO: 530336 - protein, 11 aa, Influenza virus
LEVCFMYSDFH

SEQ ID NO: 530337 - protein, 11 aa, Influenza virus
LEVGTRWMKII

SEQ ID NO: 530338 - protein, 11 aa, Influenza virus
LFALSGVAIAL

SEQ ID NO: 530339 - protein, 11 aa, Influenza virus
LFALSGVAISL

SEQ ID NO: 530340 - protein, 11 aa, Influenza virus
LFALSGVAITL

SEQ ID NO: 530341 - protein, 11 aa, Influenza virus
LFALSGVAVAL

SEQ ID NO: 530342 - protein, 11 aa, Influenza virus
LFASSGIAIAL

SEQ ID NO: 530343 - protein, 11 aa, Influenza virus
LFASSGIAIVL

SEQ ID NO: 530344 - protein, 11 aa, Influenza virus
LFDEVKRRLSA

SEQ ID NO: 530345 - protein, 11 aa, Influenza virus
LFDEVKRRLST

SEQ ID NO: 530346 - protein, 11 aa, Influenza virus
LFDEVRRRLSA

SEQ ID NO: 530347 - protein, 11 aa, Influenza virus
LFDEVRRRLST

SEQ ID NO: 530348 - protein, 11 aa, Influenza virus
LFDEVRRRLSV

SEQ ID NO: 530349 - protein, 11 aa, Influenza virus
LFEKFFPSSSY

SEQ ID NO: 530350 - protein, 11 aa, Influenza virus
LFERVKRQLRE

SEQ ID NO: 530351 - protein, 11 aa, Influenza virus
LFERVRHQLRE

SEQ ID NO: 530352 - protein, 11 aa, Influenza virus
LFERVRRQLRE

SEQ ID NO: 530353 - protein, 11 aa, Influenza virus
LFFFCLKNGNM

SEQ ID NO: 530354 - protein, 11 aa, Influenza virus
LFFWMCSNGSL

SEQ ID NO: 530355 - protein, 11 aa, Influenza virus
LFGAIAGFIEG

SEQ ID NO: 530356 - protein, 11 aa, Influenza virus
LFGAIAGFIEN

SEQ ID NO: 530357 - protein, 11 aa, Influenza virus
LFGAIAGFLEN

SEQ ID NO: 530358 - protein, 11 aa, Influenza virus
LFGAKAGFIEG

SEQ ID NO: 530359 - protein, 11 aa, Influenza virus
LFGAKAGFIEN

SEQ ID NO: 530360 - protein, 11 aa, Influenza virus
LFIKDYRYTYR

SEQ ID NO: 530361 - protein, 11 aa, Influenza virus
LFLVCVSLLQS

SEQ ID NO: 530362 - protein, 11 aa, Influenza virus
LFLYVRTNGTS

SEQ ID NO: 530363 - protein, 11 aa, Influenza virus
LFMIIGGFIFG

SEQ ID NO: 530364 - protein, 11 aa, Influenza virus
LFNTIGNLIAP

SEQ ID NO: 530365 - protein, 11 aa, Influenza virus
LFQDILMRMSK

SEQ ID NO: 530366 - protein, 11 aa, Influenza virus
LFQGGHIEECS

SEQ ID NO: 530367 - protein, 11 aa, Influenza virus
LFQQMRDILGT

SEQ ID NO: 530368 - protein, 11 aa, Influenza virus
LFQQMRDVLGT

SEQ ID NO: 530369 - protein, 11 aa, Influenza virus
LFSGIKSFSRT

SEQ ID NO: 530370 - protein, 11 aa, Influenza virus
LFSGIRSFSRT

SEQ ID NO: 530371 - protein, 11 aa, Influenza virus
LFSGVNSFSRT

SEQ ID NO: 530372 - protein, 11 aa, Influenza virus
LFSGYKDIILW

SEQ ID NO: 530373 - protein, 11 aa, Influenza virus
LFSSIKKYERV

SEQ ID NO: 530374 - protein, 11 aa, Influenza virus
LFSSIKRYERV

SEQ ID NO: 530375 - protein, 11 aa, Influenza virus
LFTLSGVAIAL

SEQ ID NO: 530376 - protein, 11 aa, Influenza virus
LFVLMENERTL

SEQ ID NO: 530377 - protein, 11 aa, Influenza virus
LFVQSYFQLFL

SEQ ID NO: 530378 - protein, 11 aa, Influenza virus
LGAIAGFIEGG

SEQ ID NO: 530379 - protein, 11 aa, Influenza virus
LGAINTTLPFH

SEQ ID NO: 530380 - protein, 11 aa, Influenza virus
LGAISFWMCSG

SEQ ID NO: 530381 - protein, 11 aa, Influenza virus
LGAISFWMCSN

SEQ ID NO: 530382 - protein, 11 aa, Influenza virus
LGALNTTLPFH

SEQ ID NO: 530383 - protein, 11 aa, Influenza virus
LGAPLELRDCK

SEQ ID NO: 530384 - protein, 11 aa, Influenza virus
LGAPLVLDDCS

SEQ ID NO: 530385 - protein, 11 aa, Influenza virus
LGAVSFWMCSN

SEQ ID NO: 530386 - protein, 11 aa, Influenza virus
LGCKMYALHQG

SEQ ID NO: 530387 - protein, 11 aa, Influenza virus
LGCRMYALHQG

SEQ ID NO: 530388 - protein, 11 aa, Influenza virus
LGDAPFLDRLR

SEQ ID NO: 530389 - protein, 11 aa, Influenza virus
LGDCNFEGWIV

SEQ ID NO: 530390 - protein, 11 aa, Influenza virus
LGDCPKYIKSG

SEQ ID NO: 530391 - protein, 11 aa, Influenza virus
LGDCRFEGWIV

SEQ ID NO: 530392 - protein, 11 aa, Influenza virus
LGDCSFAGWIL

SEQ ID NO: 530393 - protein, 11 aa, Influenza virus
LGDCSFAGWLL

SEQ ID NO: 530394 - protein, 11 aa, Influenza virus
LGDCSFEGWIG

SEQ ID NO: 530395 - protein, 11 aa, Influenza virus
LGDCSFEGWIV

SEQ ID NO: 530396 - protein, 11 aa, Influenza virus
LGDCSIAGWLL

SEQ ID NO: 530397 - protein, 11 aa, Influenza virus
LGECPKYIKSD

SEQ ID NO: 530398 - protein, 11 aa, Influenza virus
LGENIAPEKVD

SEQ ID NO: 530399 - protein, 11 aa, Influenza virus
LGENMAPEKID

SEQ ID NO: 530400 - protein, 11 aa, Influenza virus
LGENMAPEKMD

SEQ ID NO: 530401 - protein, 11 aa, Influenza virus
LGENMAPEKVD

SEQ ID NO: 530402 - protein, 11 aa, Influenza virus
LGFIMWACQKG

SEQ ID NO: 530403 - protein, 11 aa, Influenza virus
LGFIMWACQRG

SEQ ID NO: 530404 - protein, 11 aa, Influenza virus
LGFIMWTCQKG

SEQ ID NO: 530405 - protein, 11 aa, Influenza virus
LGFIVWACQRG

SEQ ID NO: 530406 - protein, 11 aa, Influenza virus
LGFVFTLTVPS

SEQ ID NO: 530407 - protein, 11 aa, Influenza virus
LGFVLWACQNG

SEQ ID NO: 530408 - protein, 11 aa, Influenza virus
LGFVMWACQKG

SEQ ID NO: 530409 - protein, 11 aa, Influenza virus
LGGCSFAGWIL

SEQ ID NO: 530410 - protein, 11 aa, Influenza virus
LGGTISPRSRS

SEQ ID NO: 530411 - protein, 11 aa, Influenza virus
LGHHAIPNGTI

SEQ ID NO: 530412 - protein, 11 aa, Influenza virus
LGHHAVANGTI

SEQ ID NO: 530413 - protein, 11 aa, Influenza virus
LGHHAVANGTK

SEQ ID NO: 530414 - protein, 11 aa, Influenza virus
LGHHAVANGTR

SEQ ID NO: 530415 - protein, 11 aa, Influenza virus
LGHHAVANGTV

SEQ ID NO: 530416 - protein, 11 aa, Influenza virus
LGHHAVENGTS

SEQ ID NO: 530417 - protein, 11 aa, Influenza virus
LGHHAVPNGTI

SEQ ID NO: 530418 - protein, 11 aa, Influenza virus
LGHHAVPNGTK

SEQ ID NO: 530419 - protein, 11 aa, Influenza virus
LGHHAVPNGTL

SEQ ID NO: 530420 - protein, 11 aa, Influenza virus
LGHHAVPNGTM

SEQ ID NO: 530421 - protein, 11 aa, Influenza virus
LGHHAVPNGTV

SEQ ID NO: 530422 - protein, 11 aa, Influenza virus
LGHHAVSNGTI

SEQ ID NO: 530423 - protein, 11 aa, Influenza virus
LGHHAVSNGTK

SEQ ID NO: 530424 - protein, 11 aa, Influenza virus
LGHHAVTNGTK

SEQ ID NO: 530425 - protein, 11 aa, Influenza virus
LGIINLLIGIS

SEQ ID NO: 530426 - protein, 11 aa, Influenza virus
LGIITGPPQCD

SEQ ID NO: 530427 - protein, 11 aa, Influenza virus
LGILTGPPQCD

SEQ ID NO: 530428 - protein, 11 aa, Influenza virus
LGINMSKKKSY

SEQ ID NO: 530429 - protein, 11 aa, Influenza virus
LGIPFHLGTKQ

SEQ ID NO: 530430 - protein, 11 aa, Influenza virus
LGIQSDAQIDE

SEQ ID NO: 530431 - protein, 11 aa, Influenza virus
LGITGPDATAV

SEQ ID NO: 530432 - protein, 11 aa, Influenza virus
LGITGPDSTAV

SEQ ID NO: 530433 - protein, 11 aa, Influenza virus
LGITGPDTTAV

SEQ ID NO: 530434 - protein, 11 aa, Influenza virus
LGKVECVCRDN

SEQ ID NO: 530435 - protein, 11 aa, Influenza virus
LGLDIRTATRE

SEQ ID NO: 530436 - protein, 11 aa, Influenza virus
LGLHDANVRNL

SEQ ID NO: 530437 - protein, 11 aa, Influenza virus
LGLNIGLHLKP

SEQ ID NO: 530438 - protein, 11 aa, Influenza virus
LGLNIGLHLRP

SEQ ID NO: 530439 - protein, 11 aa, Influenza virus
LGLNVGLHLKP

SEQ ID NO: 530440 - protein, 11 aa, Influenza virus
LGLRISSSFSF

SEQ ID NO: 530441 - protein, 11 aa, Influenza virus
LGLRNTPSIEP

SEQ ID NO: 530442 - protein, 11 aa, Influenza virus
LGLSMVKSDKI

SEQ ID NO: 530443 - protein, 11 aa, Influenza virus
LGLSMVRSDKI

SEQ ID NO: 530444 - protein, 11 aa, Influenza virus
LGLVCATCEQI

SEQ ID NO: 530445 - protein, 11 aa, Influenza virus
LGMKNVPEKIH

SEQ ID NO: 530446 - protein, 11 aa, Influenza virus
LGMKNVPEKIR

SEQ ID NO: 530447 - protein, 11 aa, Influenza virus
LGMQNGSCRCM

SEQ ID NO: 530448 - protein, 11 aa, Influenza virus
LGMQNGSYRCM

SEQ ID NO: 530449 - protein, 11 aa, Influenza virus
LGNCPKYIKSG

SEQ ID NO: 530450 - protein, 11 aa, Influenza virus
LGNCSIAGWLL

SEQ ID NO: 530451 - protein, 11 aa, Influenza virus
LGNGCFEFWHK

SEQ ID NO: 530452 - protein, 11 aa, Influenza virus
LGNGCFEFWHR

SEQ ID NO: 530453 - protein, 11 aa, Influenza virus
LGNGCFEFYHK

SEQ ID NO: 530454 - protein, 11 aa, Influenza virus
LGNGCFEFYHR

SEQ ID NO: 530455 - protein, 11 aa, Influenza virus
LGNGCFKIYHK

SEQ ID NO: 530456 - protein, 11 aa, Influenza virus
LGNLNKKMEDG

SEQ ID NO: 530457 - protein, 11 aa, Influenza virus
LGNPECDRLLI

SEQ ID NO: 530458 - protein, 11 aa, Influenza virus
LGNPECDRLLN

SEQ ID NO: 530459 - protein, 11 aa, Influenza virus
LGNPECDRLLR

SEQ ID NO: 530460 - protein, 11 aa, Influenza virus
LGNPECDRLLS

SEQ ID NO: 530461 - protein, 11 aa, Influenza virus
LGNPECDRLLT

SEQ ID NO: 530462 - protein, 11 aa, Influenza virus
LGNPKCDLYLN

SEQ ID NO: 530463 - protein, 11 aa, Influenza virus
LGNPKCDLYLS

SEQ ID NO: 530464 - protein, 11 aa, Influenza virus
LGNPKCDPYLN

SEQ ID NO: 530465 - protein, 11 aa, Influenza virus
LGNPMCDDLIG

SEQ ID NO: 530466 - protein, 11 aa, Influenza virus
LGNPMCDELIG

SEQ ID NO: 530467 - protein, 11 aa, Influenza virus
LGNPMCDNLIG

SEQ ID NO: 530468 - protein, 11 aa, Influenza virus
LGNPMCDYLIG

SEQ ID NO: 530469 - protein, 11 aa, Influenza virus
LGNPRCDDLIG

SEQ ID NO: 530470 - protein, 11 aa, Influenza virus
LGNVINWTRDS

SEQ ID NO: 530471 - protein, 11 aa, Influenza virus
LGNYKEICIAW

SEQ ID NO: 530472 - protein, 11 aa, Influenza virus
LGNYKEICVAW

SEQ ID NO: 530473 - protein, 11 aa, Influenza virus
LGNYKEIRIAW

SEQ ID NO: 530474 - protein, 11 aa, Influenza virus
LGNYREICIAW

SEQ ID NO: 530475 - protein, 11 aa, Influenza virus
LGNYREVCIAW

SEQ ID NO: 530476 - protein, 11 aa, Influenza virus
LGPATAQMALQ

SEQ ID NO: 530477 - protein, 11 aa, Influenza virus
LGQFPVQTDEY

SEQ ID NO: 530478 - protein, 11 aa, Influenza virus
LGQGTTLDNEH

SEQ ID NO: 530479 - protein, 11 aa, Influenza virus
LGQGTTLDNKH

SEQ ID NO: 530480 - protein, 11 aa, Influenza virus
LGQGTTLENKH

SEQ ID NO: 530481 - protein, 11 aa, Influenza virus
LGQGTTLNNKH

SEQ ID NO: 530482 - protein, 11 aa, Influenza virus
LGQGTTLYNKH

SEQ ID NO: 530483 - protein, 11 aa, Influenza virus
LGQVECVCRDN

SEQ ID NO: 530484 - protein, 11 aa, Influenza virus
LGQWDWPDGAK

SEQ ID NO: 530485 - protein, 11 aa, Influenza virus
LGQWNWPDGAE

SEQ ID NO: 530486 - protein, 11 aa, Influenza virus
LGQWNWPDGAK

SEQ ID NO: 530487 - protein, 11 aa, Influenza virus
LGRTFSPRSRS

SEQ ID NO: 530488 - protein, 11 aa, Influenza virus
LGRTISKDLRS

SEQ ID NO: 530489 - protein, 11 aa, Influenza virus
LGRTISKDSRS

SEQ ID NO: 530490 - protein, 11 aa, Influenza virus
LGRTISKDTRS

SEQ ID NO: 530491 - protein, 11 aa, Influenza virus
LGRTISPKLRS

SEQ ID NO: 530492 - protein, 11 aa, Influenza virus
LGRTISPRLRS

SEQ ID NO: 530493 - protein, 11 aa, Influenza virus
LGRTISPRSRN

SEQ ID NO: 530494 - protein, 11 aa, Influenza virus
LGRTISPRSRS

SEQ ID NO: 530495 - protein, 11 aa, Influenza virus
LGRTISYSSRS

SEQ ID NO: 530496 - protein, 11 aa, Influenza virus
LGRTTSKDSRS

SEQ ID NO: 530497 - protein, 11 aa, Influenza virus
LGRTVSINGRS

SEQ ID NO: 530498 - protein, 11 aa, Influenza virus
LGRTVSISGRS

SEQ ID NO: 530499 - protein, 11 aa, Influenza virus
LGRTVSNSGRS

SEQ ID NO: 530500 - protein, 11 aa, Influenza virus
LGRTVSTSGRS

SEQ ID NO: 530501 - protein, 11 aa, Influenza virus
LGSAQHVEECS

SEQ ID NO: 530502 - protein, 11 aa, Influenza virus
LGSCGILGTII

SEQ ID NO: 530503 - protein, 11 aa, Influenza virus
LGSPGCDRLQD

SEQ ID NO: 530504 - protein, 11 aa, Influenza virus
LGSPLELRDCK

SEQ ID NO: 530505 - protein, 11 aa, Influenza virus
LGSPLVLDDCS

SEQ ID NO: 530506 - protein, 11 aa, Influenza virus
LGSPPIVSNSD

SEQ ID NO: 530507 - protein, 11 aa, Influenza virus
LGSPPIVSNSE

SEQ ID NO: 530508 - protein, 11 aa, Influenza virus
LGSPPMVSNSD

SEQ ID NO: 530509 - protein, 11 aa, Influenza virus
LGSPPVVSNSD

SEQ ID NO: 530510 - protein, 11 aa, Influenza virus
LGSSFYAEMKW

SEQ ID NO: 530511 - protein, 11 aa, Influenza virus
LGSSPNAYQAK

SEQ ID NO: 530512 - protein, 11 aa, Influenza virus
LGSSPNAYQAQ

SEQ ID NO: 530513 - protein, 11 aa, Influenza virus
LGSSPNAYQAR

SEQ ID NO: 530514 - protein, 11 aa, Influenza virus
LGSSSNAYQAK

SEQ ID NO: 530515 - protein, 11 aa, Influenza virus
LGSWSWHDGAE

SEQ ID NO: 530516 - protein, 11 aa, Influenza virus
LGTIIGPPQCD

SEQ ID NO: 530517 - protein, 11 aa, Influenza virus
LGTITGPPQCD

SEQ ID NO: 530518 - protein, 11 aa, Influenza virus
LGTKQVCAAWS

SEQ ID NO: 530519 - protein, 11 aa, Influenza virus
LGTKQVCIAWS

SEQ ID NO: 530520 - protein, 11 aa, Influenza virus
LGTKQVCMAWS

SEQ ID NO: 530521 - protein, 11 aa, Influenza virus
LGTKQVCVAWS

SEQ ID NO: 530522 - protein, 11 aa, Influenza virus
LGTLIGPPQCD

SEQ ID NO: 530523 - protein, 11 aa, Influenza virus
LGTPLELRDCK

SEQ ID NO: 530524 - protein, 11 aa, Influenza virus
LGTPPTVSNSD

SEQ ID NO: 530525 - protein, 11 aa, Influenza virus
LGTRQVCIAWS

SEQ ID NO: 530526 - protein, 11 aa, Influenza virus
LGTRQVCMAWS

SEQ ID NO: 530527 - protein, 11 aa, Influenza virus
LGTRQVCVAWS

SEQ ID NO: 530528 - protein, 11 aa, Influenza virus
LGTVTGPPQCD

SEQ ID NO: 530529 - protein, 11 aa, Influenza virus
LGVPFHLATKQ

SEQ ID NO: 530530 - protein, 11 aa, Influenza virus
LGVPFHLGTKQ

SEQ ID NO: 530531 - protein, 11 aa, Influenza virus
LGVPFHLGTRQ

SEQ ID NO: 530532 - protein, 11 aa, Influenza virus
LGVPFYLGTKQ

SEQ ID NO: 530533 - protein, 11 aa, Influenza virus
LGVSFHLGTKQ

SEQ ID NO: 530534 - protein, 11 aa, Influenza virus
LGVSILNLGQK

SEQ ID NO: 530535 - protein, 11 aa, Influenza virus
LGVSILNLGQR

SEQ ID NO: 530536 - protein, 11 aa, Influenza virus
LGVSVLNLGQK

SEQ ID NO: 530537 - protein, 11 aa, Influenza virus
LGVWTYNAELL

SEQ ID NO: 530538 - protein, 11 aa, Influenza virus
LGYETFKVIGG

SEQ ID NO: 530539 - protein, 11 aa, Influenza virus
LGYGVKGFGFR

SEQ ID NO: 530540 - protein, 11 aa, Influenza virus
LGYSTGALASC

SEQ ID NO: 530541 - protein, 11 aa, Influenza virus
LHDANVKNLHD

SEQ ID NO: 530542 - protein, 11 aa, Influenza virus
LHDANVKNLHE

SEQ ID NO: 530543 - protein, 11 aa, Influenza virus
LHDANVRNLHD

SEQ ID NO: 530544 - protein, 11 aa, Influenza virus
LHDANVRNLHE

SEQ ID NO: 530545 - protein, 11 aa, Influenza virus
LHDSNVKNLYD

SEQ ID NO: 530546 - protein, 11 aa, Influenza virus
LHDSNVKNLYN

SEQ ID NO: 530547 - protein, 11 aa, Influenza virus
LHDSNVRNLHE

SEQ ID NO: 530548 - protein, 11 aa, Influenza virus
LHDSNVRSLHE

SEQ ID NO: 530549 - protein, 11 aa, Influenza virus
LHDSNVTNLHE

SEQ ID NO: 530550 - protein, 11 aa, Influenza virus
LHERVRKQLRE

SEQ ID NO: 530551 - protein, 11 aa, Influenza virus
LHICVTGDDRN

SEQ ID NO: 530552 - protein, 11 aa, Influenza virus
LHIPEAGLKWE

SEQ ID NO: 530553 - protein, 11 aa, Influenza virus
LHIPEVCLKWD

SEQ ID NO: 530554 - protein, 11 aa, Influenza virus
LHIPEVCLKWE

SEQ ID NO: 530555 - protein, 11 aa, Influenza virus
LHIPEVCLKWG

SEQ ID NO: 530556 - protein, 11 aa, Influenza virus
LHKCDNECMET

SEQ ID NO: 530557 - protein, 11 aa, Influenza virus
LHKCDNKCMET

SEQ ID NO: 530558 - protein, 11 aa, Influenza virus
LHKCNDSCMDT

SEQ ID NO: 530559 - protein, 11 aa, Influenza virus
LHKCNDSCMEA

SEQ ID NO: 530560 - protein, 11 aa, Influenza virus
LHKCNDSCMET

SEQ ID NO: 530561 - protein, 11 aa, Influenza virus
LHKCNNECMET

SEQ ID NO: 530562 - protein, 11 aa, Influenza virus
LHKCNNSCMET

SEQ ID NO: 530563 - protein, 11 aa, Influenza virus
LHKCNNTCMET

SEQ ID NO: 530564 - protein, 11 aa, Influenza virus
LHLEFKADLII

SEQ ID NO: 530565 - protein, 11 aa, Influenza virus
LHLTGIWDTLI

SEQ ID NO: 530566 - protein, 11 aa, Influenza virus
LHLTGKWDTLI

SEQ ID NO: 530567 - protein, 11 aa, Influenza virus
LHLTGTWDTLI

SEQ ID NO: 530568 - protein, 11 aa, Influenza virus
LHLTQGACWEQ

SEQ ID NO: 530569 - protein, 11 aa, Influenza virus
LHLTQGTCWEQ

SEQ ID NO: 530570 - protein, 11 aa, Influenza virus
LHNGGLIAPSR

SEQ ID NO: 530571 - protein, 11 aa, Influenza virus
LHNIHPLTIGE

SEQ ID NO: 530572 - protein, 11 aa, Influenza virus
LHQGTTIRNKH

SEQ ID NO: 530573 - protein, 11 aa, Influenza virus
LHQGTTIRNRH

SEQ ID NO: 530574 - protein, 11 aa, Influenza virus
LHVCITGDDRN

SEQ ID NO: 530575 - protein, 11 aa, Influenza virus
LHVCVTGDDGN

SEQ ID NO: 530576 - protein, 11 aa, Influenza virus
LHVCVTGDDKN

SEQ ID NO: 530577 - protein, 11 aa, Influenza virus
LHVCVTGDDRN

SEQ ID NO: 530578 - protein, 11 aa, Influenza virus
LIAGGLILGMQ

SEQ ID NO: 530579 - protein, 11 aa, Influenza virus
LIAGWYGFQHS

SEQ ID NO: 530580 - protein, 11 aa, Influenza virus
LIALCGSPFPV

SEQ ID NO: 530581 - protein, 11 aa, Influenza virus
LIALCGSPFSV

SEQ ID NO: 530582 - protein, 11 aa, Influenza virus
LIAMENQHTID

SEQ ID NO: 530583 - protein, 11 aa, Influenza virus
LIAPEFGYLLK

SEQ ID NO: 530584 - protein, 11 aa, Influenza virus
LIAPEFGYLLR

SEQ ID NO: 530585 - protein, 11 aa, Influenza virus
LIAPEYGFKIS

SEQ ID NO: 530586 - protein, 11 aa, Influenza virus
LIAPEYGFRIS

SEQ ID NO: 530587 - protein, 11 aa, Influenza virus
LIAPEYGHLIT

SEQ ID NO: 530588 - protein, 11 aa, Influenza virus
LIAPEYGHLTT

SEQ ID NO: 530589 - protein, 11 aa, Influenza virus
LIAPEYGHLVT

SEQ ID NO: 530590 - protein, 11 aa, Influenza virus
LIAPEYGYLIT

SEQ ID NO: 530591 - protein, 11 aa, Influenza virus
LIAPRGHYKIS

SEQ ID NO: 530592 - protein, 11 aa, Influenza virus
LIAPRYGYIIE

SEQ ID NO: 530593 - protein, 11 aa, Influenza virus
LICATCEQIAD

SEQ ID NO: 530594 - protein, 11 aa, Influenza virus
LIDALLGDPHC

SEQ ID NO: 530595 - protein, 11 aa, Influenza virus
LIDALLGDPQC

SEQ ID NO: 530596 - protein, 11 aa, Influenza virus
LIDGWYGFKHQ

SEQ ID NO: 530597 - protein, 11 aa, Influenza virus
LIDGWYGFRHQ

SEQ ID NO: 530598 - protein, 11 aa, Influenza virus
LIDGWYGYHHE

SEQ ID NO: 530599 - protein, 11 aa, Influenza virus
LIDGWYGYKHQ

SEQ ID NO: 530600 - protein, 11 aa, Influenza virus
LIDGWYGYRHQ

SEQ ID NO: 530601 - protein, 11 aa, Influenza virus
LIDKTNQQFEL

SEQ ID NO: 530602 - protein, 11 aa, Influenza virus
LIDKTNQQFEM

SEQ ID NO: 530603 - protein, 11 aa, Influenza virus
LIDNEFTEVEQ

SEQ ID NO: 530604 - protein, 11 aa, Influenza virus
LIDSIGSWSQN

SEQ ID NO: 530605 - protein, 11 aa, Influenza virus
LIDSLLGDPHC

SEQ ID NO: 530606 - protein, 11 aa, Influenza virus
LIEDPAAPHGL

SEQ ID NO: 530607 - protein, 11 aa, Influenza virus
LIEDPGAPHGL

SEQ ID NO: 530608 - protein, 11 aa, Influenza virus
LIEDPNAPHKL

SEQ ID NO: 530609 - protein, 11 aa, Influenza virus
LIEDPNAPNKF

SEQ ID NO: 530610 - protein, 11 aa, Influenza virus
LIEDPNAPNKL

SEQ ID NO: 530611 - protein, 11 aa, Influenza virus
LIEDPSAPHGL

SEQ ID NO: 530612 - protein, 11 aa, Influenza virus
LIEDPSAPHRL

SEQ ID NO: 530613 - protein, 11 aa, Influenza virus
LIEDPTAPHGL

SEQ ID NO: 530614 - protein, 11 aa, Influenza virus
LIEKTNDKYHQ

SEQ ID NO: 530615 - protein, 11 aa, Influenza virus
LIEKTNEKYHQ

SEQ ID NO: 530616 - protein, 11 aa, Influenza virus
LIEKTNKQFEL

SEQ ID NO: 530617 - protein, 11 aa, Influenza virus
LIEKTNQQFEL

SEQ ID NO: 530618 - protein, 11 aa, Influenza virus
LIEKTNTEFES

SEQ ID NO: 530619 - protein, 11 aa, Influenza virus
LIEKTNTQFEL

SEQ ID NO: 530620 - protein, 11 aa, Influenza virus
LIENDRTLDLH

SEQ ID NO: 530621 - protein, 11 aa, Influenza virus
LIENERTLDLH

SEQ ID NO: 530622 - protein, 11 aa, Influenza virus
LIENLQAYQKR

SEQ ID NO: 530623 - protein, 11 aa, Influenza virus
LIENQKTLDEH

SEQ ID NO: 530624 - protein, 11 aa, Influenza virus
LIENTYVNNTT

SEQ ID NO: 530625 - protein, 11 aa, Influenza virus
LIEQNIPVTQV

SEQ ID NO: 530626 - protein, 11 aa, Influenza virus
LIEQNVPVTQV

SEQ ID NO: 530627 - protein, 11 aa, Influenza virus
LIERTNEKYHQ

SEQ ID NO: 530628 - protein, 11 aa, Influenza virus
LIERTNQQFEL

SEQ ID NO: 530629 - protein, 11 aa, Influenza virus
LIETNHTGTYC

SEQ ID NO: 530630 - protein, 11 aa, Influenza virus
LIETTHTGTYC

SEQ ID NO: 530631 - protein, 11 aa, Influenza virus
LIFLARSALIL

SEQ ID NO: 530632 - protein, 11 aa, Influenza virus
LIFLARSALVL

SEQ ID NO: 530633 - protein, 11 aa, Influenza virus
LIFMARSALIL

SEQ ID NO: 530634 - protein, 11 aa, Influenza virus
LIFMCVKNGNL

SEQ ID NO: 530635 - protein, 11 aa, Influenza virus
LIFMCVKNGNM

SEQ ID NO: 530636 - protein, 11 aa, Influenza virus
LIFSARSALIL

SEQ ID NO: 530637 - protein, 11 aa, Influenza virus
LIGISNVGLKV

SEQ ID NO: 530638 - protein, 11 aa, Influenza virus
LIGISNVGLNV

SEQ ID NO: 530639 - protein, 11 aa, Influenza virus
LIGKNSWSYIV

SEQ ID NO: 530640 - protein, 11 aa, Influenza virus
LIGKTNQQFEL

SEQ ID NO: 530641 - protein, 11 aa, Influenza virus
LIGKTSWSYIV

SEQ ID NO: 530642 - protein, 11 aa, Influenza virus
LIGQGDIVLVM

SEQ ID NO: 530643 - protein, 11 aa, Influenza virus
LIGQGDVVLVM

SEQ ID NO: 530644 - protein, 11 aa, Influenza virus
LIGRTNQQFEL

SEQ ID NO: 530645 - protein, 11 aa, Influenza virus
LIIAARNIVRR

SEQ ID NO: 530646 - protein, 11 aa, Influenza virus
LIIAARSIVRR

SEQ ID NO: 530647 - protein, 11 aa, Influenza virus
LIIERRNSSDI

SEQ ID NO: 530648 - protein, 11 aa, Influenza virus
LIIGISNVGLN

SEQ ID NO: 530649 - protein, 11 aa, Influenza virus
LIIWGIHHPSS

SEQ ID NO: 530650 - protein, 11 aa, Influenza virus
LIKHENRMVLA

SEQ ID NO: 530651 - protein, 11 aa, Influenza virus
LILAFILWACS

SEQ ID NO: 530652 - protein, 11 aa, Influenza virus
LILAFIMWACS

SEQ ID NO: 530653 - protein, 11 aa, Influenza virus
LILFNTIGNLI

SEQ ID NO: 530654 - protein, 11 aa, Influenza virus
LILGFVLWACQ

SEQ ID NO: 530655 - protein, 11 aa, Influenza virus
LILGMQNGSCR

SEQ ID NO: 530656 - protein, 11 aa, Influenza virus
LILGMQNGSYR

SEQ ID NO: 530657 - protein, 11 aa, Influenza virus
LILGNPKCDLY

SEQ ID NO: 530658 - protein, 11 aa, Influenza virus
LILGNPKCDPY

SEQ ID NO: 530659 - protein, 11 aa, Influenza virus
LILKDCSIAGW

SEQ ID NO: 530660 - protein, 11 aa, Influenza virus
LILKDCSVAGW

SEQ ID NO: 530661 - protein, 11 aa, Influenza virus
LILLENERTLD

SEQ ID NO: 530662 - protein, 11 aa, Influenza virus
LILRDCSVAGW

SEQ ID NO: 530663 - protein, 11 aa, Influenza virus
LILRGAVAHKS

SEQ ID NO: 530664 - protein, 11 aa, Influenza virus
LILRGSIAHKS

SEQ ID NO: 530665 - protein, 11 aa, Influenza virus
LILRGSVAHKS

SEQ ID NO: 530666 - protein, 11 aa, Influenza virus
LILSNPKCDLY

SEQ ID NO: 530667 - protein, 11 aa, Influenza virus
LILVALALSHT

SEQ ID NO: 530668 - protein, 11 aa, Influenza virus
LIMRTVIALSY

SEQ ID NO: 530669 - protein, 11 aa, Influenza virus
LIMWGIHHPSS

SEQ ID NO: 530670 - protein, 11 aa, Influenza virus
LINDPWVLLNA

SEQ ID NO: 530671 - protein, 11 aa, Influenza virus
LINGALGSPGC

SEQ ID NO: 530672 - protein, 11 aa, Influenza virus
LINGWYGFQHQ

SEQ ID NO: 530673 - protein, 11 aa, Influenza virus
LINGWYGFQHR

SEQ ID NO: 530674 - protein, 11 aa, Influenza virus
LINGWYGFRHQ

SEQ ID NO: 530675 - protein, 11 aa, Influenza virus
LINTYQWIIRN

SEQ ID NO: 530676 - protein, 11 aa, Influenza virus
LIPMISKCKTK

SEQ ID NO: 530677 - protein, 11 aa, Influenza virus
LIPMISKCRTK

SEQ ID NO: 530678 - protein, 11 aa, Influenza virus
LIPMISKCRTR

SEQ ID NO: 530679 - protein, 11 aa, Influenza virus
LIPMISKSRTK

SEQ ID NO: 530680 - protein, 11 aa, Influenza virus
LIPMISNCRTK

SEQ ID NO: 530681 - protein, 11 aa, Influenza virus
LIQGYKDIILW

SEQ ID NO: 530682 - protein, 11 aa, Influenza virus
LIRALTLNTMT

SEQ ID NO: 530683 - protein, 11 aa, Influenza virus
LIRGNSPIFNY

SEQ ID NO: 530684 - protein, 11 aa, Influenza virus
LIRGNSPVFNY

SEQ ID NO: 530685 - protein, 11 aa, Influenza virus
LIRGQQGRMDY

SEQ ID NO: 530686 - protein, 11 aa, Influenza virus
LIRGRPEEAKY

SEQ ID NO: 530687 - protein, 11 aa, Influenza virus
LIRGRPEEVKY

SEQ ID NO: 530688 - protein, 11 aa, Influenza virus
LIRGRPKEDEV

SEQ ID NO: 530689 - protein, 11 aa, Influenza virus
LIRGRPKEDKV

SEQ ID NO: 530690 - protein, 11 aa, Influenza virus
LIRGRPKEDRV

SEQ ID NO: 530691 - protein, 11 aa, Influenza virus
LIRGRPKEEKV

SEQ ID NO: 530692 - protein, 11 aa, Influenza virus
LIRHENRMVIA

SEQ ID NO: 530693 - protein, 11 aa, Influenza virus
LIRHENRMVLA

SEQ ID NO: 530694 - protein, 11 aa, Influenza virus
LIRMIKRGIND

SEQ ID NO: 530695 - protein, 11 aa, Influenza virus
LIRMIKRGVND

SEQ ID NO: 530696 - protein, 11 aa, Influenza virus
LIRMVKRGIND

SEQ ID NO: 530697 - protein, 11 aa, Influenza virus
LIRTLTLNTMT

SEQ ID NO: 530698 - protein, 11 aa, Influenza virus
LISDGGPNLYN

SEQ ID NO: 530699 - protein, 11 aa, Influenza virus
LISKTNQQFEL

SEQ ID NO: 530700 - protein, 11 aa, Influenza virus
LISTPLGSPPI

SEQ ID NO: 530701 - protein, 11 aa, Influenza virus
LISTPLGSPPM

SEQ ID NO: 530702 - protein, 11 aa, Influenza virus
LISTPLGSPPV

SEQ ID NO: 530703 - protein, 11 aa, Influenza virus
LISTPLGTPPT

SEQ ID NO: 530704 - protein, 11 aa, Influenza virus
LISWEMGLAPS

SEQ ID NO: 530705 - protein, 11 aa, Influenza virus
LISWEMGQAPS

SEQ ID NO: 530706 - protein, 11 aa, Influenza virus
LISWGMGQAPS

SEQ ID NO: 530707 - protein, 11 aa, Influenza virus
LISWPLSSPPT

SEQ ID NO: 530708 - protein, 11 aa, Influenza virus
LISWPQSSPPT

SEQ ID NO: 530709 - protein, 11 aa, Influenza virus
LITDGPSDAQA

SEQ ID NO: 530710 - protein, 11 aa, Influenza virus
LITDGPSNAQA

SEQ ID NO: 530711 - protein, 11 aa, Influenza virus
LITGKSHGRIL

SEQ ID NO: 530712 - protein, 11 aa, Influenza virus
LITGKSHGRVL

SEQ ID NO: 530713 - protein, 11 aa, Influenza virus
LITVGSSKYQQ

SEQ ID NO: 530714 - protein, 11 aa, Influenza virus
LITVGSSKYRQ

SEQ ID NO: 530715 - protein, 11 aa, Influenza virus
LITWGIHHPSS

SEQ ID NO: 530716 - protein, 11 aa, Influenza virus
LIVFNTIGNLI

SEQ ID NO: 530717 - protein, 11 aa, Influenza virus
LIVFNTIGNLV

SEQ ID NO: 530718 - protein, 11 aa, Influenza virus
LIVLLENQKTL

SEQ ID NO: 530719 - protein, 11 aa, Influenza virus
LIVSLGAISFW

SEQ ID NO: 530720 - protein, 11 aa, Influenza virus
LIVWGIHHPSS

SEQ ID NO: 530721 - protein, 11 aa, Influenza virus
LIVWGVHHSSS

SEQ ID NO: 530722 - protein, 11 aa, Influenza virus
LIWLWLVLREK

SEQ ID NO: 530723 - protein, 11 aa, Influenza virus
LIWMACHSAAF

SEQ ID NO: 530724 - protein, 11 aa, Influenza virus
LKAEIAQKLED

SEQ ID NO: 530725 - protein, 11 aa, Influenza virus
LKAEIAQRLED

SEQ ID NO: 530726 - protein, 11 aa, Influenza virus
LKAEIAQRLEG

SEQ ID NO: 530727 - protein, 11 aa, Influenza virus
LKAEIAQRLEN

SEQ ID NO: 530728 - protein, 11 aa, Influenza virus
LKAEIAQRLES

SEQ ID NO: 530729 - protein, 11 aa, Influenza virus
LKDCSVAGWLL

SEQ ID NO: 530730 - protein, 11 aa, Influenza virus
LKDEEKIPKTK

SEQ ID NO: 530731 - protein, 11 aa, Influenza virus
LKDGNMRCTIC

SEQ ID NO: 530732 - protein, 11 aa, Influenza virus
LKDNAIDEGDG

SEQ ID NO: 530733 - protein, 11 aa, Influenza virus
LKDNAKDEGNG

SEQ ID NO: 530734 - protein, 11 aa, Influenza virus
LKDNAKDLGNG

SEQ ID NO: 530735 - protein, 11 aa, Influenza virus
LKDNAKEIGNG

SEQ ID NO: 530736 - protein, 11 aa, Influenza virus
LKDNAKELGNG

SEQ ID NO: 530737 - protein, 11 aa, Influenza virus
LKDNANDLGNG

SEQ ID NO: 530738 - protein, 11 aa, Influenza virus
LKDNARELGNG

SEQ ID NO: 530739 - protein, 11 aa, Influenza virus
LKDNLEPGTFD

SEQ ID NO: 530740 - protein, 11 aa, Influenza virus
LKDQAWSYIVE

SEQ ID NO: 530741 - protein, 11 aa, Influenza virus
LKDQDWSYIVE

SEQ ID NO: 530742 - protein, 11 aa, Influenza virus
LKDQGWSYIVE

SEQ ID NO: 530743 - protein, 11 aa, Influenza virus
LKDQSWSYIVE

SEQ ID NO: 530744 - protein, 11 aa, Influenza virus
LKEQLSSVSSF

SEQ ID NO: 530745 - protein, 11 aa, Influenza virus
LKEQLSTVSSF

SEQ ID NO: 530746 - protein, 11 aa, Influenza virus
LKFKADLIIER

SEQ ID NO: 530747 - protein, 11 aa, Influenza virus
LKGKFQTAAQK

SEQ ID NO: 530748 - protein, 11 aa, Influenza virus
LKGKFQTAAQR

SEQ ID NO: 530749 - protein, 11 aa, Influenza virus
LKGLILGNPKC

SEQ ID NO: 530750 - protein, 11 aa, Influenza virus
LKGNAKDEGNG

SEQ ID NO: 530751 - protein, 11 aa, Influenza virus
LKGRHANGTIH

SEQ ID NO: 530752 - protein, 11 aa, Influenza virus
LKGSAKHIEEC

SEQ ID NO: 530753 - protein, 11 aa, Influenza virus
LKGSAMHIEEC

SEQ ID NO: 530754 - protein, 11 aa, Influenza virus
LKGSARHIEEC

SEQ ID NO: 530755 - protein, 11 aa, Influenza virus
LKGSARHIEEW

SEQ ID NO: 530756 - protein, 11 aa, Influenza virus
LKHNPTEEQAV

SEQ ID NO: 530757 - protein, 11 aa, Influenza virus
LKHRFEIIEGR

SEQ ID NO: 530758 - protein, 11 aa, Influenza virus
LKIPNAETDPN

SEQ ID NO: 530759 - protein, 11 aa, Influenza virus
LKIPNAETDPS

SEQ ID NO: 530760 - protein, 11 aa, Influenza virus
LKIPNAGIDPN

SEQ ID NO: 530761 - protein, 11 aa, Influenza virus
LKIPNAGTDPN

SEQ ID NO: 530762 - protein, 11 aa, Influenza virus
LKIRTNGNLIA

SEQ ID NO: 530763 - protein, 11 aa, Influenza virus
LKISSSFSFGG

SEQ ID NO: 530764 - protein, 11 aa, Influenza virus
LKITENSFEQI

SEQ ID NO: 530765 - protein, 11 aa, Influenza virus
LKKQEIEGIKL

SEQ ID NO: 530766 - protein, 11 aa, Influenza virus
LKLAIGLRNVP

SEQ ID NO: 530767 - protein, 11 aa, Influenza virus
LKLAIGPRNVP

SEQ ID NO: 530768 - protein, 11 aa, Influenza virus
LKLASGLRNVP

SEQ ID NO: 530769 - protein, 11 aa, Influenza virus
LKLATGLKNVP

SEQ ID NO: 530770 - protein, 11 aa, Influenza virus
LKLATGLRNIP

SEQ ID NO: 530771 - protein, 11 aa, Influenza virus
LKLATGLRNVP

SEQ ID NO: 530772 - protein, 11 aa, Influenza virus
LKLATGMRNIP

SEQ ID NO: 530773 - protein, 11 aa, Influenza virus
LKLATGMRNVP

SEQ ID NO: 530774 - protein, 11 aa, Influenza virus
LKLATGPRNVP

SEQ ID NO: 530775 - protein, 11 aa, Influenza virus
LKLGQFPVQTD

SEQ ID NO: 530776 - protein, 11 aa, Influenza virus
LKLVDGQDCDL

SEQ ID NO: 530777 - protein, 11 aa, Influenza virus
LKLVTGLRNVP

SEQ ID NO: 530778 - protein, 11 aa, Influenza virus
LKMPASRYLTD

SEQ ID NO: 530779 - protein, 11 aa, Influenza virus
LKMSLLTEVET

SEQ ID NO: 530780 - protein, 11 aa, Influenza virus
LKMTIASDILK

SEQ ID NO: 530781 - protein, 11 aa, Influenza virus
LKMTIASDILT

SEQ ID NO: 530782 - protein, 11 aa, Influenza virus
LKNGNMRCTIC

SEQ ID NO: 530783 - protein, 11 aa, Influenza virus
LKNNAIDEGDG

SEQ ID NO: 530784 - protein, 11 aa, Influenza virus
LKNNAKDEGNG

SEQ ID NO: 530785 - protein, 11 aa, Influenza virus
LKPGETLKVES

SEQ ID NO: 530786 - protein, 11 aa, Influenza virus
LKPGETLNIES

SEQ ID NO: 530787 - protein, 11 aa, Influenza virus
LKPGETLNVES

SEQ ID NO: 530788 - protein, 11 aa, Influenza virus
LKPGQTLRIIS

SEQ ID NO: 530789 - protein, 11 aa, Influenza virus
LKPGQTLRIRS

SEQ ID NO: 530790 - protein, 11 aa, Influenza virus
LKPGQTLRVKS

SEQ ID NO: 530791 - protein, 11 aa, Influenza virus
LKPGQTLRVRS

SEQ ID NO: 530792 - protein, 11 aa, Influenza virus
LKPGQTVKIKT

SEQ ID NO: 530793 - protein, 11 aa, Influenza virus
LKPGQTVKIQT

SEQ ID NO: 530794 - protein, 11 aa, Influenza virus
LKQNPTEEQAV

SEQ ID NO: 530795 - protein, 11 aa, Influenza virus
LKREITFHGAK

SEQ ID NO: 530796 - protein, 11 aa, Influenza virus
LKREITFYGAK

SEQ ID NO: 530797 - protein, 11 aa, Influenza virus
LKREMTFHGAK

SEQ ID NO: 530798 - protein, 11 aa, Influenza virus
LKRGETLKIRT

SEQ ID NO: 530799 - protein, 11 aa, Influenza virus
LKRNEIKGVEL

SEQ ID NO: 530800 - protein, 11 aa, Influenza virus
LKRNEIKGVKL

SEQ ID NO: 530801 - protein, 11 aa, Influenza virus
LKRQEIDGIKL

SEQ ID NO: 530802 - protein, 11 aa, Influenza virus
LKRQEIEGIKL

SEQ ID NO: 530803 - protein, 11 aa, Influenza virus
LKRQEIEGIRL

SEQ ID NO: 530804 - protein, 11 aa, Influenza virus
LKRQEINGIKL

SEQ ID NO: 530805 - protein, 11 aa, Influenza virus
LKRRAIATPGM

SEQ ID NO: 530806 - protein, 11 aa, Influenza virus
LKSDKRIGSCT

SEQ ID NO: 530807 - protein, 11 aa, Influenza virus
LKSEDNVYKVL

SEQ ID NO: 530808 - protein, 11 aa, Influenza virus
LKSEQFPVQTD

SEQ ID NO: 530809 - protein, 11 aa, Influenza virus
LKSGQFPVQTD

SEQ ID NO: 530810 - protein, 11 aa, Influenza virus
LKSLFSSIKKY

SEQ ID NO: 530811 - protein, 11 aa, Influenza virus
LKSNAIDEGDG

SEQ ID NO: 530812 - protein, 11 aa, Influenza virus
LKSTQAAIDKI

SEQ ID NO: 530813 - protein, 11 aa, Influenza virus
LKSTQAAIDQI

SEQ ID NO: 530814 - protein, 11 aa, Influenza virus
LKSTQAAINQI

SEQ ID NO: 530815 - protein, 11 aa, Influenza virus
LKSTQTAIDQI

SEQ ID NO: 530816 - protein, 11 aa, Influenza virus
LKSWKGNIMRT

SEQ ID NO: 530817 - protein, 11 aa, Influenza virus
LKTEDNIYKIL

SEQ ID NO: 530818 - protein, 11 aa, Influenza virus
LKTEDNVYKIL

SEQ ID NO: 530819 - protein, 11 aa, Influenza virus
LKTEDNVYKVL

SEQ ID NO: 530820 - protein, 11 aa, Influenza virus
LKTRPILSPLT

SEQ ID NO: 530821 - protein, 11 aa, Influenza virus
LKVESNGNLIA

SEQ ID NO: 530822 - protein, 11 aa, Influenza virus
LKVPNAGTDPN

SEQ ID NO: 530823 - protein, 11 aa, Influenza virus
LKVPNALTDDK

SEQ ID NO: 530824 - protein, 11 aa, Influenza virus
LKVPNALTDDR

SEQ ID NO: 530825 - protein, 11 aa, Influenza virus
LKVPNALTDER

SEQ ID NO: 530826 - protein, 11 aa, Influenza virus
LKVPNALTDNR

SEQ ID NO: 530827 - protein, 11 aa, Influenza virus
LKVPNALTNDR

SEQ ID NO: 530828 - protein, 11 aa, Influenza virus
LKWALGENMAP

SEQ ID NO: 530829 - protein, 11 aa, Influenza virus
LKWLISKSKEQ

SEQ ID NO: 530830 - protein, 11 aa, Influenza virus
LKWLVSKDKGR

SEQ ID NO: 530831 - protein, 11 aa, Influenza virus
LKWLVSKNKGQ

SEQ ID NO: 530832 - protein, 11 aa, Influenza virus
LKWLVSKSKGQ

SEQ ID NO: 530833 - protein, 11 aa, Influenza virus
LKWLVSKTKGQ

SEQ ID NO: 530834 - protein, 11 aa, Influenza virus
LKWTLGENMAP

SEQ ID NO: 530835 - protein, 11 aa, Influenza virus
LKWVLGENMAP

SEQ ID NO: 530836 - protein, 11 aa, Influenza virus
LKYNGIITDTL

SEQ ID NO: 530837 - protein, 11 aa, Influenza virus
LKYNGVITDTL

SEQ ID NO: 530838 - protein, 11 aa, Influenza virus
LLAIAMGLIFM

SEQ ID NO: 530839 - protein, 11 aa, Influenza virus
LLAKSVFNCLY

SEQ ID NO: 530840 - protein, 11 aa, Influenza virus
LLAKSVFNNLY

SEQ ID NO: 530841 - protein, 11 aa, Influenza virus
LLAKSVFNSIY

SEQ ID NO: 530842 - protein, 11 aa, Influenza virus
LLAKSVFNSLY

SEQ ID NO: 530843 - protein, 11 aa, Influenza virus
LLAPKYGYIIE

SEQ ID NO: 530844 - protein, 11 aa, Influenza virus
LLAPRYGYIIE

SEQ ID NO: 530845 - protein, 11 aa, Influenza virus
LLASTNAHDRI

SEQ ID NO: 530846 - protein, 11 aa, Influenza virus
LLASTNAYDRI

SEQ ID NO: 530847 - protein, 11 aa, Influenza virus
LLATGMKNVPE

SEQ ID NO: 530848 - protein, 11 aa, Influenza virus
LLATGMRNIPE

SEQ ID NO: 530849 - protein, 11 aa, Influenza virus
LLATGMRNVPE

SEQ ID NO: 530850 - protein, 11 aa, Influenza virus
LLDNLQAYQKR

SEQ ID NO: 530851 - protein, 11 aa, Influenza virus
LLDPGDTVTFT

SEQ ID NO: 530852 - protein, 11 aa, Influenza virus
LLDVWTYNAEL

SEQ ID NO: 530853 - protein, 11 aa, Influenza virus
LLEKNVTVTHS

SEQ ID NO: 530854 - protein, 11 aa, Influenza virus
LLEMCHGTQIG

SEQ ID NO: 530855 - protein, 11 aa, Influenza virus
LLEMCHSTQIG

SEQ ID NO: 530856 - protein, 11 aa, Influenza virus
LLEMCHSTQVG

SEQ ID NO: 530857 - protein, 11 aa, Influenza virus
LLEMCHSTRIG

SEQ ID NO: 530858 - protein, 11 aa, Influenza virus
LLENDKTLDLH

SEQ ID NO: 530859 - protein, 11 aa, Influenza virus
LLENDKTLDMH

SEQ ID NO: 530860 - protein, 11 aa, Influenza virus
LLENDKTLNMH

SEQ ID NO: 530861 - protein, 11 aa, Influenza virus
LLENDRTLDLH

SEQ ID NO: 530862 - protein, 11 aa, Influenza virus
LLENDVPVTSS

SEQ ID NO: 530863 - protein, 11 aa, Influenza virus
LLENEKTLDLH

SEQ ID NO: 530864 - protein, 11 aa, Influenza virus
LLENERTLDFH

SEQ ID NO: 530865 - protein, 11 aa, Influenza virus
LLENERTLDLH

SEQ ID NO: 530866 - protein, 11 aa, Influenza virus
LLENERTLDYH

SEQ ID NO: 530867 - protein, 11 aa, Influenza virus
LLENGRTLDLH

SEQ ID NO: 530868 - protein, 11 aa, Influenza virus
LLENGRTLGLH

SEQ ID NO: 530869 - protein, 11 aa, Influenza virus
LLENGVPVTSS

SEQ ID NO: 530870 - protein, 11 aa, Influenza virus
LLENGVPVTST

SEQ ID NO: 530871 - protein, 11 aa, Influenza virus
LLENLQAYQKR

SEQ ID NO: 530872 - protein, 11 aa, Influenza virus
LLENLQTYQKR

SEQ ID NO: 530873 - protein, 11 aa, Influenza virus
LLENNVPVTSS

SEQ ID NO: 530874 - protein, 11 aa, Influenza virus
LLENQKALDEH

SEQ ID NO: 530875 - protein, 11 aa, Influenza virus
LLENQKILDEH

SEQ ID NO: 530876 - protein, 11 aa, Influenza virus
LLENQKPLDEH

SEQ ID NO: 530877 - protein, 11 aa, Influenza virus
LLENQKTLDEH

SEQ ID NO: 530878 - protein, 11 aa, Influenza virus
LLENQKTLDKH

SEQ ID NO: 530879 - protein, 11 aa, Influenza virus
LLESDVPVTSS

SEQ ID NO: 530880 - protein, 11 aa, Influenza virus
LLEVGTRWMKI

SEQ ID NO: 530881 - protein, 11 aa, Influenza virus
LLFMIIGGFIF

SEQ ID NO: 530882 - protein, 11 aa, Influenza virus
LLFQDILMRMS

SEQ ID NO: 530883 - protein, 11 aa, Influenza virus
LLGAIAGFIEG

SEQ ID NO: 530884 - protein, 11 aa, Influenza virus
LLGIITGPPQC

SEQ ID NO: 530885 - protein, 11 aa, Influenza virus
LLGINMSKKKS

SEQ ID NO: 530886 - protein, 11 aa, Influenza virus
LLGNPECDILL

SEQ ID NO: 530887 - protein, 11 aa, Influenza virus
LLGNPECDLFL

SEQ ID NO: 530888 - protein, 11 aa, Influenza virus
LLGNPECDLLL

SEQ ID NO: 530889 - protein, 11 aa, Influenza virus
LLGNPECDRLL

SEQ ID NO: 530890 - protein, 11 aa, Influenza virus
LLGNPKCDRLL

SEQ ID NO: 530891 - protein, 11 aa, Influenza virus
LLGNQKTLDEH

SEQ ID NO: 530892 - protein, 11 aa, Influenza virus
LLGSAQHVEEC

SEQ ID NO: 530893 - protein, 11 aa, Influenza virus
LLGSSPNAYQA

SEQ ID NO: 530894 - protein, 11 aa, Influenza virus
LLGTITGPPQC

SEQ ID NO: 530895 - protein, 11 aa, Influenza virus
LLGTLIGPPQC

SEQ ID NO: 530896 - protein, 11 aa, Influenza virus
LLGTVTGPPQC

SEQ ID NO: 530897 - protein, 11 aa, Influenza virus
LLHKCNDSCMD

SEQ ID NO: 530898 - protein, 11 aa, Influenza virus
LLHKCNDSCME

SEQ ID NO: 530899 - protein, 11 aa, Influenza virus
LLHKCNNSCME

SEQ ID NO: 530900 - protein, 11 aa, Influenza virus
LLHKCNNTCME

SEQ ID NO: 530901 - protein, 11 aa, Influenza virus
LLIAFVLWACQ

SEQ ID NO: 530902 - protein, 11 aa, Influenza virus
LLIAMENQHTI

SEQ ID NO: 530903 - protein, 11 aa, Influenza virus
LLIGISNIGLN

SEQ ID NO: 530904 - protein, 11 aa, Influenza virus
LLIGISNMSLN

SEQ ID NO: 530905 - protein, 11 aa, Influenza virus
LLIGISNVGLN

SEQ ID NO: 530906 - protein, 11 aa, Influenza virus
LLIGISNVVLN

SEQ ID NO: 530907 - protein, 11 aa, Influenza virus
LLIGVSNVGLN

SEQ ID NO: 530908 - protein, 11 aa, Influenza virus
LLILLENERTL

SEQ ID NO: 530909 - protein, 11 aa, Influenza virus
LLISDGGPNLY

SEQ ID NO: 530910 - protein, 11 aa, Influenza virus
LLKERGFFGAI

SEQ ID NO: 530911 - protein, 11 aa, Influenza virus
LLKHRFEIIEG

SEQ ID NO: 530912 - protein, 11 aa, Influenza virus
LLLAFILWACQ

SEQ ID NO: 530913 - protein, 11 aa, Influenza virus
LLLAFMLWACQ

SEQ ID NO: 530914 - protein, 11 aa, Influenza virus
LLLAFVLWACQ

SEQ ID NO: 530915 - protein, 11 aa, Influenza virus
LLLATGMKNVP

SEQ ID NO: 530916 - protein, 11 aa, Influenza virus
LLLATGMRNIP

SEQ ID NO: 530917 - protein, 11 aa, Influenza virus
LLLATGMRNVP

SEQ ID NO: 530918 - protein, 11 aa, Influenza virus
LLLLQANLCRF

SEQ ID NO: 530919 - protein, 11 aa, Influenza virus
LLLMIIGGFIF

SEQ ID NO: 530920 - protein, 11 aa, Influenza virus
LLLNKSLCNVE

SEQ ID NO: 530921 - protein, 11 aa, Influenza virus
LLLNKSLCSVE

SEQ ID NO: 530922 - protein, 11 aa, Influenza virus
LLLQANLCRFL

SEQ ID NO: 530923 - protein, 11 aa, Influenza virus
LLLQIISLCSI

SEQ ID NO: 530924 - protein, 11 aa, Influenza virus
LLLQITSLCSI

SEQ ID NO: 530925 - protein, 11 aa, Influenza virus
LLLQVTSLCSI

SEQ ID NO: 530926 - protein, 11 aa, Influenza virus
LLLTFILWACQ

SEQ ID NO: 530927 - protein, 11 aa, Influenza virus
LLMDALKLSIE

SEQ ID NO: 530928 - protein, 11 aa, Influenza virus
LLMDSLKLSIE

SEQ ID NO: 530929 - protein, 11 aa, Influenza virus
LLMIIGGFIFG

SEQ ID NO: 530930 - protein, 11 aa, Influenza virus
LLMNELGGPFH

SEQ ID NO: 530931 - protein, 11 aa, Influenza virus
LLMNELGIPFH

SEQ ID NO: 530932 - protein, 11 aa, Influenza virus
LLMNELGVPFH

SEQ ID NO: 530933 - protein, 11 aa, Influenza virus
LLMNELGVPFY

SEQ ID NO: 530934 - protein, 11 aa, Influenza virus
LLMNELGVPLH

SEQ ID NO: 530935 - protein, 11 aa, Influenza virus
LLMNELGVSFH

SEQ ID NO: 530936 - protein, 11 aa, Influenza virus
LLMSELGVPFH

SEQ ID NO: 530937 - protein, 11 aa, Influenza virus
LLMSTNAYDRI

SEQ ID NO: 530938 - protein, 11 aa, Influenza virus
LLNASCAAMDD

SEQ ID NO: 530939 - protein, 11 aa, Influenza virus
LLNASCAAMDE

SEQ ID NO: 530940 - protein, 11 aa, Influenza virus
LLNASCAAMED

SEQ ID NO: 530941 - protein, 11 aa, Influenza virus
LLNASWFNSFL

SEQ ID NO: 530942 - protein, 11 aa, Influenza virus
LLNDKHSNETV

SEQ ID NO: 530943 - protein, 11 aa, Influenza virus
LLNDKHSNGTA

SEQ ID NO: 530944 - protein, 11 aa, Influenza virus
LLNDKHSNGTI

SEQ ID NO: 530945 - protein, 11 aa, Influenza virus
LLNDKHSNGTV

SEQ ID NO: 530946 - protein, 11 aa, Influenza virus
LLNDKHSNNTV

SEQ ID NO: 530947 - protein, 11 aa, Influenza virus
LLNDRHSNGTI

SEQ ID NO: 530948 - protein, 11 aa, Influenza virus
LLNDRHSNGTV

SEQ ID NO: 530949 - protein, 11 aa, Influenza virus
LLNKSLCNVEG

SEQ ID NO: 530950 - protein, 11 aa, Influenza virus
LLNKSLCSVEG

SEQ ID NO: 530951 - protein, 11 aa, Influenza virus
LLNPFVSHKEI

SEQ ID NO: 530952 - protein, 11 aa, Influenza virus
LLNRLNINPVK

SEQ ID NO: 530953 - protein, 11 aa, Influenza virus
LLNRLNINPVT

SEQ ID NO: 530954 - protein, 11 aa, Influenza virus
LLNRLNINSVK

SEQ ID NO: 530955 - protein, 11 aa, Influenza virus
LLNRLSINPVK

SEQ ID NO: 530956 - protein, 11 aa, Influenza virus
LLNSSCAAMDD

SEQ ID NO: 530957 - protein, 11 aa, Influenza virus
LLPFAAAPPEQ

SEQ ID NO: 530958 - protein, 11 aa, Influenza virus
LLPFAAAPPKQ

SEQ ID NO: 530959 - protein, 11 aa, Influenza virus
LLPFAAAPPVQ

SEQ ID NO: 530960 - protein, 11 aa, Influenza virus
LLPFASAPPEQ

SEQ ID NO: 530961 - protein, 11 aa, Influenza virus
LLQANLCRFLE

SEQ ID NO: 530962 - protein, 11 aa, Influenza virus
LLQIISLCSIW

SEQ ID NO: 530963 - protein, 11 aa, Influenza virus
LLQITSLCSIW

SEQ ID NO: 530964 - protein, 11 aa, Influenza virus
LLQSAILSLQT

SEQ ID NO: 530965 - protein, 11 aa, Influenza virus
LLQSLQQIESI

SEQ ID NO: 530966 - protein, 11 aa, Influenza virus
LLQSLQQIESM

SEQ ID NO: 530967 - protein, 11 aa, Influenza virus
LLRENAEEDGT

SEQ ID NO: 530968 - protein, 11 aa, Influenza virus
LLRHFQKDAKI

SEQ ID NO: 530969 - protein, 11 aa, Influenza virus
LLRHFQKDAKM

SEQ ID NO: 530970 - protein, 11 aa, Influenza virus
LLRHFQKDAKV

SEQ ID NO: 530971 - protein, 11 aa, Influenza virus
LLRHFQKDARV

SEQ ID NO: 530972 - protein, 11 aa, Influenza virus
LLRHFQKNAKV

SEQ ID NO: 530973 - protein, 11 aa, Influenza virus
LLSLLEMCHST

SEQ ID NO: 530974 - protein, 11 aa, Influenza virus
LLSPEEISETQ

SEQ ID NO: 530975 - protein, 11 aa, Influenza virus
LLSPEEVSEAQ

SEQ ID NO: 530976 - protein, 11 aa, Influenza virus
LLSPEEVSETQ

SEQ ID NO: 530977 - protein, 11 aa, Influenza virus
LLSRLNINPVK

SEQ ID NO: 530978 - protein, 11 aa, Influenza virus
LLSSKANQVFP

SEQ ID NO: 530979 - protein, 11 aa, Influenza virus
LLSSKDNQVFP

SEQ ID NO: 530980 - protein, 11 aa, Influenza virus
LLTEVETYVLS

SEQ ID NO: 530981 - protein, 11 aa, Influenza virus
LLVADGGPNLY

SEQ ID NO: 530982 - protein, 11 aa, Influenza virus
LLVAIENQHTI

SEQ ID NO: 530983 - protein, 11 aa, Influenza virus
LLVALENQHTI

SEQ ID NO: 530984 - protein, 11 aa, Influenza virus
LLVALENQNTI

SEQ ID NO: 530985 - protein, 11 aa, Influenza virus
LLVAMENQHTI

SEQ ID NO: 530986 - protein, 11 aa, Influenza virus
LLVLIENDRTL

SEQ ID NO: 530987 - protein, 11 aa, Influenza virus
LLVLIENERTL

SEQ ID NO: 530988 - protein, 11 aa, Influenza virus
LLVLIENQKTL

SEQ ID NO: 530989 - protein, 11 aa, Influenza virus
LLVLLEDERTL

SEQ ID NO: 530990 - protein, 11 aa, Influenza virus
LLVLLENDKTL

SEQ ID NO: 530991 - protein, 11 aa, Influenza virus
LLVLLENDRTL

SEQ ID NO: 530992 - protein, 11 aa, Influenza virus
LLVLLENEKTL

SEQ ID NO: 530993 - protein, 11 aa, Influenza virus
LLVLLENERTL

SEQ ID NO: 530994 - protein, 11 aa, Influenza virus
LLVLLENGRTL

SEQ ID NO: 530995 - protein, 11 aa, Influenza virus
LLVLLENQKIL

SEQ ID NO: 530996 - protein, 11 aa, Influenza virus
LLVLLENQKPL

SEQ ID NO: 530997 - protein, 11 aa, Influenza virus
LLVLLENQKTL

SEQ ID NO: 530998 - protein, 11 aa, Influenza virus
LLVLLGNQKTL

SEQ ID NO: 530999 - protein, 11 aa, Influenza virus
LLVLMENEITL

SEQ ID NO: 531000 - protein, 11 aa, Influenza virus
LLVLMENEMTL

SEQ ID NO: 531001 - protein, 11 aa, Influenza virus
LLVLMENERTL

SEQ ID NO: 531002 - protein, 11 aa, Influenza virus
LLVMLENQKTL

SEQ ID NO: 531003 - protein, 11 aa, Influenza virus
LLVSDGGPNLY

SEQ ID NO: 531004 - protein, 11 aa, Influenza virus
LLVSLGAIGFW

SEQ ID NO: 531005 - protein, 11 aa, Influenza virus
LLVSLGAISFW

SEQ ID NO: 531006 - protein, 11 aa, Influenza virus
LLVSLGAVSFW

SEQ ID NO: 531007 - protein, 11 aa, Influenza virus
LLVSTNAYDRI

SEQ ID NO: 531008 - protein, 11 aa, Influenza virus
LLVWLENEKTL

SEQ ID NO: 531009 - protein, 11 aa, Influenza virus
LMDALKLSIED

SEQ ID NO: 531010 - protein, 11 aa, Influenza virus
LMDALKLSIEN

SEQ ID NO: 531011 - protein, 11 aa, Influenza virus
LMDALLGDPHC

SEQ ID NO: 531012 - protein, 11 aa, Influenza virus
LMDSLKLSIED

SEQ ID NO: 531013 - protein, 11 aa, Influenza virus
LMENEMTLDFH

SEQ ID NO: 531014 - protein, 11 aa, Influenza virus
LMENERTLDFH

SEQ ID NO: 531015 - protein, 11 aa, Influenza virus
LMENERTLDLH

SEQ ID NO: 531016 - protein, 11 aa, Influenza virus
LMENERTLDYH

SEQ ID NO: 531017 - protein, 11 aa, Influenza virus
LMENERTLEFH

SEQ ID NO: 531018 - protein, 11 aa, Influenza virus
LMENERTLGFH

SEQ ID NO: 531019 - protein, 11 aa, Influenza virus
LMENERTLYFH

SEQ ID NO: 531020 - protein, 11 aa, Influenza virus
LMETERTLDFH

SEQ ID NO: 531021 - protein, 11 aa, Influenza virus
LMEWIKTRPIL

SEQ ID NO: 531022 - protein, 11 aa, Influenza virus
LMEWLKTRPIL

SEQ ID NO: 531023 - protein, 11 aa, Influenza virus
LMIIGGFIFGC

SEQ ID NO: 531024 - protein, 11 aa, Influenza virus
LMIWHSNLNDA

SEQ ID NO: 531025 - protein, 11 aa, Influenza virus
LMLATGMKNVP

SEQ ID NO: 531026 - protein, 11 aa, Influenza virus
LMLATGMRNIP

SEQ ID NO: 531027 - protein, 11 aa, Influenza virus
LMLATGMRNVP

SEQ ID NO: 531028 - protein, 11 aa, Influenza virus
LMLNKSLCKIE

SEQ ID NO: 531029 - protein, 11 aa, Influenza virus
LMLNKSLCKVE

SEQ ID NO: 531030 - protein, 11 aa, Influenza virus
LMLQSRTREIL

SEQ ID NO: 531031 - protein, 11 aa, Influenza virus
LMLSKSLCKVE

SEQ ID NO: 531032 - protein, 11 aa, Influenza virus
LMMAYMLEREL

SEQ ID NO: 531033 - protein, 11 aa, Influenza virus
LMNELGIPFHL

SEQ ID NO: 531034 - protein, 11 aa, Influenza virus
LMNELGVPFHL

SEQ ID NO: 531035 - protein, 11 aa, Influenza virus
LMNELGVPFYL

SEQ ID NO: 531036 - protein, 11 aa, Influenza virus
LMNELGVSFHL

SEQ ID NO: 531037 - protein, 11 aa, Influenza virus
LMQGSTLPRRS

SEQ ID NO: 531038 - protein, 11 aa, Influenza virus
LMSCHIGVAPS

SEQ ID NO: 531039 - protein, 11 aa, Influenza virus
LMSCPIGEAPS

SEQ ID NO: 531040 - protein, 11 aa, Influenza virus
LMSCPIGEVPS

SEQ ID NO: 531041 - protein, 11 aa, Influenza virus
LMSCPIGVAPS

SEQ ID NO: 531042 - protein, 11 aa, Influenza virus
LMSCPLGEAPS

SEQ ID NO: 531043 - protein, 11 aa, Influenza virus
LMSCPMGVAPS

SEQ ID NO: 531044 - protein, 11 aa, Influenza virus
LMSCPVGEAPS

SEQ ID NO: 531045 - protein, 11 aa, Influenza virus
LMSCPVGVAPS

SEQ ID NO: 531046 - protein, 11 aa, Influenza virus
LMSELGVPFHL

SEQ ID NO: 531047 - protein, 11 aa, Influenza virus
LMSLSRTREIL

SEQ ID NO: 531048 - protein, 11 aa, Influenza virus
LMSQSRTREIL

SEQ ID NO: 531049 - protein, 11 aa, Influenza virus
LMSQSRTRGIL

SEQ ID NO: 531050 - protein, 11 aa, Influenza virus
LMSTNAYDRIC

SEQ ID NO: 531051 - protein, 11 aa, Influenza virus
LMSTPLGTPPT

SEQ ID NO: 531052 - protein, 11 aa, Influenza virus
LMSVLLGSSPN

SEQ ID NO: 531053 - protein, 11 aa, Influenza virus
LMSVPLGSSPN

SEQ ID NO: 531054 - protein, 11 aa, Influenza virus
LMSVPLGSSSN

SEQ ID NO: 531055 - protein, 11 aa, Influenza virus
LMTDGPSDAQA

SEQ ID NO: 531056 - protein, 11 aa, Influenza virus
LMTELGVPFHL

SEQ ID NO: 531057 - protein, 11 aa, Influenza virus
LMVAYMLEREL

SEQ ID NO: 531058 - protein, 11 aa, Influenza virus
LMWALGENMAP

SEQ ID NO: 531059 - protein, 11 aa, Influenza virus
LMWEINGPESV

SEQ ID NO: 531060 - protein, 11 aa, Influenza virus
LNASCAAMDDF

SEQ ID NO: 531061 - protein, 11 aa, Influenza virus
LNASCAAMDEF

SEQ ID NO: 531062 - protein, 11 aa, Influenza virus
LNASCAAMEDF

SEQ ID NO: 531063 - protein, 11 aa, Influenza virus
LNASWFNSFLA

SEQ ID NO: 531064 - protein, 11 aa, Influenza virus
LNASWFNSFLI

SEQ ID NO: 531065 - protein, 11 aa, Influenza virus
LNASWFNSFLK

SEQ ID NO: 531066 - protein, 11 aa, Influenza virus
LNASWFNSFLT

SEQ ID NO: 531067 - protein, 11 aa, Influenza virus
LNASWFNSFLV

SEQ ID NO: 531068 - protein, 11 aa, Influenza virus
LNDATYQRTRA

SEQ ID NO: 531069 - protein, 11 aa, Influenza virus
LNDKHSNGTAK

SEQ ID NO: 531070 - protein, 11 aa, Influenza virus
LNDKHSNGTIK

SEQ ID NO: 531071 - protein, 11 aa, Influenza virus
LNDKHSNGTVK

SEQ ID NO: 531072 - protein, 11 aa, Influenza virus
LNDKHSNNTVK

SEQ ID NO: 531073 - protein, 11 aa, Influenza virus
LNDKHSNNTVR

SEQ ID NO: 531074 - protein, 11 aa, Influenza virus
LNDRHSNGTIK

SEQ ID NO: 531075 - protein, 11 aa, Influenza virus
LNDRHSNGTVK

SEQ ID NO: 531076 - protein, 11 aa, Influenza virus
LNDTTYQRTRA

SEQ ID NO: 531077 - protein, 11 aa, Influenza virus
LNEGIMNTSKP

SEQ ID NO: 531078 - protein, 11 aa, Influenza virus
LNEGVINTSKP

SEQ ID NO: 531079 - protein, 11 aa, Influenza virus
LNEGVMNTSKP

SEQ ID NO: 531080 - protein, 11 aa, Influenza virus
LNEITTKINNI

SEQ ID NO: 531081 - protein, 11 aa, Influenza virus
LNFVNRANQRL

SEQ ID NO: 531082 - protein, 11 aa, Influenza virus
LNGIPPLELGD

SEQ ID NO: 531083 - protein, 11 aa, Influenza virus
LNGISPIHLGD

SEQ ID NO: 531084 - protein, 11 aa, Influenza virus
LNGISPVHLGD

SEQ ID NO: 531085 - protein, 11 aa, Influenza virus
LNGNGDPNNMD

SEQ ID NO: 531086 - protein, 11 aa, Influenza virus
LNGNGDPSNMD

SEQ ID NO: 531087 - protein, 11 aa, Influenza virus
LNGREWSYIVE

SEQ ID NO: 531088 - protein, 11 aa, Influenza virus
LNGTAKHIEEC

SEQ ID NO: 531089 - protein, 11 aa, Influenza virus
LNGVSPIHLGD

SEQ ID NO: 531090 - protein, 11 aa, Influenza virus
LNGVSPVHLGD

SEQ ID NO: 531091 - protein, 11 aa, Influenza virus
LNHLIGKTNQQ

SEQ ID NO: 531092 - protein, 11 aa, Influenza virus
LNIESNGNLIA

SEQ ID NO: 531093 - protein, 11 aa, Influenza virus
LNINPVKLSSG

SEQ ID NO: 531094 - protein, 11 aa, Influenza virus
LNINPVTLSSG

SEQ ID NO: 531095 - protein, 11 aa, Influenza virus
LNINSVKLSSG

SEQ ID NO: 531096 - protein, 11 aa, Influenza virus
LNITAASLNDD

SEQ ID NO: 531097 - protein, 11 aa, Influenza virus
LNKKIDDGFLD

SEQ ID NO: 531098 - protein, 11 aa, Influenza virus
LNKKMEDGFLD

SEQ ID NO: 531099 - protein, 11 aa, Influenza virus
LNKKMEDGFLN

SEQ ID NO: 531100 - protein, 11 aa, Influenza virus
LNKKVDDGFID

SEQ ID NO: 531101 - protein, 11 aa, Influenza virus
LNKKVDDGFLD

SEQ ID NO: 531102 - protein, 11 aa, Influenza virus
LNKKVDDGLLD

SEQ ID NO: 531103 - protein, 11 aa, Influenza virus
LNKNEIKGVKL

SEQ ID NO: 531104 - protein, 11 aa, Influenza virus
LNKSLCKIEGW

SEQ ID NO: 531105 - protein, 11 aa, Influenza virus
LNKSLCKVEEW

SEQ ID NO: 531106 - protein, 11 aa, Influenza virus
LNKSLCKVEGW

SEQ ID NO: 531107 - protein, 11 aa, Influenza virus
LNKSLCNVEGW

SEQ ID NO: 531108 - protein, 11 aa, Influenza virus
LNKSLCSVEGW

SEQ ID NO: 531109 - protein, 11 aa, Influenza virus
LNLIIGISNVG

SEQ ID NO: 531110 - protein, 11 aa, Influenza virus
LNLLIGISNIG

SEQ ID NO: 531111 - protein, 11 aa, Influenza virus
LNLLIGISNVG

SEQ ID NO: 531112 - protein, 11 aa, Influenza virus
LNLLIGISNVV

SEQ ID NO: 531113 - protein, 11 aa, Influenza virus
LNLLIGVSNVG

SEQ ID NO: 531114 - protein, 11 aa, Influenza virus
LNLYDRVRKQL

SEQ ID NO: 531115 - protein, 11 aa, Influenza virus
LNLYERVRKQL

SEQ ID NO: 531116 - protein, 11 aa, Influenza virus
LNMGQPFYSHR

SEQ ID NO: 531117 - protein, 11 aa, Influenza virus
LNMHDANVRNL

SEQ ID NO: 531118 - protein, 11 aa, Influenza virus
LNNEIRWPPHW

SEQ ID NO: 531119 - protein, 11 aa, Influenza virus
LNNEPGSGNWP

SEQ ID NO: 531120 - protein, 11 aa, Influenza virus
LNNKHSNGTIH

SEQ ID NO: 531121 - protein, 11 aa, Influenza virus
LNNKHWSGYSG

SEQ ID NO: 531122 - protein, 11 aa, Influenza virus
LNNKNWSGYSG

SEQ ID NO: 531123 - protein, 11 aa, Influenza virus
LNNMNWSGYSG

SEQ ID NO: 531124 - protein, 11 aa, Influenza virus
LNNNGELRHLF

SEQ ID NO: 531125 - protein, 11 aa, Influenza virus
LNNRNWSGYSG

SEQ ID NO: 531126 - protein, 11 aa, Influenza virus
LNNTEPLCDVS

SEQ ID NO: 531127 - protein, 11 aa, Influenza virus
LNNTEPLCEVS

SEQ ID NO: 531128 - protein, 11 aa, Influenza virus
LNNTEPLCNVS

SEQ ID NO: 531129 - protein, 11 aa, Influenza virus
LNNVIDKMNKQ

SEQ ID NO: 531130 - protein, 11 aa, Influenza virus
LNNVIDKMNNQ

SEQ ID NO: 531131 - protein, 11 aa, Influenza virus
LNNVIDKMYKQ

SEQ ID NO: 531132 - protein, 11 aa, Influenza virus
LNPMHQLLRHF

SEQ ID NO: 531133 - protein, 11 aa, Influenza virus
LNQTYRNNRKE

SEQ ID NO: 531134 - protein, 11 aa, Influenza virus
LNQTYRNTRKE

SEQ ID NO: 531135 - protein, 11 aa, Influenza virus
LNRFIEKTNQQ

SEQ ID NO: 531136 - protein, 11 aa, Influenza virus
LNRIIEKTNQQ

SEQ ID NO: 531137 - protein, 11 aa, Influenza virus
LNRKMEDGFLD

SEQ ID NO: 531138 - protein, 11 aa, Influenza virus
LNRKVDDGFLD

SEQ ID NO: 531139 - protein, 11 aa, Influenza virus
LNRLIDKTNQQ

SEQ ID NO: 531140 - protein, 11 aa, Influenza virus
LNRLIDRTNHQ

SEQ ID NO: 531141 - protein, 11 aa, Influenza virus
LNRLIEKTNDK

SEQ ID NO: 531142 - protein, 11 aa, Influenza virus
LNRLIEKTNEK

SEQ ID NO: 531143 - protein, 11 aa, Influenza virus
LNRLIEKTNKQ

SEQ ID NO: 531144 - protein, 11 aa, Influenza virus
LNRLIEKTNQQ

SEQ ID NO: 531145 - protein, 11 aa, Influenza virus
LNRLIEKTNTE

SEQ ID NO: 531146 - protein, 11 aa, Influenza virus
LNRLIEKTNTQ

SEQ ID NO: 531147 - protein, 11 aa, Influenza virus
LNRLIERTNEK

SEQ ID NO: 531148 - protein, 11 aa, Influenza virus
LNRLIERTNQQ

SEQ ID NO: 531149 - protein, 11 aa, Influenza virus
LNRLIGKTNQQ

SEQ ID NO: 531150 - protein, 11 aa, Influenza virus
LNRLISKTNQQ

SEQ ID NO: 531151 - protein, 11 aa, Influenza virus
LNRLNINPVKL

SEQ ID NO: 531152 - protein, 11 aa, Influenza virus
LNRLNINPVTL

SEQ ID NO: 531153 - protein, 11 aa, Influenza virus
LNRLNINSVKL

SEQ ID NO: 531154 - protein, 11 aa, Influenza virus
LNRLSINPVKL

SEQ ID NO: 531155 - protein, 11 aa, Influenza virus
LNRNEIKGVKL

SEQ ID NO: 531156 - protein, 11 aa, Influenza virus
LNRNQPAATAL

SEQ ID NO: 531157 - protein, 11 aa, Influenza virus
LNRQEIEGVKL

SEQ ID NO: 531158 - protein, 11 aa, Influenza virus
LNRQEIGGVKL

SEQ ID NO: 531159 - protein, 11 aa, Influenza virus
LNSSCAAMDDF

SEQ ID NO: 531160 - protein, 11 aa, Influenza virus
LNTDWSGYSGS

SEQ ID NO: 531161 - protein, 11 aa, Influenza virus
LNTMHQLLRHF

SEQ ID NO: 531162 - protein, 11 aa, Influenza virus
LNTMTKDAERG

SEQ ID NO: 531163 - protein, 11 aa, Influenza virus
LNTSQRGILED

SEQ ID NO: 531164 - protein, 11 aa, Influenza virus
LNTSQRGVLED

SEQ ID NO: 531165 - protein, 11 aa, Influenza virus
LNTTLPFHNIH

SEQ ID NO: 531166 - protein, 11 aa, Influenza virus
LNVESNGNLIA

SEQ ID NO: 531167 - protein, 11 aa, Influenza virus
LNVESNGNLVA

SEQ ID NO: 531168 - protein, 11 aa, Influenza virus
LNVWTYNAELL

SEQ ID NO: 531169 - protein, 11 aa, Influenza virus
LNWLTKATNGN

SEQ ID NO: 531170 - protein, 11 aa, Influenza virus
LNWLTKETNGN

SEQ ID NO: 531171 - protein, 11 aa, Influenza virus
LNWSGYSGSFT

SEQ ID NO: 531172 - protein, 11 aa, Influenza virus
LNYHYEECSCY

SEQ ID NO: 531173 - protein, 11 aa, Influenza virus
LPDGAQIQYFS

SEQ ID NO: 531174 - protein, 11 aa, Influenza virus
LPDLYDYKEDR

SEQ ID NO: 531175 - protein, 11 aa, Influenza virus
LPDLYDYKENR

SEQ ID NO: 531176 - protein, 11 aa, Influenza virus
LPDLYDYKESR

SEQ ID NO: 531177 - protein, 11 aa, Influenza virus
LPDLYDYKKNR

SEQ ID NO: 531178 - protein, 11 aa, Influenza virus
LPFAAAPPEQS

SEQ ID NO: 531179 - protein, 11 aa, Influenza virus
LPFAAAPPKQS

SEQ ID NO: 531180 - protein, 11 aa, Influenza virus
LPFAAAPPVQS

SEQ ID NO: 531181 - protein, 11 aa, Influenza virus
LPFASAPPEQS

SEQ ID NO: 531182 - protein, 11 aa, Influenza virus
LPFHNIHPLAI

SEQ ID NO: 531183 - protein, 11 aa, Influenza virus
LPFHNIHPLTI

SEQ ID NO: 531184 - protein, 11 aa, Influenza virus
LPFHNVHPLAI

SEQ ID NO: 531185 - protein, 11 aa, Influenza virus
LPFHNVHPLTI

SEQ ID NO: 531186 - protein, 11 aa, Influenza virus
LPFQNIDSRAV

SEQ ID NO: 531187 - protein, 11 aa, Influenza virus
LPFQNIDSWAV

SEQ ID NO: 531188 - protein, 11 aa, Influenza virus
LPFQNLSPRTV

SEQ ID NO: 531189 - protein, 11 aa, Influenza virus
LPLALGMKNVP

SEQ ID NO: 531190 - protein, 11 aa, Influenza virus
LPLCPFKGFFP

SEQ ID NO: 531191 - protein, 11 aa, Influenza virus
LPLCPFQGFFP

SEQ ID NO: 531192 - protein, 11 aa, Influenza virus
LPLCPFRGFFP

SEQ ID NO: 531193 - protein, 11 aa, Influenza virus
LPQSGRIVVDY

SEQ ID NO: 531194 - protein, 11 aa, Influenza virus
LPRRSGAAGAA

SEQ ID NO: 531195 - protein, 11 aa, Influenza virus
LPSFGVSGINE

SEQ ID NO: 531196 - protein, 11 aa, Influenza virus
LPSFGVSGVNE

SEQ ID NO: 531197 - protein, 11 aa, Influenza virus
LPTFDSLNITA

SEQ ID NO: 531198 - protein, 11 aa, Influenza virus
LPVGGNEKKAK

SEQ ID NO: 531199 - protein, 11 aa, Influenza virus
LQALQLLLEVE

SEQ ID NO: 531200 - protein, 11 aa, Influenza virus
LQANLCRFLET

SEQ ID NO: 531201 - protein, 11 aa, Influenza virus
LQATGMKNVPE

SEQ ID NO: 531202 - protein, 11 aa, Influenza virus
LQAYQKRMGLQ

SEQ ID NO: 531203 - protein, 11 aa, Influenza virus
LQAYQKRMGVQ

SEQ ID NO: 531204 - protein, 11 aa, Influenza virus
LQCRICIDFRD

SEQ ID NO: 531205 - protein, 11 aa, Influenza virus
LQCRICILDQN

SEQ ID NO: 531206 - protein, 11 aa, Influenza virus
LQCRICIRADG

SEQ ID NO: 531207 - protein, 11 aa, Influenza virus
LQDNAKDEGNG

SEQ ID NO: 531208 - protein, 11 aa, Influenza virus
LQDTTWDVFIE

SEQ ID NO: 531209 - protein, 11 aa, Influenza virus
LQGSARHIEEC

SEQ ID NO: 531210 - protein, 11 aa, Influenza virus
LQGTKRSYEQM

SEQ ID NO: 531211 - protein, 11 aa, Influenza virus
LQIISLCSIWF

SEQ ID NO: 531212 - protein, 11 aa, Influenza virus
LQITSLCSIWF

SEQ ID NO: 531213 - protein, 11 aa, Influenza virus
LQLFIKDYRYT

SEQ ID NO: 531214 - protein, 11 aa, Influenza virus
LQLKDNAKELG

SEQ ID NO: 531215 - protein, 11 aa, Influenza virus
LQLKDNARELG

SEQ ID NO: 531216 - protein, 11 aa, Influenza virus
LQLNPIDGPLP

SEQ ID NO: 531217 - protein, 11 aa, Influenza virus
LQLRDNAKELG

SEQ ID NO: 531218 - protein, 11 aa, Influenza virus
LQLRDNARELG

SEQ ID NO: 531219 - protein, 11 aa, Influenza virus
LQNASRHYMGE

SEQ ID NO: 531220 - protein, 11 aa, Influenza virus
LQNNAIDEGDG

SEQ ID NO: 531221 - protein, 11 aa, Influenza virus
LQNRIMINPVK

SEQ ID NO: 531222 - protein, 11 aa, Influenza virus
LQNRIQIDPVK

SEQ ID NO: 531223 - protein, 11 aa, Influenza virus
LQNRIQIDQVK

SEQ ID NO: 531224 - protein, 11 aa, Influenza virus
LQNRIQIDSVK

SEQ ID NO: 531225 - protein, 11 aa, Influenza virus
LQNTSKHYIGK

SEQ ID NO: 531226 - protein, 11 aa, Influenza virus
LQQIESIIEAE

SEQ ID NO: 531227 - protein, 11 aa, Influenza virus
LQQIESMIEAE

SEQ ID NO: 531228 - protein, 11 aa, Influenza virus
LQQIESMVEAE

SEQ ID NO: 531229 - protein, 11 aa, Influenza virus
LQQVESMIEAE

SEQ ID NO: 531230 - protein, 11 aa, Influenza virus
LQRRRFIQNAL

SEQ ID NO: 531231 - protein, 11 aa, Influenza virus
LQRRRFVQNAL

SEQ ID NO: 531232 - protein, 11 aa, Influenza virus
LQSLQQIESII

SEQ ID NO: 531233 - protein, 11 aa, Influenza virus
LQSLQQIESMI

SEQ ID NO: 531234 - protein, 11 aa, Influenza virus
LQSLQQIESMV

SEQ ID NO: 531235 - protein, 11 aa, Influenza virus
LQSSDDFALIL

SEQ ID NO: 531236 - protein, 11 aa, Influenza virus
LQSSDDFALIV

SEQ ID NO: 531237 - protein, 11 aa, Influenza virus
LQTYQKRMGVQ

SEQ ID NO: 531238 - protein, 11 aa, Influenza virus
LRDCKIEAVIY

SEQ ID NO: 531239 - protein, 11 aa, Influenza virus
LRDCKVEAVIY

SEQ ID NO: 531240 - protein, 11 aa, Influenza virus
LRDCSIAGWLL

SEQ ID NO: 531241 - protein, 11 aa, Influenza virus
LRDCSVAGWLL

SEQ ID NO: 531242 - protein, 11 aa, Influenza virus
LRDDLEPGTFD

SEQ ID NO: 531243 - protein, 11 aa, Influenza virus
LRDNAKDEGNG

SEQ ID NO: 531244 - protein, 11 aa, Influenza virus
LRDNAKDLGNG

SEQ ID NO: 531245 - protein, 11 aa, Influenza virus
LRDNAKEIGNG

SEQ ID NO: 531246 - protein, 11 aa, Influenza virus
LRDNAKELGNG

SEQ ID NO: 531247 - protein, 11 aa, Influenza virus
LRDNAMILGNG

SEQ ID NO: 531248 - protein, 11 aa, Influenza virus
LRDNANDLGNG

SEQ ID NO: 531249 - protein, 11 aa, Influenza virus
LRDNLEPGTFD

SEQ ID NO: 531250 - protein, 11 aa, Influenza virus
LRDNVKELGNG

SEQ ID NO: 531251 - protein, 11 aa, Influenza virus
LRDQGWSYIVE

SEQ ID NO: 531252 - protein, 11 aa, Influenza virus
LRDSLEPGTFD

SEQ ID NO: 531253 - protein, 11 aa, Influenza virus
LREHLSSVSSF

SEQ ID NO: 531254 - protein, 11 aa, Influenza virus
LRELWQCYYLL

SEQ ID NO: 531255 - protein, 11 aa, Influenza virus
LRENAEDIGNG

SEQ ID NO: 531256 - protein, 11 aa, Influenza virus
LRENAEDKGNG

SEQ ID NO: 531257 - protein, 11 aa, Influenza virus
LRENAEDLGNG

SEQ ID NO: 531258 - protein, 11 aa, Influenza virus
LRENAEDMGDG

SEQ ID NO: 531259 - protein, 11 aa, Influenza virus
LRENAEDMGGG

SEQ ID NO: 531260 - protein, 11 aa, Influenza virus
LRENAEDMGNG

SEQ ID NO: 531261 - protein, 11 aa, Influenza virus
LRENAEDQGNG

SEQ ID NO: 531262 - protein, 11 aa, Influenza virus
LRENAEDRGNG

SEQ ID NO: 531263 - protein, 11 aa, Influenza virus
LRENAEEDCTG

SEQ ID NO: 531264 - protein, 11 aa, Influenza virus
LRENAEEDGNG

SEQ ID NO: 531265 - protein, 11 aa, Influenza virus
LRENAEEDGTA

SEQ ID NO: 531266 - protein, 11 aa, Influenza virus
LRENAEEDGTG

SEQ ID NO: 531267 - protein, 11 aa, Influenza virus
LRENAEEMGNG

SEQ ID NO: 531268 - protein, 11 aa, Influenza virus
LREQKQEFKMN

SEQ ID NO: 531269 - protein, 11 aa, Influenza virus
LREQLSSVSSF

SEQ ID NO: 531270 - protein, 11 aa, Influenza virus
LREQLSTVSSF

SEQ ID NO: 531271 - protein, 11 aa, Influenza virus
LRFLFSSIKKY

SEQ ID NO: 531272 - protein, 11 aa, Influenza virus
LRFVFSIAASY

SEQ ID NO: 531273 - protein, 11 aa, Influenza virus
LRFVFSNAASY

SEQ ID NO: 531274 - protein, 11 aa, Influenza virus
LRFVFSSAASY

SEQ ID NO: 531275 - protein, 11 aa, Influenza virus
LRGFLIIGKED

SEQ ID NO: 531276 - protein, 11 aa, Influenza virus
LRGFLILGKED

SEQ ID NO: 531277 - protein, 11 aa, Influenza virus
LRGFLILGKEN

SEQ ID NO: 531278 - protein, 11 aa, Influenza virus
LRGFLILGRED

SEQ ID NO: 531279 - protein, 11 aa, Influenza virus
LRGGRNSFFSR

SEQ ID NO: 531280 - protein, 11 aa, Influenza virus
LRGIPPLELGD

SEQ ID NO: 531281 - protein, 11 aa, Influenza virus
LRGQHANGTIH

SEQ ID NO: 531282 - protein, 11 aa, Influenza virus
LRGRGSTLGLD

SEQ ID NO: 531283 - protein, 11 aa, Influenza virus
LRGRHANGTIH

SEQ ID NO: 531284 - protein, 11 aa, Influenza virus
LRGRHANGTIN

SEQ ID NO: 531285 - protein, 11 aa, Influenza virus
LRGRHANGTMH

SEQ ID NO: 531286 - protein, 11 aa, Influenza virus
LRGSARHIEEC

SEQ ID NO: 531287 - protein, 11 aa, Influenza virus
LRGSIAHKSCL

SEQ ID NO: 531288 - protein, 11 aa, Influenza virus
LRGSVAHKSCL

SEQ ID NO: 531289 - protein, 11 aa, Influenza virus
LRHFQKDAKIL

SEQ ID NO: 531290 - protein, 11 aa, Influenza virus
LRHFQKDAKML

SEQ ID NO: 531291 - protein, 11 aa, Influenza virus
LRHFQKDAKVL

SEQ ID NO: 531292 - protein, 11 aa, Influenza virus
LRHFQKDARVL

SEQ ID NO: 531293 - protein, 11 aa, Influenza virus
LRHFQKNAKVL

SEQ ID NO: 531294 - protein, 11 aa, Influenza virus
LRHLFSGIKSF

SEQ ID NO: 531295 - protein, 11 aa, Influenza virus
LRHLFSGIRSF

SEQ ID NO: 531296 - protein, 11 aa, Influenza virus
LRHLFSGVNSF

SEQ ID NO: 531297 - protein, 11 aa, Influenza virus
LRISSSFSFGG

SEQ ID NO: 531298 - protein, 11 aa, Influenza virus
LRLAIGLRNTP

SEQ ID NO: 531299 - protein, 11 aa, Influenza virus
LRLALGLRNTP

SEQ ID NO: 531300 - protein, 11 aa, Influenza virus
LRLATGLRNIP

SEQ ID NO: 531301 - protein, 11 aa, Influenza virus
LRLATGLRNVP

SEQ ID NO: 531302 - protein, 11 aa, Influenza virus
LRLATGMRNIP

SEQ ID NO: 531303 - protein, 11 aa, Influenza virus
LRLATGMRNVP

SEQ ID NO: 531304 - protein, 11 aa, Influenza virus
LRLAVGLRNTP

SEQ ID NO: 531305 - protein, 11 aa, Influenza virus
LRMATGLRNIP

SEQ ID NO: 531306 - protein, 11 aa, Influenza virus
LRMATGLRNVP

SEQ ID NO: 531307 - protein, 11 aa, Influenza virus
LRMKWMMAMKY

SEQ ID NO: 531308 - protein, 11 aa, Influenza virus
LRMKWMMAMRY

SEQ ID NO: 531309 - protein, 11 aa, Influenza virus
LRMVTGLRNIP

SEQ ID NO: 531310 - protein, 11 aa, Influenza virus
LRNDTDVVNFL

SEQ ID NO: 531311 - protein, 11 aa, Influenza virus
LRNDTDVVNFV

SEQ ID NO: 531312 - protein, 11 aa, Influenza virus
LRNDTDVVNYV

SEQ ID NO: 531313 - protein, 11 aa, Influenza virus
LRNGNMRCTIC

SEQ ID NO: 531314 - protein, 11 aa, Influenza virus
LRNIPSIQSRG

SEQ ID NO: 531315 - protein, 11 aa, Influenza virus
LRNIPSVQSRG

SEQ ID NO: 531316 - protein, 11 aa, Influenza virus
LRNTPSIDPKG

SEQ ID NO: 531317 - protein, 11 aa, Influenza virus
LRNTPSIEPKG

SEQ ID NO: 531318 - protein, 11 aa, Influenza virus
LRNTPSIEPRG

SEQ ID NO: 531319 - protein, 11 aa, Influenza virus
LRNTPSVEPKG

SEQ ID NO: 531320 - protein, 11 aa, Influenza virus
LRNTPSVEPRG

SEQ ID NO: 531321 - protein, 11 aa, Influenza virus
LRNVPSIQSRG

SEQ ID NO: 531322 - protein, 11 aa, Influenza virus
LRPGETLNVES

SEQ ID NO: 531323 - protein, 11 aa, Influenza virus
LRPGQTLRVRS

SEQ ID NO: 531324 - protein, 11 aa, Influenza virus
LRQIIRESGGI

SEQ ID NO: 531325 - protein, 11 aa, Influenza virus
LRQILRESGGI

SEQ ID NO: 531326 - protein, 11 aa, Influenza virus
LRQILRGSGGI

SEQ ID NO: 531327 - protein, 11 aa, Influenza virus
LRQILRGSGGV

SEQ ID NO: 531328 - protein, 11 aa, Influenza virus
LRQILRKSGGI

SEQ ID NO: 531329 - protein, 11 aa, Influenza virus
LRQILRRSGGI

SEQ ID NO: 531330 - protein, 11 aa, Influenza virus
LRQKIMESGGI

SEQ ID NO: 531331 - protein, 11 aa, Influenza virus
LRQKIMESGGV

SEQ ID NO: 531332 - protein, 11 aa, Influenza virus
LRQKVMESGGI

SEQ ID NO: 531333 - protein, 11 aa, Influenza virus
LRQNAEEDGKG

SEQ ID NO: 531334 - protein, 11 aa, Influenza virus
LRQNAEEDGRG

SEQ ID NO: 531335 - protein, 11 aa, Influenza virus
LRQNPTEEQAV

SEQ ID NO: 531336 - protein, 11 aa, Influenza virus
LRQVLRESGGI

SEQ ID NO: 531337 - protein, 11 aa, Influenza virus
LRQVLRRSGGI

SEQ ID NO: 531338 - protein, 11 aa, Influenza virus
LRRCLLQSLQQ

SEQ ID NO: 531339 - protein, 11 aa, Influenza virus
LRRDQKSLRGR

SEQ ID NO: 531340 - protein, 11 aa, Influenza virus
LRRQKSLIWLW

SEQ ID NO: 531341 - protein, 11 aa, Influenza virus
LRRQKWWVWLW

SEQ ID NO: 531342 - protein, 11 aa, Influenza virus
LRSGFEMLKIP

SEQ ID NO: 531343 - protein, 11 aa, Influenza virus
LRSGYEMLKVP

SEQ ID NO: 531344 - protein, 11 aa, Influenza virus
LRSGYETFKVI

SEQ ID NO: 531345 - protein, 11 aa, Influenza virus
LRSGYWAIRTR

SEQ ID NO: 531346 - protein, 11 aa, Influenza virus
LRSILANNGKF

SEQ ID NO: 531347 - protein, 11 aa, Influenza virus
LRSILANNGRF

SEQ ID NO: 531348 - protein, 11 aa, Influenza virus
LRSILASSGSL

SEQ ID NO: 531349 - protein, 11 aa, Influenza virus
LRSIVASSGTL

SEQ ID NO: 531350 - protein, 11 aa, Influenza virus
LRSIVASSGTV

SEQ ID NO: 531351 - protein, 11 aa, Influenza virus
LRSKYWAIRTR

SEQ ID NO: 531352 - protein, 11 aa, Influenza virus
LRSLFSSIKKY

SEQ ID NO: 531353 - protein, 11 aa, Influenza virus
LRSLFSSIKRY

SEQ ID NO: 531354 - protein, 11 aa, Influenza virus
LRSLIASSGTL

SEQ ID NO: 531355 - protein, 11 aa, Influenza virus
LRSLVASSGNL

SEQ ID NO: 531356 - protein, 11 aa, Influenza virus
LRSLVASSGTL

SEQ ID NO: 531357 - protein, 11 aa, Influenza virus
LRSNAPSGIEY

SEQ ID NO: 531358 - protein, 11 aa, Influenza virus
LRSNAPSGVEY

SEQ ID NO: 531359 - protein, 11 aa, Influenza virus
LRSRYWAIRTR

SEQ ID NO: 531360 - protein, 11 aa, Influenza virus
LRTHESECVCI

SEQ ID NO: 531361 - protein, 11 aa, Influenza virus
LRTQDSECVSH

SEQ ID NO: 531362 - protein, 11 aa, Influenza virus
LRTQESECACI

SEQ ID NO: 531363 - protein, 11 aa, Influenza virus
LRTQESECACV

SEQ ID NO: 531364 - protein, 11 aa, Influenza virus
LRTQESECICI

SEQ ID NO: 531365 - protein, 11 aa, Influenza virus
LRTQESECLCI

SEQ ID NO: 531366 - protein, 11 aa, Influenza virus
LRTQESECQCI

SEQ ID NO: 531367 - protein, 11 aa, Influenza virus
LRTQESECQCL

SEQ ID NO: 531368 - protein, 11 aa, Influenza virus
LRTQESECVCH

SEQ ID NO: 531369 - protein, 11 aa, Influenza virus
LRTQESECVCI

SEQ ID NO: 531370 - protein, 11 aa, Influenza virus
LRTQESECVCM

SEQ ID NO: 531371 - protein, 11 aa, Influenza virus
LRTQESECVCV

SEQ ID NO: 531372 - protein, 11 aa, Influenza virus
LRTQESECVRH

SEQ ID NO: 531373 - protein, 11 aa, Influenza virus
LRTQESSCTCI

SEQ ID NO: 531374 - protein, 11 aa, Influenza virus
LRTQESSCVCI

SEQ ID NO: 531375 - protein, 11 aa, Influenza virus
LRTQESSCVCM

SEQ ID NO: 531376 - protein, 11 aa, Influenza virus
LRTQESSCVCV

SEQ ID NO: 531377 - protein, 11 aa, Influenza virus
LRWALGENMAP

SEQ ID NO: 531378 - protein, 11 aa, Influenza virus
LSADGDIWVTR

SEQ ID NO: 531379 - protein, 11 aa, Influenza virus
LSAFDERRNKY

SEQ ID NO: 531380 - protein, 11 aa, Influenza virus
LSAFDERRNRY

SEQ ID NO: 531381 - protein, 11 aa, Influenza virus
LSAGGAIWVTR

SEQ ID NO: 531382 - protein, 11 aa, Influenza virus
LSAGGDIWATR

SEQ ID NO: 531383 - protein, 11 aa, Influenza virus
LSAGGDIWITR

SEQ ID NO: 531384 - protein, 11 aa, Influenza virus
LSAGGDIWVMR

SEQ ID NO: 531385 - protein, 11 aa, Influenza virus
LSAGGDIWVTR

SEQ ID NO: 531386 - protein, 11 aa, Influenza virus
LSAGGHIWVTR

SEQ ID NO: 531387 - protein, 11 aa, Influenza virus
LSAGGNIWITR

SEQ ID NO: 531388 - protein, 11 aa, Influenza virus
LSASGDIWITR

SEQ ID NO: 531389 - protein, 11 aa, Influenza virus
LSASGDIWVTR

SEQ ID NO: 531390 - protein, 11 aa, Influenza virus
LSEQNVPVTQV

SEQ ID NO: 531391 - protein, 11 aa, Influenza virus
LSFQGRGVFEL

SEQ ID NO: 531392 - protein, 11 aa, Influenza virus
LSFTITGDNTK

SEQ ID NO: 531393 - protein, 11 aa, Influenza virus
LSFTVTGDNTK

SEQ ID NO: 531394 - protein, 11 aa, Influenza virus
LSFWMCSNGPL

SEQ ID NO: 531395 - protein, 11 aa, Influenza virus
LSFWMCSNGSI

SEQ ID NO: 531396 - protein, 11 aa, Influenza virus
LSFWMCSNGSL

SEQ ID NO: 531397 - protein, 11 aa, Influenza virus
LSGGAQHVEEC

SEQ ID NO: 531398 - protein, 11 aa, Influenza virus
LSGGYKDIILW

SEQ ID NO: 531399 - protein, 11 aa, Influenza virus
LSGGYKDVILW

SEQ ID NO: 531400 - protein, 11 aa, Influenza virus
LSGIPPLELGD

SEQ ID NO: 531401 - protein, 11 aa, Influenza virus
LSGNAQHVEEC

SEQ ID NO: 531402 - protein, 11 aa, Influenza virus
LSGNGDPNNMD

SEQ ID NO: 531403 - protein, 11 aa, Influenza virus
LSGREWSYIVE

SEQ ID NO: 531404 - protein, 11 aa, Influenza virus
LSGSAQHIEEC

SEQ ID NO: 531405 - protein, 11 aa, Influenza virus
LSGSAQHVEEC

SEQ ID NO: 531406 - protein, 11 aa, Influenza virus
LSGVAIALSIL

SEQ ID NO: 531407 - protein, 11 aa, Influenza virus
LSGVAIALSVL

SEQ ID NO: 531408 - protein, 11 aa, Influenza virus
LSHTAYSQITN

SEQ ID NO: 531409 - protein, 11 aa, Influenza virus
LSIAPIMFSNK

SEQ ID NO: 531410 - protein, 11 aa, Influenza virus
LSIEDPDHEGE

SEQ ID NO: 531411 - protein, 11 aa, Influenza virus
LSIEDPNHEGE

SEQ ID NO: 531412 - protein, 11 aa, Influenza virus
LSIEDPSHEGE

SEQ ID NO: 531413 - protein, 11 aa, Influenza virus
LSIEEPSHEGE

SEQ ID NO: 531414 - protein, 11 aa, Influenza virus
LSIENPSHEGE

SEQ ID NO: 531415 - protein, 11 aa, Influenza virus
LSIIPSGPLKA

SEQ ID NO: 531416 - protein, 11 aa, Influenza virus
LSILNLLIGIS

SEQ ID NO: 531417 - protein, 11 aa, Influenza virus
LSINPVKLSSG

SEQ ID NO: 531418 - protein, 11 aa, Influenza virus
LSISIGSSTYQ

SEQ ID NO: 531419 - protein, 11 aa, Influenza virus
LSISVESSTYQ

SEQ ID NO: 531420 - protein, 11 aa, Influenza virus
LSISVGSSIYQ

SEQ ID NO: 531421 - protein, 11 aa, Influenza virus
LSISVGSSTYQ

SEQ ID NO: 531422 - protein, 11 aa, Influenza virus
LSIVPSGPLKA

SEQ ID NO: 531423 - protein, 11 aa, Influenza virus
LSIYSCIASSI

SEQ ID NO: 531424 - protein, 11 aa, Influenza virus
LSIYSCIASSL

SEQ ID NO: 531425 - protein, 11 aa, Influenza virus
LSIYSCIASST

SEQ ID NO: 531426 - protein, 11 aa, Influenza virus
LSIYSCIASSV

SEQ ID NO: 531427 - protein, 11 aa, Influenza virus
LSIYSCVASSL

SEQ ID NO: 531428 - protein, 11 aa, Influenza virus
LSIYSSVASSL

SEQ ID NO: 531429 - protein, 11 aa, Influenza virus
LSIYSTAASSL

SEQ ID NO: 531430 - protein, 11 aa, Influenza virus
LSIYSTVAASL

SEQ ID NO: 531431 - protein, 11 aa, Influenza virus
LSIYSTVASSL

SEQ ID NO: 531432 - protein, 11 aa, Influenza virus
LSIYSTVSSSL

SEQ ID NO: 531433 - protein, 11 aa, Influenza virus
LSIYSTVTSSL

SEQ ID NO: 531434 - protein, 11 aa, Influenza virus
LSIYSTVVSSL

SEQ ID NO: 531435 - protein, 11 aa, Influenza virus
LSKDNAIRIGE

SEQ ID NO: 531436 - protein, 11 aa, Influenza virus
LSKDNGIRIGS

SEQ ID NO: 531437 - protein, 11 aa, Influenza virus
LSKSLCKVEGW

SEQ ID NO: 531438 - protein, 11 aa, Influenza virus
LSLAIMIAGIF

SEQ ID NO: 531439 - protein, 11 aa, Influenza virus
LSLAIMIAGIS

SEQ ID NO: 531440 - protein, 11 aa, Influenza virus
LSLAIMMAGIF

SEQ ID NO: 531441 - protein, 11 aa, Influenza virus
LSLAIMMAGIS

SEQ ID NO: 531442 - protein, 11 aa, Influenza virus
LSLAIMVAGIS

SEQ ID NO: 531443 - protein, 11 aa, Influenza virus
LSLIMRTVIAL

SEQ ID NO: 531444 - protein, 11 aa, Influenza virus
LSLLEMCHSTQ

SEQ ID NO: 531445 - protein, 11 aa, Influenza virus
LSLYSTVASSL

SEQ ID NO: 531446 - protein, 11 aa, Influenza virus
LSMAPIMFSNK

SEQ ID NO: 531447 - protein, 11 aa, Influenza virus
LSMEFSLTDPR

SEQ ID NO: 531448 - protein, 11 aa, Influenza virus
LSMVKSDKICL

SEQ ID NO: 531449 - protein, 11 aa, Influenza virus
LSMVRSDKICL

SEQ ID NO: 531450 - protein, 11 aa, Influenza virus
LSNMGIYQILA

SEQ ID NO: 531451 - protein, 11 aa, Influenza virus
LSNMGVYQILA

SEQ ID NO: 531452 - protein, 11 aa, Influenza virus
LSNMGVYQVLA

SEQ ID NO: 531453 - protein, 11 aa, Influenza virus
LSNNATDTVDT

SEQ ID NO: 531454 - protein, 11 aa, Influenza virus
LSNNSSDTVDT

SEQ ID NO: 531455 - protein, 11 aa, Influenza virus
LSNNSTDKIDT

SEQ ID NO: 531456 - protein, 11 aa, Influenza virus
LSNNSTDKVDT

SEQ ID NO: 531457 - protein, 11 aa, Influenza virus
LSNNSTDKVNT

SEQ ID NO: 531458 - protein, 11 aa, Influenza virus
LSNNSTDTVDT

SEQ ID NO: 531459 - protein, 11 aa, Influenza virus
LSNNSTEKVDT

SEQ ID NO: 531460 - protein, 11 aa, Influenza virus
LSNNSTERVDT

SEQ ID NO: 531461 - protein, 11 aa, Influenza virus
LSNPKCDLYLN

SEQ ID NO: 531462 - protein, 11 aa, Influenza virus
LSPEEISETQG

SEQ ID NO: 531463 - protein, 11 aa, Influenza virus
LSPEEVSEAQG

SEQ ID NO: 531464 - protein, 11 aa, Influenza virus
LSPEEVSETQG

SEQ ID NO: 531465 - protein, 11 aa, Influenza virus
LSPGMMMGMFN

SEQ ID NO: 531466 - protein, 11 aa, Influenza virus
LSPLTKGILGF

SEQ ID NO: 531467 - protein, 11 aa, Influenza virus
LSPLTKGMLGF

SEQ ID NO: 531468 - protein, 11 aa, Influenza virus
LSPNVYQARFE

SEQ ID NO: 531469 - protein, 11 aa, Influenza virus
LSPRTVGQCPK

SEQ ID NO: 531470 - protein, 11 aa, Influenza virus
LSQGTTIRGKH

SEQ ID NO: 531471 - protein, 11 aa, Influenza virus
LSQGTTIRGRH

SEQ ID NO: 531472 - protein, 11 aa, Influenza virus
LSQGTTLKGRH

SEQ ID NO: 531473 - protein, 11 aa, Influenza virus
LSQGTTLRGQH

SEQ ID NO: 531474 - protein, 11 aa, Influenza virus
LSQGTTLRGRH

SEQ ID NO: 531475 - protein, 11 aa, Influenza virus
LSQKFEEIRWL

SEQ ID NO: 531476 - protein, 11 aa, Influenza virus
LSRCRETRGLF

SEQ ID NO: 531477 - protein, 11 aa, Influenza virus
LSRCRKTRGLF

SEQ ID NO: 531478 - protein, 11 aa, Influenza virus
LSRLNINPVKL

SEQ ID NO: 531479 - protein, 11 aa, Influenza virus
LSSGYKDIILW

SEQ ID NO: 531480 - protein, 11 aa, Influenza virus
LSSGYKDVIIW

SEQ ID NO: 531481 - protein, 11 aa, Influenza virus
LSSGYKDVILW

SEQ ID NO: 531482 - protein, 11 aa, Influenza virus
LSSGYKEVILW

SEQ ID NO: 531483 - protein, 11 aa, Influenza virus
LSSKANQVFPQ

SEQ ID NO: 531484 - protein, 11 aa, Influenza virus
LSSKDNQVFPQ

SEQ ID NO: 531485 - protein, 11 aa, Influenza virus
LSSMGIYQILA

SEQ ID NO: 531486 - protein, 11 aa, Influenza virus
LSSMGVYQILA

SEQ ID NO: 531487 - protein, 11 aa, Influenza virus
LSSRISFYWTI

SEQ ID NO: 531488 - protein, 11 aa, Influenza virus
LSSSGNNQVFP

SEQ ID NO: 531489 - protein, 11 aa, Influenza virus
LSSSMNNQVFP

SEQ ID NO: 531490 - protein, 11 aa, Influenza virus
LSSVNTNTINR

SEQ ID NO: 531491 - protein, 11 aa, Influenza virus
LSSVSSFEKFE

SEQ ID NO: 531492 - protein, 11 aa, Influenza virus
LSSVSSFERFE

SEQ ID NO: 531493 - protein, 11 aa, Influenza virus
LSSVSSFKRFE

SEQ ID NO: 531494 - protein, 11 aa, Influenza virus
LSSVTTNTINR

SEQ ID NO: 531495 - protein, 11 aa, Influenza virus
LSTIALFIGVG

SEQ ID NO: 531496 - protein, 11 aa, Influenza virus
LSTIALIIGVG

SEQ ID NO: 531497 - protein, 11 aa, Influenza virus
LSTIALLIGIG

SEQ ID NO: 531498 - protein, 11 aa, Influenza virus
LSTIALLIGVG

SEQ ID NO: 531499 - protein, 11 aa, Influenza virus
LSTKALLIGIG

SEQ ID NO: 531500 - protein, 11 aa, Influenza virus
LSTNSSDKVDT

SEQ ID NO: 531501 - protein, 11 aa, Influenza virus
LSTNSSEKVDT

SEQ ID NO: 531502 - protein, 11 aa, Influenza virus
LSTNSSEKVNT

SEQ ID NO: 531503 - protein, 11 aa, Influenza virus
LSTNSSERVDT

SEQ ID NO: 531504 - protein, 11 aa, Influenza virus
LSTNSTEKVDT

SEQ ID NO: 531505 - protein, 11 aa, Influenza virus
LSTRGIQIASN

SEQ ID NO: 531506 - protein, 11 aa, Influenza virus
LSTRGVQIASN

SEQ ID NO: 531507 - protein, 11 aa, Influenza virus
LSTRGVQVASN

SEQ ID NO: 531508 - protein, 11 aa, Influenza virus
LSTVLGVSILN

SEQ ID NO: 531509 - protein, 11 aa, Influenza virus
LSTVLGVSVLN

SEQ ID NO: 531510 - protein, 11 aa, Influenza virus
LSTVSSFERFE

SEQ ID NO: 531511 - protein, 11 aa, Influenza virus
LSVAPIMFSNK

SEQ ID NO: 531512 - protein, 11 aa, Influenza virus
LSVIPSGPLKA

SEQ ID NO: 531513 - protein, 11 aa, Influenza virus
LSVLNLLIGIS

SEQ ID NO: 531514 - protein, 11 aa, Influenza virus
LSVLNLLIGVS

SEQ ID NO: 531515 - protein, 11 aa, Influenza virus
LSVYSTVASSL

SEQ ID NO: 531516 - protein, 11 aa, Influenza virus
LSYKVGYLCAG

SEQ ID NO: 531517 - protein, 11 aa, Influenza virus
LSYQVGYLCAG

SEQ ID NO: 531518 - protein, 11 aa, Influenza virus
LSYRVGYLCAG

SEQ ID NO: 531519 - protein, 11 aa, Influenza virus
LSYSAGALASC

SEQ ID NO: 531520 - protein, 11 aa, Influenza virus
LSYSTGALASC

SEQ ID NO: 531521 - protein, 11 aa, Influenza virus
LSYSVGYLCAG

SEQ ID NO: 531522 - protein, 11 aa, Influenza virus
LSYTVGYLCAG

SEQ ID NO: 531523 - protein, 11 aa, Influenza virus
LTDKGSIQSDK

SEQ ID NO: 531524 - protein, 11 aa, Influenza virus
LTDNHVEVVSA

SEQ ID NO: 531525 - protein, 11 aa, Influenza virus
LTDNPRPNDPA

SEQ ID NO: 531526 - protein, 11 aa, Influenza virus
LTDNPRPNDPN

SEQ ID NO: 531527 - protein, 11 aa, Influenza virus
LTDNPRPNDPS

SEQ ID NO: 531528 - protein, 11 aa, Influenza virus
LTDNPRPNDPT

SEQ ID NO: 531529 - protein, 11 aa, Influenza virus
LTDNPRPNDPV

SEQ ID NO: 531530 - protein, 11 aa, Influenza virus
LTDSEMNKLFD

SEQ ID NO: 531531 - protein, 11 aa, Influenza virus
LTDSEMNKLFE

SEQ ID NO: 531532 - protein, 11 aa, Influenza virus
LTDSEMNKLYE

SEQ ID NO: 531533 - protein, 11 aa, Influenza virus
LTDSEMSKLFE

SEQ ID NO: 531534 - protein, 11 aa, Influenza virus
LTDSQTATKRI

SEQ ID NO: 531535 - protein, 11 aa, Influenza virus
LTDSQTATKRL

SEQ ID NO: 531536 - protein, 11 aa, Influenza virus
LTDWSGYSGSF

SEQ ID NO: 531537 - protein, 11 aa, Influenza virus
LTEIWSYNAEL

SEQ ID NO: 531538 - protein, 11 aa, Influenza virus
LTEKGIEVVNA

SEQ ID NO: 531539 - protein, 11 aa, Influenza virus
LTEKGVEVVNA

SEQ ID NO: 531540 - protein, 11 aa, Influenza virus
LTENGVPVTSS

SEQ ID NO: 531541 - protein, 11 aa, Influenza virus
LTEQNVPVTQV

SEQ ID NO: 531542 - protein, 11 aa, Influenza virus
LTEREVEVVNA

SEQ ID NO: 531543 - protein, 11 aa, Influenza virus
LTERGIEVVNA

SEQ ID NO: 531544 - protein, 11 aa, Influenza virus
LTERGVEVVDA

SEQ ID NO: 531545 - protein, 11 aa, Influenza virus
LTERGVEVVNA

SEQ ID NO: 531546 - protein, 11 aa, Influenza virus
LTETGVPVTSS

SEQ ID NO: 531547 - protein, 11 aa, Influenza virus
LTEVETYVLSI

SEQ ID NO: 531548 - protein, 11 aa, Influenza virus
LTEVETYVLSV

SEQ ID NO: 531549 - protein, 11 aa, Influenza virus
LTFLARSALIL

SEQ ID NO: 531550 - protein, 11 aa, Influenza virus
LTGGQSFYRSI

SEQ ID NO: 531551 - protein, 11 aa, Influenza virus
LTGIWDTLIER

SEQ ID NO: 531552 - protein, 11 aa, Influenza virus
LTGMWDTLIER

SEQ ID NO: 531553 - protein, 11 aa, Influenza virus
LTGRGIEVVNA

SEQ ID NO: 531554 - protein, 11 aa, Influenza virus
LTGTAKHIEEC

SEQ ID NO: 531555 - protein, 11 aa, Influenza virus
LTGTWDTLIER

SEQ ID NO: 531556 - protein, 11 aa, Influenza virus
LTHALRELWQC

SEQ ID NO: 531557 - protein, 11 aa, Influenza virus
LTHGALLNDKH

SEQ ID NO: 531558 - protein, 11 aa, Influenza virus
LTHGSLLNDKH

SEQ ID NO: 531559 - protein, 11 aa, Influenza virus
LTHHMRKKRGL

SEQ ID NO: 531560 - protein, 11 aa, Influenza virus
LTHIMIWHSNL

SEQ ID NO: 531561 - protein, 11 aa, Influenza virus
LTHLMIWHSNL

SEQ ID NO: 531562 - protein, 11 aa, Influenza virus
LTHMMIWHSNL

SEQ ID NO: 531563 - protein, 11 aa, Influenza virus
LTIGECPKYIK

SEQ ID NO: 531564 - protein, 11 aa, Influenza virus
LTIGECPKYVK

SEQ ID NO: 531565 - protein, 11 aa, Influenza virus
LTIGECPKYVR

SEQ ID NO: 531566 - protein, 11 aa, Influenza virus
LTIGECPRYVK

SEQ ID NO: 531567 - protein, 11 aa, Influenza virus
LTIGISGPDDG

SEQ ID NO: 531568 - protein, 11 aa, Influenza virus
LTIGISGPDNE

SEQ ID NO: 531569 - protein, 11 aa, Influenza virus
LTIGISGPDNG

SEQ ID NO: 531570 - protein, 11 aa, Influenza virus
LTIGITGPDAT

SEQ ID NO: 531571 - protein, 11 aa, Influenza virus
LTIGKCPKYVK

SEQ ID NO: 531572 - protein, 11 aa, Influenza virus
LTIIYSSSMMW

SEQ ID NO: 531573 - protein, 11 aa, Influenza virus
LTITYSSPMMW

SEQ ID NO: 531574 - protein, 11 aa, Influenza virus
LTITYSSSLMW

SEQ ID NO: 531575 - protein, 11 aa, Influenza virus
LTITYSSSMMW

SEQ ID NO: 531576 - protein, 11 aa, Influenza virus
LTIYSTAASSL

SEQ ID NO: 531577 - protein, 11 aa, Influenza virus
LTIYSTVASSF

SEQ ID NO: 531578 - protein, 11 aa, Influenza virus
LTIYSTVASSI

SEQ ID NO: 531579 - protein, 11 aa, Influenza virus
LTIYSTVASSL

SEQ ID NO: 531580 - protein, 11 aa, Influenza virus
LTKATNGNYGP

SEQ ID NO: 531581 - protein, 11 aa, Influenza virus
LTKETNGNYGP

SEQ ID NO: 531582 - protein, 11 aa, Influenza virus
LTKGEKANVLI

SEQ ID NO: 531583 - protein, 11 aa, Influenza virus
LTKGILGFVFT

SEQ ID NO: 531584 - protein, 11 aa, Influenza virus
LTKGLCIINSW

SEQ ID NO: 531585 - protein, 11 aa, Influenza virus
LTKGLCTINSW

SEQ ID NO: 531586 - protein, 11 aa, Influenza virus
LTKGMLGFVFT

SEQ ID NO: 531587 - protein, 11 aa, Influenza virus
LTKGVLGFVFT

SEQ ID NO: 531588 - protein, 11 aa, Influenza virus
LTKITVDHMAI

SEQ ID NO: 531589 - protein, 11 aa, Influenza virus
LTKKEPDTYDF

SEQ ID NO: 531590 - protein, 11 aa, Influenza virus
LTKKKNPEAYN

SEQ ID NO: 531591 - protein, 11 aa, Influenza virus
LTKKKPDIYDF

SEQ ID NO: 531592 - protein, 11 aa, Influenza virus
LTKKKPDTYDF

SEQ ID NO: 531593 - protein, 11 aa, Influenza virus
LTKRLCTINSW

SEQ ID NO: 531594 - protein, 11 aa, Influenza virus
LTKTTVDHMAI

SEQ ID NO: 531595 - protein, 11 aa, Influenza virus
LTKTTVDHMAV

SEQ ID NO: 531596 - protein, 11 aa, Influenza virus
LTLGITGPDAT

SEQ ID NO: 531597 - protein, 11 aa, Influenza virus
LTLGITGPDST

SEQ ID NO: 531598 - protein, 11 aa, Influenza virus
LTLGITGPDTT

SEQ ID NO: 531599 - protein, 11 aa, Influenza virus
LTLKLGQFPVQ

SEQ ID NO: 531600 - protein, 11 aa, Influenza virus
LTLKSEQFPVQ

SEQ ID NO: 531601 - protein, 11 aa, Influenza virus
LTLKSGQFPVQ

SEQ ID NO: 531602 - protein, 11 aa, Influenza virus
LTLNTMTKDAE

SEQ ID NO: 531603 - protein, 11 aa, Influenza virus
LTMGECPKYVK

SEQ ID NO: 531604 - protein, 11 aa, Influenza virus
LTMGYKDIILW

SEQ ID NO: 531605 - protein, 11 aa, Influenza virus
LTNSEMNKLYE

SEQ ID NO: 531606 - protein, 11 aa, Influenza virus
LTQGACWEQLY

SEQ ID NO: 531607 - protein, 11 aa, Influenza virus
LTQGALLNDKH

SEQ ID NO: 531608 - protein, 11 aa, Influenza virus
LTQGALLNDRH

SEQ ID NO: 531609 - protein, 11 aa, Influenza virus
LTQGRQTFDWT

SEQ ID NO: 531610 - protein, 11 aa, Influenza virus
LTQGRQTYDWT

SEQ ID NO: 531611 - protein, 11 aa, Influenza virus
LTQGSLLNDKH

SEQ ID NO: 531612 - protein, 11 aa, Influenza virus
LTQGSLLNDRH

SEQ ID NO: 531613 - protein, 11 aa, Influenza virus
LTQGTCWEQLY

SEQ ID NO: 531614 - protein, 11 aa, Influenza virus
LTQGTCWEQMY

SEQ ID NO: 531615 - protein, 11 aa, Influenza virus
LTQGYKDIILW

SEQ ID NO: 531616 - protein, 11 aa, Influenza virus
LTQGYKDVILW

SEQ ID NO: 531617 - protein, 11 aa, Influenza virus
LTQTLVSNNDW

SEQ ID NO: 531618 - protein, 11 aa, Influenza virus
LTRELCTINSW

SEQ ID NO: 531619 - protein, 11 aa, Influenza virus
LTRGLCTINSW

SEQ ID NO: 531620 - protein, 11 aa, Influenza virus
LTRTTVDHMAI

SEQ ID NO: 531621 - protein, 11 aa, Influenza virus
LTSLPFQNIHP

SEQ ID NO: 531622 - protein, 11 aa, Influenza virus
LTSVTTNTINR

SEQ ID NO: 531623 - protein, 11 aa, Influenza virus
LTTGKSHGRIL

SEQ ID NO: 531624 - protein, 11 aa, Influenza virus
LTTIGLLLQIT

SEQ ID NO: 531625 - protein, 11 aa, Influenza virus
LTTIGPLLQIT

SEQ ID NO: 531626 - protein, 11 aa, Influenza virus
LTTRGVQIASN

SEQ ID NO: 531627 - protein, 11 aa, Influenza virus
LTTTIKPWARN

SEQ ID NO: 531628 - protein, 11 aa, Influenza virus
LTTTIKTWAGK

SEQ ID NO: 531629 - protein, 11 aa, Influenza virus
LTTTIKTWAGN

SEQ ID NO: 531630 - protein, 11 aa, Influenza virus
LTTTIKTWAKN

SEQ ID NO: 531631 - protein, 11 aa, Influenza virus
LTTTIKTWARN

SEQ ID NO: 531632 - protein, 11 aa, Influenza virus
LTTTIRTWAKN

SEQ ID NO: 531633 - protein, 11 aa, Influenza virus
LTTTPTKSYFA

SEQ ID NO: 531634 - protein, 11 aa, Influenza virus
LTTTVKTWAGN

SEQ ID NO: 531635 - protein, 11 aa, Influenza virus
LTTVGLLLQII

SEQ ID NO: 531636 - protein, 11 aa, Influenza virus
LTTVGLLLQIT

SEQ ID NO: 531637 - protein, 11 aa, Influenza virus
LTTVGLLLQVT

SEQ ID NO: 531638 - protein, 11 aa, Influenza virus
LTVEVPYVCTE

SEQ ID NO: 531639 - protein, 11 aa, Influenza virus
LTVNVRGSGLR

SEQ ID NO: 531640 - protein, 11 aa, Influenza virus
LTVNVRGSGMR

SEQ ID NO: 531641 - protein, 11 aa, Influenza virus
LTVNVRGTGMR

SEQ ID NO: 531642 - protein, 11 aa, Influenza virus
LTVPSERGLQR

SEQ ID NO: 531643 - protein, 11 aa, Influenza virus
LTVSVRGSGMR

SEQ ID NO: 531644 - protein, 11 aa, Influenza virus
LTVTHSVNLLE

SEQ ID NO: 531645 - protein, 11 aa, Influenza virus
LVADGGPNLYN

SEQ ID NO: 531646 - protein, 11 aa, Influenza virus
LVAGGLILGMQ

SEQ ID NO: 531647 - protein, 11 aa, Influenza virus
LVAGWYGFQHQ

SEQ ID NO: 531648 - protein, 11 aa, Influenza virus
LVAGWYGFQHS

SEQ ID NO: 531649 - protein, 11 aa, Influenza virus
LVAGWYGFQHT

SEQ ID NO: 531650 - protein, 11 aa, Influenza virus
LVAIENQHTID

SEQ ID NO: 531651 - protein, 11 aa, Influenza virus
LVALALSHTAY

SEQ ID NO: 531652 - protein, 11 aa, Influenza virus
LVALCGSPISV

SEQ ID NO: 531653 - protein, 11 aa, Influenza virus
LVALCGSPVPV

SEQ ID NO: 531654 - protein, 11 aa, Influenza virus
LVALCGSPVSV

SEQ ID NO: 531655 - protein, 11 aa, Influenza virus
LVALENQHTID

SEQ ID NO: 531656 - protein, 11 aa, Influenza virus
LVALENQHTIH

SEQ ID NO: 531657 - protein, 11 aa, Influenza virus
LVALENQNTID

SEQ ID NO: 531658 - protein, 11 aa, Influenza virus
LVAMENQHTID

SEQ ID NO: 531659 - protein, 11 aa, Influenza virus
LVAPEYGFKIS

SEQ ID NO: 531660 - protein, 11 aa, Influenza virus
LVAVENQHTID

SEQ ID NO: 531661 - protein, 11 aa, Influenza virus
LVCATCEQIAD

SEQ ID NO: 531662 - protein, 11 aa, Influenza virus
LVCVSLLQSAI

SEQ ID NO: 531663 - protein, 11 aa, Influenza virus
LVDALLGDPHC

SEQ ID NO: 531664 - protein, 11 aa, Influenza virus
LVDGQDCDLIN

SEQ ID NO: 531665 - protein, 11 aa, Influenza virus
LVDGWYGFRHQ

SEQ ID NO: 531666 - protein, 11 aa, Influenza virus
LVDSIGSWSQN

SEQ ID NO: 531667 - protein, 11 aa, Influenza virus
LVDSIVSWSQN

SEQ ID NO: 531668 - protein, 11 aa, Influenza virus
LVETNHTDELC

SEQ ID NO: 531669 - protein, 11 aa, Influenza virus
LVETNHTGTYC

SEQ ID NO: 531670 - protein, 11 aa, Influenza virus
LVETSHTGTYC

SEQ ID NO: 531671 - protein, 11 aa, Influenza virus
LVFFCLKNGNM

SEQ ID NO: 531672 - protein, 11 aa, Influenza virus
LVFFCLRNGNM

SEQ ID NO: 531673 - protein, 11 aa, Influenza virus
LVFICIKNGNM

SEQ ID NO: 531674 - protein, 11 aa, Influenza virus
LVFICIKNGNV

SEQ ID NO: 531675 - protein, 11 aa, Influenza virus
LVFICMKNGNM

SEQ ID NO: 531676 - protein, 11 aa, Influenza virus
LVFICVKNGNM

SEQ ID NO: 531677 - protein, 11 aa, Influenza virus
LVFMCVKNGNM

SEQ ID NO: 531678 - protein, 11 aa, Influenza virus
LVFREQKQEFK

SEQ ID NO: 531679 - protein, 11 aa, Influenza virus
LVGDTPRNDDG

SEQ ID NO: 531680 - protein, 11 aa, Influenza virus
LVGDTPRNDDI

SEQ ID NO: 531681 - protein, 11 aa, Influenza virus
LVGDTPRNDDR

SEQ ID NO: 531682 - protein, 11 aa, Influenza virus
LVGDTPRNDDS

SEQ ID NO: 531683 - protein, 11 aa, Influenza virus
LVGDTPRNEDG

SEQ ID NO: 531684 - protein, 11 aa, Influenza virus
LVGDTPRNEDS

SEQ ID NO: 531685 - protein, 11 aa, Influenza virus
LVGDTPRNGDS

SEQ ID NO: 531686 - protein, 11 aa, Influenza virus
LVGDTPRNNDS

SEQ ID NO: 531687 - protein, 11 aa, Influenza virus
LVGDTPRSDDS

SEQ ID NO: 531688 - protein, 11 aa, Influenza virus
LVGIDPFKLLQ

SEQ ID NO: 531689 - protein, 11 aa, Influenza virus
LVGIDPFRLLQ

SEQ ID NO: 531690 - protein, 11 aa, Influenza virus
LVGINMSKKKS

SEQ ID NO: 531691 - protein, 11 aa, Influenza virus
LVGINMSKRKS

SEQ ID NO: 531692 - protein, 11 aa, Influenza virus
LVGLILAFILW

SEQ ID NO: 531693 - protein, 11 aa, Influenza virus
LVGLILAFIMW

SEQ ID NO: 531694 - protein, 11 aa, Influenza virus
LVGLILSFIMW

SEQ ID NO: 531695 - protein, 11 aa, Influenza virus
LVGLILTFIMW

SEQ ID NO: 531696 - protein, 11 aa, Influenza virus
LVGPILSFIMW

SEQ ID NO: 531697 - protein, 11 aa, Influenza virus
LVGVDPFKLLQ

SEQ ID NO: 531698 - protein, 11 aa, Influenza virus
LVGVDPFRLLQ

SEQ ID NO: 531699 - protein, 11 aa, Influenza virus
LVIAARNIVRR

SEQ ID NO: 531700 - protein, 11 aa, Influenza virus
LVLATGLRNAH

SEQ ID NO: 531701 - protein, 11 aa, Influenza virus
LVLATGLRNIP

SEQ ID NO: 531702 - protein, 11 aa, Influenza virus
LVLATGLRNVP

SEQ ID NO: 531703 - protein, 11 aa, Influenza virus
LVLATGPRNVP

SEQ ID NO: 531704 - protein, 11 aa, Influenza virus
LVLDDCSLEGI

SEQ ID NO: 531705 - protein, 11 aa, Influenza virus
LVLDDCSLEGL

SEQ ID NO: 531706 - protein, 11 aa, Influenza virus
LVLDDCSLKGL

SEQ ID NO: 531707 - protein, 11 aa, Influenza virus
LVLGDCSIAGW

SEQ ID NO: 531708 - protein, 11 aa, Influenza virus
LVLGLSMVKSD

SEQ ID NO: 531709 - protein, 11 aa, Influenza virus
LVLGLSMVRSD

SEQ ID NO: 531710 - protein, 11 aa, Influenza virus
LVLGNPKCDLY

SEQ ID NO: 531711 - protein, 11 aa, Influenza virus
LVLIENDRTLD

SEQ ID NO: 531712 - protein, 11 aa, Influenza virus
LVLIENERTLD

SEQ ID NO: 531713 - protein, 11 aa, Influenza virus
LVLIENQKTLD

SEQ ID NO: 531714 - protein, 11 aa, Influenza virus
LVLLEDERTLD

SEQ ID NO: 531715 - protein, 11 aa, Influenza virus
LVLLENDKTLD

SEQ ID NO: 531716 - protein, 11 aa, Influenza virus
LVLLENDKTLN

SEQ ID NO: 531717 - protein, 11 aa, Influenza virus
LVLLENDRTLD

SEQ ID NO: 531718 - protein, 11 aa, Influenza virus
LVLLENEKTLD

SEQ ID NO: 531719 - protein, 11 aa, Influenza virus
LVLLENERTLD

SEQ ID NO: 531720 - protein, 11 aa, Influenza virus
LVLLENGRTLD

SEQ ID NO: 531721 - protein, 11 aa, Influenza virus
LVLLENGRTLG

SEQ ID NO: 531722 - protein, 11 aa, Influenza virus
LVLLENQKILD

SEQ ID NO: 531723 - protein, 11 aa, Influenza virus
LVLLENQKPLD

SEQ ID NO: 531724 - protein, 11 aa, Influenza virus
LVLLENQKTLD

SEQ ID NO: 531725 - protein, 11 aa, Influenza virus
LVLLETKKKLD

SEQ ID NO: 531726 - protein, 11 aa, Influenza virus
LVLLFMIIGGF

SEQ ID NO: 531727 - protein, 11 aa, Influenza virus
LVLLGNQKTLD

SEQ ID NO: 531728 - protein, 11 aa, Influenza virus
LVLLLMIIGGF

SEQ ID NO: 531729 - protein, 11 aa, Influenza virus
LVLMENEMTLD

SEQ ID NO: 531730 - protein, 11 aa, Influenza virus
LVLMENERILD

SEQ ID NO: 531731 - protein, 11 aa, Influenza virus
LVLMENERTLD

SEQ ID NO: 531732 - protein, 11 aa, Influenza virus
LVLMENERTLG

SEQ ID NO: 531733 - protein, 11 aa, Influenza virus
LVLMENERTLY

SEQ ID NO: 531734 - protein, 11 aa, Influenza virus
LVLNKSLCKVE

SEQ ID NO: 531735 - protein, 11 aa, Influenza virus
LVLWGIHHPDS

SEQ ID NO: 531736 - protein, 11 aa, Influenza virus
LVLWGIHHPDT

SEQ ID NO: 531737 - protein, 11 aa, Influenza virus
LVMGQQGRMDY

SEQ ID NO: 531738 - protein, 11 aa, Influenza virus
LVMKRKRDSSI

SEQ ID NO: 531739 - protein, 11 aa, Influenza virus
LVMKRKRNSSI

SEQ ID NO: 531740 - protein, 11 aa, Influenza virus
LVMWGIHHPSS

SEQ ID NO: 531741 - protein, 11 aa, Influenza virus
LVNPGDSIIFN

SEQ ID NO: 531742 - protein, 11 aa, Influenza virus
LVNTYQWIIKN

SEQ ID NO: 531743 - protein, 11 aa, Influenza virus
LVNTYQWIIRN

SEQ ID NO: 531744 - protein, 11 aa, Influenza virus
LVNTYQWVIRN

SEQ ID NO: 531745 - protein, 11 aa, Influenza virus
LVPCEPIIIER

SEQ ID NO: 531746 - protein, 11 aa, Influenza virus
LVPCFWLEMIR

SEQ ID NO: 531747 - protein, 11 aa, Influenza virus
LVPCFWVEMIR

SEQ ID NO: 531748 - protein, 11 aa, Influenza virus
LVREQQGRMDY

SEQ ID NO: 531749 - protein, 11 aa, Influenza virus
LVRGNSPAFNY

SEQ ID NO: 531750 - protein, 11 aa, Influenza virus
LVRGNSPVFNH

SEQ ID NO: 531751 - protein, 11 aa, Influenza virus
LVRGNSPVFNY

SEQ ID NO: 531752 - protein, 11 aa, Influenza virus
LVRGQQGRMDY

SEQ ID NO: 531753 - protein, 11 aa, Influenza virus
LVRGQQGTMDY

SEQ ID NO: 531754 - protein, 11 aa, Influenza virus
LVRGQQGWMDY

SEQ ID NO: 531755 - protein, 11 aa, Influenza virus
LVRKTRFLPVA

SEQ ID NO: 531756 - protein, 11 aa, Influenza virus
LVRKTRFLPVS

SEQ ID NO: 531757 - protein, 11 aa, Influenza virus
LVRKTRFLPVT

SEQ ID NO: 531758 - protein, 11 aa, Influenza virus
LVRKTRFLPVV

SEQ ID NO: 531759 - protein, 11 aa, Influenza virus
LVRMIKRGIND

SEQ ID NO: 531760 - protein, 11 aa, Influenza virus
LVRSGMDPRMC

SEQ ID NO: 531761 - protein, 11 aa, Influenza virus
LVRTGMDPRMC

SEQ ID NO: 531762 - protein, 11 aa, Influenza virus
LVSDGGPNLYN

SEQ ID NO: 531763 - protein, 11 aa, Influenza virus
LVSLGAIGFWM

SEQ ID NO: 531764 - protein, 11 aa, Influenza virus
LVSLGAISFWM

SEQ ID NO: 531765 - protein, 11 aa, Influenza virus
LVSLGAVSFWM

SEQ ID NO: 531766 - protein, 11 aa, Influenza virus
LVSLLEMCHST

SEQ ID NO: 531767 - protein, 11 aa, Influenza virus
LVSNDDWSGYS

SEQ ID NO: 531768 - protein, 11 aa, Influenza virus
LVSNNDWSGYS

SEQ ID NO: 531769 - protein, 11 aa, Influenza virus
LVSNSDWSGYS

SEQ ID NO: 531770 - protein, 11 aa, Influenza virus
LVSTKEWSKRY

SEQ ID NO: 531771 - protein, 11 aa, Influenza virus
LVSTKEWSRRY

SEQ ID NO: 531772 - protein, 11 aa, Influenza virus
LVSTNAYDRIC

SEQ ID NO: 531773 - protein, 11 aa, Influenza virus
LVSWEMGQAPS

SEQ ID NO: 531774 - protein, 11 aa, Influenza virus
LVSWPLSSPPT

SEQ ID NO: 531775 - protein, 11 aa, Influenza virus
LVTDGPSDAQA

SEQ ID NO: 531776 - protein, 11 aa, Influenza virus
LVTGKSHGRIL

SEQ ID NO: 531777 - protein, 11 aa, Influenza virus
LVTREPYISCD

SEQ ID NO: 531778 - protein, 11 aa, Influenza virus
LVTREPYLSCD

SEQ ID NO: 531779 - protein, 11 aa, Influenza virus
LVTREPYLSCG

SEQ ID NO: 531780 - protein, 11 aa, Influenza virus
LVTREPYVSCD

SEQ ID NO: 531781 - protein, 11 aa, Influenza virus
LVTREPYVSCE

SEQ ID NO: 531782 - protein, 11 aa, Influenza virus
LVTTVTLHFKQ

SEQ ID NO: 531783 - protein, 11 aa, Influenza virus
LVVFCGTSGTY

SEQ ID NO: 531784 - protein, 11 aa, Influenza virus
LVVSLGAISFW

SEQ ID NO: 531785 - protein, 11 aa, Influenza virus
LVWLENEKTLD

SEQ ID NO: 531786 - protein, 11 aa, Influenza virus
LVWMACHSAAF

SEQ ID NO: 531787 - protein, 11 aa, Influenza virus
LVWMACNSAAF

SEQ ID NO: 531788 - protein, 11 aa, Influenza virus
LWACQNGNIRC

SEQ ID NO: 531789 - protein, 11 aa, Influenza virus
LWACQNGNIRW

SEQ ID NO: 531790 - protein, 11 aa, Influenza virus
LWACQNGNLRC

SEQ ID NO: 531791 - protein, 11 aa, Influenza virus
LWACQNGNVRC

SEQ ID NO: 531792 - protein, 11 aa, Influenza virus
LWACQTGNIRC

SEQ ID NO: 531793 - protein, 11 aa, Influenza virus
LWACSSGNCRF

SEQ ID NO: 531794 - protein, 11 aa, Influenza virus
LWAYNAELLVL

SEQ ID NO: 531795 - protein, 11 aa, Influenza virus
LWCKIVTTVGW

SEQ ID NO: 531796 - protein, 11 aa, Influenza virus
LWDPFRQSERG

SEQ ID NO: 531797 - protein, 11 aa, Influenza virus
LWDSFRQSERG

SEQ ID NO: 531798 - protein, 11 aa, Influenza virus
LWFSFGASCFF

SEQ ID NO: 531799 - protein, 11 aa, Influenza virus
LWFSFGASCFI

SEQ ID NO: 531800 - protein, 11 aa, Influenza virus
LWFSFGASCFL

SEQ ID NO: 531801 - protein, 11 aa, Influenza virus
LWFSFGASCFT

SEQ ID NO: 531802 - protein, 11 aa, Influenza virus
LWFSFGASCFV

SEQ ID NO: 531803 - protein, 11 aa, Influenza virus
LWFSFGASCLI

SEQ ID NO: 531804 - protein, 11 aa, Influenza virus
LWFSFGASCVM

SEQ ID NO: 531805 - protein, 11 aa, Influenza virus
LWFSFGASSFV

SEQ ID NO: 531806 - protein, 11 aa, Influenza virus
LWFSLGASCFL

SEQ ID NO: 531807 - protein, 11 aa, Influenza virus
LWGIHHPDSET

SEQ ID NO: 531808 - protein, 11 aa, Influenza virus
LWGIHHPDTEA

SEQ ID NO: 531809 - protein, 11 aa, Influenza virus
LWGIHHPDTEE

SEQ ID NO: 531810 - protein, 11 aa, Influenza virus
LWGIHHPDTET

SEQ ID NO: 531811 - protein, 11 aa, Influenza virus
LWGIHHPPDAK

SEQ ID NO: 531812 - protein, 11 aa, Influenza virus
LWGIHHPPDET

SEQ ID NO: 531813 - protein, 11 aa, Influenza virus
LWGIHHPPDTK

SEQ ID NO: 531814 - protein, 11 aa, Influenza virus
LWGIHHPPNTK

SEQ ID NO: 531815 - protein, 11 aa, Influenza virus
LWGVHHPSSDN

SEQ ID NO: 531816 - protein, 11 aa, Influenza virus
LWHVRKRFADQ

SEQ ID NO: 531817 - protein, 11 aa, Influenza virus
LWISFAISCFL

SEQ ID NO: 531818 - protein, 11 aa, Influenza virus
LWISFAISCLL

SEQ ID NO: 531819 - protein, 11 aa, Influenza virus
LWISFAMSCFL

SEQ ID NO: 531820 - protein, 11 aa, Influenza virus
LWISFATSCFL

SEQ ID NO: 531821 - protein, 11 aa, Influenza virus
LWISFSISCFL

SEQ ID NO: 531822 - protein, 11 aa, Influenza virus
LWISFSMSCFV

SEQ ID NO: 531823 - protein, 11 aa, Influenza virus
LWMCFNGSLQC

SEQ ID NO: 531824 - protein, 11 aa, Influenza virus
LWMCSHGSLQC

SEQ ID NO: 531825 - protein, 11 aa, Influenza virus
LWMCSNGSLQC

SEQ ID NO: 531826 - protein, 11 aa, Influenza virus
LWMCSNGSYNA

SEQ ID NO: 531827 - protein, 11 aa, Influenza virus
LWSYNADVLVA

SEQ ID NO: 531828 - protein, 11 aa, Influenza virus
LWSYNAELLIA

SEQ ID NO: 531829 - protein, 11 aa, Influenza virus
LWSYNAELLVA

SEQ ID NO: 531830 - protein, 11 aa, Influenza virus
LWSYNAGLLVA

SEQ ID NO: 531831 - protein, 11 aa, Influenza virus
LWSYNAQLLVL

SEQ ID NO: 531832 - protein, 11 aa, Influenza virus
LWTSNSIVALC

SEQ ID NO: 531833 - protein, 11 aa, Influenza virus
LWTSNSIVVFC

SEQ ID NO: 531834 - protein, 11 aa, Influenza virus
LWTSNSVVALC

SEQ ID NO: 531835 - protein, 11 aa, Influenza virus
LWTYNAELLIL

SEQ ID NO: 531836 - protein, 11 aa, Influenza virus
LWVEMIRGQPK

SEQ ID NO: 531837 - protein, 11 aa, Influenza virus
LWVSFSISCFL

SEQ ID NO: 531838 - protein, 11 aa, Influenza virus
LYASKNPYTLV

SEQ ID NO: 531839 - protein, 11 aa, Influenza virus
LYASPQLEGFS

SEQ ID NO: 531840 - protein, 11 aa, Influenza virus
LYASSQLEGFS

SEQ ID NO: 531841 - protein, 11 aa, Influenza virus
LYDAIEECLIN

SEQ ID NO: 531842 - protein, 11 aa, Influenza virus
LYDKVRLQLKD

SEQ ID NO: 531843 - protein, 11 aa, Influenza virus
LYDKVRLQLRD

SEQ ID NO: 531844 - protein, 11 aa, Influenza virus
LYDKVRMQLKD

SEQ ID NO: 531845 - protein, 11 aa, Influenza virus
LYDKVRMQLRD

SEQ ID NO: 531846 - protein, 11 aa, Influenza virus
LYDRVRKQLRQ

SEQ ID NO: 531847 - protein, 11 aa, Influenza virus
LYDRVRLQLRD

SEQ ID NO: 531848 - protein, 11 aa, Influenza virus
LYDRVRMQLRD

SEQ ID NO: 531849 - protein, 11 aa, Influenza virus
LYEAIEECLIN

SEQ ID NO: 531850 - protein, 11 aa, Influenza virus
LYEAVEECLIN

SEQ ID NO: 531851 - protein, 11 aa, Influenza virus
LYEKVRLQLRD

SEQ ID NO: 531852 - protein, 11 aa, Influenza virus
LYEKVRMQLRD

SEQ ID NO: 531853 - protein, 11 aa, Influenza virus
LYEKVRRQLRE

SEQ ID NO: 531854 - protein, 11 aa, Influenza virus
LYERVKKQLRE

SEQ ID NO: 531855 - protein, 11 aa, Influenza virus
LYERVKRQLRE

SEQ ID NO: 531856 - protein, 11 aa, Influenza virus
LYERVRKQLRE

SEQ ID NO: 531857 - protein, 11 aa, Influenza virus
LYERVRKQLRQ

SEQ ID NO: 531858 - protein, 11 aa, Influenza virus
LYERVRRQLRE

SEQ ID NO: 531859 - protein, 11 aa, Influenza virus
LYESIEECLIN

SEQ ID NO: 531860 - protein, 11 aa, Influenza virus
LYFHDSNVKNL

SEQ ID NO: 531861 - protein, 11 aa, Influenza virus
LYGAGNKLITV

SEQ ID NO: 531862 - protein, 11 aa, Influenza virus
LYGAIEECLIN

SEQ ID NO: 531863 - protein, 11 aa, Influenza virus
LYGAQSLSISV

SEQ ID NO: 531864 - protein, 11 aa, Influenza virus
LYGFIIKGRSH

SEQ ID NO: 531865 - protein, 11 aa, Influenza virus
LYGFIVKGRSH

SEQ ID NO: 531866 - protein, 11 aa, Influenza virus
LYGSENKLITV

SEQ ID NO: 531867 - protein, 11 aa, Influenza virus
LYGSGAKLITV

SEQ ID NO: 531868 - protein, 11 aa, Influenza virus
LYGSGNKLITV

SEQ ID NO: 531869 - protein, 11 aa, Influenza virus
LYGSGNKLVTV

SEQ ID NO: 531870 - protein, 11 aa, Influenza virus
LYGSGSKLITV

SEQ ID NO: 531871 - protein, 11 aa, Influenza virus
LYGTGNKLITV

SEQ ID NO: 531872 - protein, 11 aa, Influenza virus
LYGTQPLSISV

SEQ ID NO: 531873 - protein, 11 aa, Influenza virus
LYGTQSLSISI

SEQ ID NO: 531874 - protein, 11 aa, Influenza virus
LYGTQSLSISV

SEQ ID NO: 531875 - protein, 11 aa, Influenza virus
LYIRTNGTSKI

SEQ ID NO: 531876 - protein, 11 aa, Influenza virus
LYIWGVHHPST

SEQ ID NO: 531877 - protein, 11 aa, Influenza virus
LYKKLKREITF

SEQ ID NO: 531878 - protein, 11 aa, Influenza virus
LYKKLKREMTF

SEQ ID NO: 531879 - protein, 11 aa, Influenza virus
LYKNANTLSSV

SEQ ID NO: 531880 - protein, 11 aa, Influenza virus
LYKNANTLTSV

SEQ ID NO: 531881 - protein, 11 aa, Influenza virus
LYKNTNTLSSV

SEQ ID NO: 531882 - protein, 11 aa, Influenza virus
LYKVATGRVTV

SEQ ID NO: 531883 - protein, 11 aa, Influenza virus
LYLNGREWSYI

SEQ ID NO: 531884 - protein, 11 aa, Influenza virus
LYLSGREWSYI

SEQ ID NO: 531885 - protein, 11 aa, Influenza virus
LYLTGTWDTLI

SEQ ID NO: 531886 - protein, 11 aa, Influenza virus
LYLWGVHHPSS

SEQ ID NO: 531887 - protein, 11 aa, Influenza virus
LYNIRNLHIPE

SEQ ID NO: 531888 - protein, 11 aa, Influenza virus
LYNKIEFEPFQ

SEQ ID NO: 531889 - protein, 11 aa, Influenza virus
LYNKLEFEPFQ

SEQ ID NO: 531890 - protein, 11 aa, Influenza virus
LYNKMEFEPFQ

SEQ ID NO: 531891 - protein, 11 aa, Influenza virus
LYNKVEFEPFQ

SEQ ID NO: 531892 - protein, 11 aa, Influenza virus
LYNKVRMQLRD

SEQ ID NO: 531893 - protein, 11 aa, Influenza virus
LYRKLKREITF

SEQ ID NO: 531894 - protein, 11 aa, Influenza virus
LYSGFVRTLFQ

SEQ ID NO: 531895 - protein, 11 aa, Influenza virus
LYSSPQLEGFS

SEQ ID NO: 531896 - protein, 11 aa, Influenza virus
LYTRVKRQLRE

SEQ ID NO: 531897 - protein, 11 aa, Influenza virus
LYVNKNPYTLV

SEQ ID NO: 531898 - protein, 11 aa, Influenza virus
LYVRTNGTSKI

SEQ ID NO: 531899 - protein, 11 aa, Influenza virus
LYVRTNGTSKV

SEQ ID NO: 531900 - protein, 11 aa, Influenza virus
LYWHLMHPGER

SEQ ID NO: 531901 - protein, 11 aa, Influenza virus
LYWHLMRPGER

SEQ ID NO: 531902 - protein, 11 aa, Influenza virus
LYWHLMSPGER

SEQ ID NO: 531903 - protein, 11 aa, Influenza virus
MAADKESTQKA

SEQ ID NO: 531904 - protein, 11 aa, Influenza virus
MAADQKSTQEA

SEQ ID NO: 531905 - protein, 11 aa, Influenza virus
MACHSAAFEDL

SEQ ID NO: 531906 - protein, 11 aa, Influenza virus
MACNSAAFEDL

SEQ ID NO: 531907 - protein, 11 aa, Influenza virus
MADSEMLNLYD

SEQ ID NO: 531908 - protein, 11 aa, Influenza virus
MADSEMLNLYE

SEQ ID NO: 531909 - protein, 11 aa, Influenza virus
MADSIKSWRKD

SEQ ID NO: 531910 - protein, 11 aa, Influenza virus
MADSTMLNLYE

SEQ ID NO: 531911 - protein, 11 aa, Influenza virus
MAGLSFWMCSN

SEQ ID NO: 531912 - protein, 11 aa, Influenza virus
MAGSNEQAAEA

SEQ ID NO: 531913 - protein, 11 aa, Influenza virus
MAGSSEQAAEA

SEQ ID NO: 531914 - protein, 11 aa, Influenza virus
MAIDNMQNKLN

SEQ ID NO: 531915 - protein, 11 aa, Influenza virus
MAIIKKYTSAR

SEQ ID NO: 531916 - protein, 11 aa, Influenza virus
MAIIKKYTSGR

SEQ ID NO: 531917 - protein, 11 aa, Influenza virus
MAIIKRYTSGR

SEQ ID NO: 531918 - protein, 11 aa, Influenza virus
MAKCNTKCQTS

SEQ ID NO: 531919 - protein, 11 aa, Influenza virus
MALQGTKRSYE

SEQ ID NO: 531920 - protein, 11 aa, Influenza virus
MALQLFIKDYR

SEQ ID NO: 531921 - protein, 11 aa, Influenza virus
MAPIMFSNKMA

SEQ ID NO: 531922 - protein, 11 aa, Influenza virus
MARAVKLYKKL

SEQ ID NO: 531923 - protein, 11 aa, Influenza virus
MARCNTKCQTS

SEQ ID NO: 531924 - protein, 11 aa, Influenza virus
MARLGKGYMFE

SEQ ID NO: 531925 - protein, 11 aa, Influenza virus
MARLGRGYMFE

SEQ ID NO: 531926 - protein, 11 aa, Influenza virus
MARSALILRGS

SEQ ID NO: 531927 - protein, 11 aa, Influenza virus
MASIRNNSYDH

SEQ ID NO: 531928 - protein, 11 aa, Influenza virus
MASIRNNTYDH

SEQ ID NO: 531929 - protein, 11 aa, Influenza virus
MASIRNNTYNH

SEQ ID NO: 531930 - protein, 11 aa, Influenza virus
MASIRNSTYDH

SEQ ID NO: 531931 - protein, 11 aa, Influenza virus
MASQGTKRPYE

SEQ ID NO: 531932 - protein, 11 aa, Influenza virus
MASQGTKRSHE

SEQ ID NO: 531933 - protein, 11 aa, Influenza virus
MASQGTKRSYE

SEQ ID NO: 531934 - protein, 11 aa, Influenza virus
MATLCLGHHAV

SEQ ID NO: 531935 - protein, 11 aa, Influenza virus
MAWSSSSCHDG

SEQ ID NO: 531936 - protein, 11 aa, Influenza virus
MCAAWSSSSCF

SEQ ID NO: 531937 - protein, 11 aa, Influenza virus
MCFNGSLQCRI

SEQ ID NO: 531938 - protein, 11 aa, Influenza virus
MCNILKGKFQT

SEQ ID NO: 531939 - protein, 11 aa, Influenza virus
MCSGHSCRICI

SEQ ID NO: 531940 - protein, 11 aa, Influenza virus
MCSGLVGDTPR

SEQ ID NO: 531941 - protein, 11 aa, Influenza virus
MCSLMQGSTLP

SEQ ID NO: 531942 - protein, 11 aa, Influenza virus
MCSNGSLHGRI

SEQ ID NO: 531943 - protein, 11 aa, Influenza virus
MCSNGSLQCKI

SEQ ID NO: 531944 - protein, 11 aa, Influenza virus
MCSNGSLQCRI

SEQ ID NO: 531945 - protein, 11 aa, Influenza virus
MCSNGSLQCRV

SEQ ID NO: 531946 - protein, 11 aa, Influenza virus
MCSNGSLQCTI

SEQ ID NO: 531947 - protein, 11 aa, Influenza virus
MCSNGSLQFRI

SEQ ID NO: 531948 - protein, 11 aa, Influenza virus
MCSNGSLRCRI

SEQ ID NO: 531949 - protein, 11 aa, Influenza virus
MCSSTEFLGQW

SEQ ID NO: 531950 - protein, 11 aa, Influenza virus
MCSWSLQCRIC

SEQ ID NO: 531951 - protein, 11 aa, Influenza virus
MCVCRDNWHGS

SEQ ID NO: 531952 - protein, 11 aa, Influenza virus
MCVGWSSTTCH

SEQ ID NO: 531953 - protein, 11 aa, Influenza virus
MCVKNGNLRCT

SEQ ID NO: 531954 - protein, 11 aa, Influenza virus
MCVKNGNMRCT

SEQ ID NO: 531955 - protein, 11 aa, Influenza virus
MCYPGFVENLE

SEQ ID NO: 531956 - protein, 11 aa, Influenza virus
MCYPGSIENLE

SEQ ID NO: 531957 - protein, 11 aa, Influenza virus
MCYPGSVENLE

SEQ ID NO: 531958 - protein, 11 aa, Influenza virus
MDAGNGCFDIL

SEQ ID NO: 531959 - protein, 11 aa, Influenza virus
MDALKLSIEDP

SEQ ID NO: 531960 - protein, 11 aa, Influenza virus
MDALLGDPHCD

SEQ ID NO: 531961 - protein, 11 aa, Influenza virus
MDDFQLIPMIS

SEQ ID NO: 531962 - protein, 11 aa, Influenza virus
MDEFQLIPMIS

SEQ ID NO: 531963 - protein, 11 aa, Influenza virus
MDGVTNKVNSI

SEQ ID NO: 531964 - protein, 11 aa, Influenza virus
MDGWYGFRHQN

SEQ ID NO: 531965 - protein, 11 aa, Influenza virus
MDHTSQYLCTG

SEQ ID NO: 531966 - protein, 11 aa, Influenza virus
MDKAVKLYKKL

SEQ ID NO: 531967 - protein, 11 aa, Influenza virus
MDKAVKLYRKL

SEQ ID NO: 531968 - protein, 11 aa, Influenza virus
MDKQTKTMTIT

SEQ ID NO: 531969 - protein, 11 aa, Influenza virus
MDNKTKKMTIT

SEQ ID NO: 531970 - protein, 11 aa, Influenza virus
MDNQTKKMTIT

SEQ ID NO: 531971 - protein, 11 aa, Influenza virus
MDNQTKTMTIT

SEQ ID NO: 531972 - protein, 11 aa, Influenza virus
MDPRMCSLMQG

SEQ ID NO: 531973 - protein, 11 aa, Influenza virus
MDQVREGRNPG

SEQ ID NO: 531974 - protein, 11 aa, Influenza virus
MDQVRESRNPG

SEQ ID NO: 531975 - protein, 11 aa, Influenza virus
MDRAVKLYKKL

SEQ ID NO: 531976 - protein, 11 aa, Influenza virus
MDRAVKLYRKL

SEQ ID NO: 531977 - protein, 11 aa, Influenza virus
MDSLKLSIEDP

SEQ ID NO: 531978 - protein, 11 aa, Influenza virus
MDSRSGYETFR

SEQ ID NO: 531979 - protein, 11 aa, Influenza virus
MDTIRNGTYNH

SEQ ID NO: 531980 - protein, 11 aa, Influenza virus
MDTVNRTHQYS

SEQ ID NO: 531981 - protein, 11 aa, Influenza virus
MDTVSRTHQYS

SEQ ID NO: 531982 - protein, 11 aa, Influenza virus
MDVNPTLLFLE

SEQ ID NO: 531983 - protein, 11 aa, Influenza virus
MDVNPTLLFLK

SEQ ID NO: 531984 - protein, 11 aa, Influenza virus
MDVWTYNAELL

SEQ ID NO: 531985 - protein, 11 aa, Influenza virus
MDYYWAILKPG

SEQ ID NO: 531986 - protein, 11 aa, Influenza virus
MDYYWAVLKPG

SEQ ID NO: 531987 - protein, 11 aa, Influenza virus
MDYYWGILKRG

SEQ ID NO: 531988 - protein, 11 aa, Influenza virus
MEAIRNGTYNH

SEQ ID NO: 531989 - protein, 11 aa, Influenza virus
MEAMVSRARID

SEQ ID NO: 531990 - protein, 11 aa, Influenza virus
MECRTFFLTQG

SEQ ID NO: 531991 - protein, 11 aa, Influenza virus
MEDFQLIPMIS

SEQ ID NO: 531992 - protein, 11 aa, Influenza virus
MEDFVRQCFNP

SEQ ID NO: 531993 - protein, 11 aa, Influenza virus
MEDGFIDVWTY

SEQ ID NO: 531994 - protein, 11 aa, Influenza virus
MEDGFLDVWTY

SEQ ID NO: 531995 - protein, 11 aa, Influenza virus
MEDGFLGVWTY

SEQ ID NO: 531996 - protein, 11 aa, Influenza virus
MEDGLLDVWTY

SEQ ID NO: 531997 - protein, 11 aa, Influenza virus
MEEFVRQCFNP

SEQ ID NO: 531998 - protein, 11 aa, Influenza virus
MEEGSIGKVCR

SEQ ID NO: 531999 - protein, 11 aa, Influenza virus
MEEVTNATETV

SEQ ID NO: 532000 - protein, 11 aa, Influenza virus
MEFEPFQSLIP

SEQ ID NO: 532001 - protein, 11 aa, Influenza virus
MEFEPFQSLVP

SEQ ID NO: 532002 - protein, 11 aa, Influenza virus
MEFSLTDPKLE

SEQ ID NO: 532003 - protein, 11 aa, Influenza virus
MEFSLTDPRFE

SEQ ID NO: 532004 - protein, 11 aa, Influenza virus
MEFSLTDPRLE

SEQ ID NO: 532005 - protein, 11 aa, Influenza virus
MEFSLVDPRLE

SEQ ID NO: 532006 - protein, 11 aa, Influenza virus
MEGFVRQCFNP

SEQ ID NO: 532007 - protein, 11 aa, Influenza virus
MEGICYPGSIE

SEQ ID NO: 532008 - protein, 11 aa, Influenza virus
MEGICYPGSVE

SEQ ID NO: 532009 - protein, 11 aa, Influenza virus
MEGVCYPGSIE

SEQ ID NO: 532010 - protein, 11 aa, Influenza virus
MEGVCYPGSIK

SEQ ID NO: 532011 - protein, 11 aa, Influenza virus
MEHTSQYLCTG

SEQ ID NO: 532012 - protein, 11 aa, Influenza virus
MEKNITVTHAQ

SEQ ID NO: 532013 - protein, 11 aa, Influenza virus
MEKNVTVTHAK

SEQ ID NO: 532014 - protein, 11 aa, Influenza virus
MEKNVTVTHAQ

SEQ ID NO: 532015 - protein, 11 aa, Influenza virus
MELIRMIKRGI

SEQ ID NO: 532016 - protein, 11 aa, Influenza virus
MELIRMIKRGV

SEQ ID NO: 532017 - protein, 11 aa, Influenza virus
MELIRMVKRGI

SEQ ID NO: 532018 - protein, 11 aa, Influenza virus
MELPSFGVSGI

SEQ ID NO: 532019 - protein, 11 aa, Influenza virus
MELPSFGVSGV

SEQ ID NO: 532020 - protein, 11 aa, Influenza virus
MELRRCLLQSL

SEQ ID NO: 532021 - protein, 11 aa, Influenza virus
MELVRMIKRGI

SEQ ID NO: 532022 - protein, 11 aa, Influenza virus
MEMRRCLLQSL

SEQ ID NO: 532023 - protein, 11 aa, Influenza virus
MENEMTLDFHD

SEQ ID NO: 532024 - protein, 11 aa, Influenza virus
MENERILDFHD

SEQ ID NO: 532025 - protein, 11 aa, Influenza virus
MENERTLDFHD

SEQ ID NO: 532026 - protein, 11 aa, Influenza virus
MENERTLDLHD

SEQ ID NO: 532027 - protein, 11 aa, Influenza virus
MENERTLDYHD

SEQ ID NO: 532028 - protein, 11 aa, Influenza virus
MENERTLYFHD

SEQ ID NO: 532029 - protein, 11 aa, Influenza virus
MENFVRQCFNP

SEQ ID NO: 532030 - protein, 11 aa, Influenza virus
MENLNKKVDDG

SEQ ID NO: 532031 - protein, 11 aa, Influenza virus
MENQHTIDLAD

SEQ ID NO: 532032 - protein, 11 aa, Influenza virus
MENQHTIDLTD

SEQ ID NO: 532033 - protein, 11 aa, Influenza virus
MENQHTIDMAD

SEQ ID NO: 532034 - protein, 11 aa, Influenza virus
MENQHTIEMTD

SEQ ID NO: 532035 - protein, 11 aa, Influenza virus
MEQMAGSSEQA

SEQ ID NO: 532036 - protein, 11 aa, Influenza virus
MEQVAGSSEQA

SEQ ID NO: 532037 - protein, 11 aa, Influenza virus
MERIRNNTYDH

SEQ ID NO: 532038 - protein, 11 aa, Influenza virus
MERNVTVTHAQ

SEQ ID NO: 532039 - protein, 11 aa, Influenza virus
MESGGIDKIGT

SEQ ID NO: 532040 - protein, 11 aa, Influenza virus
MESGGIDKIST

SEQ ID NO: 532041 - protein, 11 aa, Influenza virus
MESGGIDKVST

SEQ ID NO: 532042 - protein, 11 aa, Influenza virus
MESGGISKIST

SEQ ID NO: 532043 - protein, 11 aa, Influenza virus
MESGGISKMST

SEQ ID NO: 532044 - protein, 11 aa, Influenza virus
MESIKNGTYDY

SEQ ID NO: 532045 - protein, 11 aa, Influenza virus
MESIRDNTYDH

SEQ ID NO: 532046 - protein, 11 aa, Influenza virus
MESIRNGTYDH

SEQ ID NO: 532047 - protein, 11 aa, Influenza virus
MESIRNNTYDH

SEQ ID NO: 532048 - protein, 11 aa, Influenza virus
MESIRNNTYNH

SEQ ID NO: 532049 - protein, 11 aa, Influenza virus
MESRGLFGAIA

SEQ ID NO: 532050 - protein, 11 aa, Influenza virus
MESVKNGTYDY

SEQ ID NO: 532051 - protein, 11 aa, Influenza virus
MESVKNGTYNY

SEQ ID NO: 532052 - protein, 11 aa, Influenza virus
MESVRNGTYDY

SEQ ID NO: 532053 - protein, 11 aa, Influenza virus
METIKNGTYDH

SEQ ID NO: 532054 - protein, 11 aa, Influenza virus
METIKNGTYNH

SEQ ID NO: 532055 - protein, 11 aa, Influenza virus
METIKNGTYNR

SEQ ID NO: 532056 - protein, 11 aa, Influenza virus
METIRNGTYDH

SEQ ID NO: 532057 - protein, 11 aa, Influenza virus
METIRNGTYNH

SEQ ID NO: 532058 - protein, 11 aa, Influenza virus
MEVCFMYSDFH

SEQ ID NO: 532059 - protein, 11 aa, Influenza virus
MEVVFPNEVGA

SEQ ID NO: 532060 - protein, 11 aa, Influenza virus
MEWIKTRPILS

SEQ ID NO: 532061 - protein, 11 aa, Influenza virus
MEWLKTRPILS

SEQ ID NO: 532062 - protein, 11 aa, Influenza virus
MEYDAVATTHS

SEQ ID NO: 532063 - protein, 11 aa, Influenza virus
MFALSQGTTLK

SEQ ID NO: 532064 - protein, 11 aa, Influenza virus
MFALSQGTTLR

SEQ ID NO: 532065 - protein, 11 aa, Influenza virus
MFDFIKWNVTY

SEQ ID NO: 532066 - protein, 11 aa, Influenza virus
MFDFSKWNVTY

SEQ ID NO: 532067 - protein, 11 aa, Influenza virus
MFDFTKWNVTH

SEQ ID NO: 532068 - protein, 11 aa, Influenza virus
MFDFTKWNVTY

SEQ ID NO: 532069 - protein, 11 aa, Influenza virus
MFESNGGLIAP

SEQ ID NO: 532070 - protein, 11 aa, Influenza virus
MFESNGGLLAP

SEQ ID NO: 532071 - protein, 11 aa, Influenza virus
MFLYIRTNGTS

SEQ ID NO: 532072 - protein, 11 aa, Influenza virus
MFLYMRTNGTS

SEQ ID NO: 532073 - protein, 11 aa, Influenza virus
MFLYVRTNGTS

SEQ ID NO: 532074 - protein, 11 aa, Influenza virus
MFNMLSTVLGV

SEQ ID NO: 532075 - protein, 11 aa, Influenza virus
MFSNKMARLGK

SEQ ID NO: 532076 - protein, 11 aa, Influenza virus
MFSNKMARLGR

SEQ ID NO: 532077 - protein, 11 aa, Influenza virus
MFSNKVARLGK

SEQ ID NO: 532078 - protein, 11 aa, Influenza virus
MGDFVRQCFNP

SEQ ID NO: 532079 - protein, 11 aa, Influenza virus
MGEAMVSRARI

SEQ ID NO: 532080 - protein, 11 aa, Influenza virus
MGECPKYVKSD

SEQ ID NO: 532081 - protein, 11 aa, Influenza virus
MGFRYSGIKTD

SEQ ID NO: 532082 - protein, 11 aa, Influenza virus
MGFRYSGIRTD

SEQ ID NO: 532083 - protein, 11 aa, Influenza virus
MGIYQILAIYA

SEQ ID NO: 532084 - protein, 11 aa, Influenza virus
MGKCNTKCQTS

SEQ ID NO: 532085 - protein, 11 aa, Influenza virus
MGKVECVCRDN

SEQ ID NO: 532086 - protein, 11 aa, Influenza virus
MGLFFFCLKNG

SEQ ID NO: 532087 - protein, 11 aa, Influenza virus
MGLIFMCVKNG

SEQ ID NO: 532088 - protein, 11 aa, Influenza virus
MGLIYNRMGAV

SEQ ID NO: 532089 - protein, 11 aa, Influenza virus
MGLIYNRMGTI

SEQ ID NO: 532090 - protein, 11 aa, Influenza virus
MGLIYNRMGTV

SEQ ID NO: 532091 - protein, 11 aa, Influenza virus
MGLKISSSFSF

SEQ ID NO: 532092 - protein, 11 aa, Influenza virus
MGLRISSSFSF

SEQ ID NO: 532093 - protein, 11 aa, Influenza virus
MGLVFFCLKNG

SEQ ID NO: 532094 - protein, 11 aa, Influenza virus
MGLVFFCLRNG

SEQ ID NO: 532095 - protein, 11 aa, Influenza virus
MGLVFICIKNG

SEQ ID NO: 532096 - protein, 11 aa, Influenza virus
MGLVFICMKNG

SEQ ID NO: 532097 - protein, 11 aa, Influenza virus
MGLVFICVKNG

SEQ ID NO: 532098 - protein, 11 aa, Influenza virus
MGLVFMCVKNG

SEQ ID NO: 532099 - protein, 11 aa, Influenza virus
MGMAADKESTQ

SEQ ID NO: 532100 - protein, 11 aa, Influenza virus
MGMFNMLSTVL

SEQ ID NO: 532101 - protein, 11 aa, Influenza virus
MGMRISSSFSF

SEQ ID NO: 532102 - protein, 11 aa, Influenza virus
MGNGCFEFYHK

SEQ ID NO: 532103 - protein, 11 aa, Influenza virus
MGNGCFKIYHK

SEQ ID NO: 532104 - protein, 11 aa, Influenza virus
MGNGCFRIYHK

SEQ ID NO: 532105 - protein, 11 aa, Influenza virus
MGNGCFTIYHK

SEQ ID NO: 532106 - protein, 11 aa, Influenza virus
MGNGCLKIYHK

SEQ ID NO: 532107 - protein, 11 aa, Influenza virus
MGQAADLKSTQ

SEQ ID NO: 532108 - protein, 11 aa, Influenza virus
MGQQGRMDYYW

SEQ ID NO: 532109 - protein, 11 aa, Influenza virus
MGRTISKDSRS

SEQ ID NO: 532110 - protein, 11 aa, Influenza virus
MGRTISMDSRS

SEQ ID NO: 532111 - protein, 11 aa, Influenza virus
MGRTISRDSRS

SEQ ID NO: 532112 - protein, 11 aa, Influenza virus
MGSIRNNTYDH

SEQ ID NO: 532113 - protein, 11 aa, Influenza virus
MGVAPSPSNSR

SEQ ID NO: 532114 - protein, 11 aa, Influenza virus
MGVQMQRFRRP

SEQ ID NO: 532115 - protein, 11 aa, Influenza virus
MGVYQILAIYA

SEQ ID NO: 532116 - protein, 11 aa, Influenza virus
MGVYQILVIYA

SEQ ID NO: 532117 - protein, 11 aa, Influenza virus
MGYICSGIFGD

SEQ ID NO: 532118 - protein, 11 aa, Influenza virus
MGYICSGVFGD

SEQ ID NO: 532119 - protein, 11 aa, Influenza virus
MGYKDIILWIS

SEQ ID NO: 532120 - protein, 11 aa, Influenza virus
MHDANVKNLHE

SEQ ID NO: 532121 - protein, 11 aa, Influenza virus
MHDANVRNLHD

SEQ ID NO: 532122 - protein, 11 aa, Influenza virus
MHDANVRNLHE

SEQ ID NO: 532123 - protein, 11 aa, Influenza virus
MHDRTKIRQLP

SEQ ID NO: 532124 - protein, 11 aa, Influenza virus
MHQLLRHFQKD

SEQ ID NO: 532125 - protein, 11 aa, Influenza virus
MHQLLRHFQKN

SEQ ID NO: 532126 - protein, 11 aa, Influenza virus
MIADRVDDAVT

SEQ ID NO: 532127 - protein, 11 aa, Influenza virus
MIALILVALAL

SEQ ID NO: 532128 - protein, 11 aa, Influenza virus
MIDGWYGFHHS

SEQ ID NO: 532129 - protein, 11 aa, Influenza virus
MIDGWYGFRHQ

SEQ ID NO: 532130 - protein, 11 aa, Influenza virus
MIDGWYGYHHE

SEQ ID NO: 532131 - protein, 11 aa, Influenza virus
MIDGWYGYHHQ

SEQ ID NO: 532132 - protein, 11 aa, Influenza virus
MIDGWYGYHHS

SEQ ID NO: 532133 - protein, 11 aa, Influenza virus
MIEAESSIKEK

SEQ ID NO: 532134 - protein, 11 aa, Influenza virus
MIEAESSVKEK

SEQ ID NO: 532135 - protein, 11 aa, Influenza virus
MIEAESSVREK

SEQ ID NO: 532136 - protein, 11 aa, Influenza virus
MIIGGFIFGCQ

SEQ ID NO: 532137 - protein, 11 aa, Influenza virus
MIKAVRGDLNF

SEQ ID NO: 532138 - protein, 11 aa, Influenza virus
MIKRGINDRNF

SEQ ID NO: 532139 - protein, 11 aa, Influenza virus
MIKRGVNDRNF

SEQ ID NO: 532140 - protein, 11 aa, Influenza virus
MILGNGCFEFW

SEQ ID NO: 532141 - protein, 11 aa, Influenza virus
MINDKIDDQIE

SEQ ID NO: 532142 - protein, 11 aa, Influenza virus
MINDKINDQIE

SEQ ID NO: 532143 - protein, 11 aa, Influenza virus
MINNDLGPATA

SEQ ID NO: 532144 - protein, 11 aa, Influenza virus
MINPVKLSGGY

SEQ ID NO: 532145 - protein, 11 aa, Influenza virus
MINPVKLSSGY

SEQ ID NO: 532146 - protein, 11 aa, Influenza virus
MIRGQPKEKAI

SEQ ID NO: 532147 - protein, 11 aa, Influenza virus
MIRGQPKEKTI

SEQ ID NO: 532148 - protein, 11 aa, Influenza virus
MIRGQPNERTI

SEQ ID NO: 532149 - protein, 11 aa, Influenza virus
MISDKIDDQIE

SEQ ID NO: 532150 - protein, 11 aa, Influenza virus
MISKCKTKEGR

SEQ ID NO: 532151 - protein, 11 aa, Influenza virus
MISKCRTKEGR

SEQ ID NO: 532152 - protein, 11 aa, Influenza virus
MISKCRTREGR

SEQ ID NO: 532153 - protein, 11 aa, Influenza virus
MISKSRTKEGR

SEQ ID NO: 532154 - protein, 11 aa, Influenza virus
MISNCRTKEGR

SEQ ID NO: 532155 - protein, 11 aa, Influenza virus
MISPLAVTWWN

SEQ ID NO: 532156 - protein, 11 aa, Influenza virus
MISRARIDARI

SEQ ID NO: 532157 - protein, 11 aa, Influenza virus
MIWDANGWVST

SEQ ID NO: 532158 - protein, 11 aa, Influenza virus
MIWHSNLNDAT

SEQ ID NO: 532159 - protein, 11 aa, Influenza virus
MIWHSNLNDTT

SEQ ID NO: 532160 - protein, 11 aa, Influenza virus
MKAVRGDLNFV

SEQ ID NO: 532161 - protein, 11 aa, Influenza virus
MKDRSPYRTLM

SEQ ID NO: 532162 - protein, 11 aa, Influenza virus
MKHTSQYICSP

SEQ ID NO: 532163 - protein, 11 aa, Influenza virus
MKHTSQYLCTG

SEQ ID NO: 532164 - protein, 11 aa, Influenza virus
MKIIRVGCVIL

SEQ ID NO: 532165 - protein, 11 aa, Influenza virus
MKIYWHLMHPG

SEQ ID NO: 532166 - protein, 11 aa, Influenza virus
MKLYWHLMHPG

SEQ ID NO: 532167 - protein, 11 aa, Influenza virus
MKLYWHLMRPG

SEQ ID NO: 532168 - protein, 11 aa, Influenza virus
MKLYWHLMSPG

SEQ ID NO: 532169 - protein, 11 aa, Influenza virus
MKNGNMQCTIC

SEQ ID NO: 532170 - protein, 11 aa, Influenza virus
MKNVPEKIHTR

SEQ ID NO: 532171 - protein, 11 aa, Influenza virus
MKNVPEKIRTR

SEQ ID NO: 532172 - protein, 11 aa, Influenza virus
MKNVPEKIRVK

SEQ ID NO: 532173 - protein, 11 aa, Influenza virus
MKRKRDSSILT

SEQ ID NO: 532174 - protein, 11 aa, Influenza virus
MKRKRNSSILT

SEQ ID NO: 532175 - protein, 11 aa, Influenza virus
MKSRGYKMNTQ

SEQ ID NO: 532176 - protein, 11 aa, Influenza virus
MKTIIIVLSCI

SEQ ID NO: 532177 - protein, 11 aa, Influenza virus
MKWGMELRRCL

SEQ ID NO: 532178 - protein, 11 aa, Influenza virus
MKWGMEMRRCL

SEQ ID NO: 532179 - protein, 11 aa, Influenza virus
MKWLLSSKANQ

SEQ ID NO: 532180 - protein, 11 aa, Influenza virus
MKWLLSSKDNQ

SEQ ID NO: 532181 - protein, 11 aa, Influenza virus
MKWLSSSGNNQ

SEQ ID NO: 532182 - protein, 11 aa, Influenza virus
MKWLSSSMNNQ

SEQ ID NO: 532183 - protein, 11 aa, Influenza virus
MKWLTLKSGQF

SEQ ID NO: 532184 - protein, 11 aa, Influenza virus
MKWMMAMKYPI

SEQ ID NO: 532185 - protein, 11 aa, Influenza virus
MKWMMAMRYPI

SEQ ID NO: 532186 - protein, 11 aa, Influenza virus
MLADRIDDAVT

SEQ ID NO: 532187 - protein, 11 aa, Influenza virus
MLADRVDDAVT

SEQ ID NO: 532188 - protein, 11 aa, Influenza virus
MLADWVDDAVT

SEQ ID NO: 532189 - protein, 11 aa, Influenza virus
MLATGMKNVPE

SEQ ID NO: 532190 - protein, 11 aa, Influenza virus
MLATGMRNIPG

SEQ ID NO: 532191 - protein, 11 aa, Influenza virus
MLATGMRNVPE

SEQ ID NO: 532192 - protein, 11 aa, Influenza virus
MLCLGHHAVPN

SEQ ID NO: 532193 - protein, 11 aa, Influenza virus
MLERELVRKTR

SEQ ID NO: 532194 - protein, 11 aa, Influenza virus
MLFVQSYFQLF

SEQ ID NO: 532195 - protein, 11 aa, Influenza virus
MLGFVFTLTVP

SEQ ID NO: 532196 - protein, 11 aa, Influenza virus
MLKIHNAGTDP

SEQ ID NO: 532197 - protein, 11 aa, Influenza virus
MLKIPNAETDP

SEQ ID NO: 532198 - protein, 11 aa, Influenza virus
MLKIPNAGIDP

SEQ ID NO: 532199 - protein, 11 aa, Influenza virus
MLKIPNAGTDP

SEQ ID NO: 532200 - protein, 11 aa, Influenza virus
MLKMSLLTEVE

SEQ ID NO: 532201 - protein, 11 aa, Influenza virus
MLKVPNAGTDP

SEQ ID NO: 532202 - protein, 11 aa, Influenza virus
MLKVPNALTDD

SEQ ID NO: 532203 - protein, 11 aa, Influenza virus
MLKVPNALTDN

SEQ ID NO: 532204 - protein, 11 aa, Influenza virus
MLKVPNALTND

SEQ ID NO: 532205 - protein, 11 aa, Influenza virus
MLLAIAMGLIF

SEQ ID NO: 532206 - protein, 11 aa, Influenza virus
MLLDPGDTVTF

SEQ ID NO: 532207 - protein, 11 aa, Influenza virus
MLNASCAAMDD

SEQ ID NO: 532208 - protein, 11 aa, Influenza virus
MLNKSLCKIEG

SEQ ID NO: 532209 - protein, 11 aa, Influenza virus
MLNKSLCKVEG

SEQ ID NO: 532210 - protein, 11 aa, Influenza virus
MLNLYDRVRKQ

SEQ ID NO: 532211 - protein, 11 aa, Influenza virus
MLNLYERVRKQ

SEQ ID NO: 532212 - protein, 11 aa, Influenza virus
MLQSRTREILT

SEQ ID NO: 532213 - protein, 11 aa, Influenza virus
MLRIPNAGIDP

SEQ ID NO: 532214 - protein, 11 aa, Influenza virus
MLSLIMRTVIA

SEQ ID NO: 532215 - protein, 11 aa, Influenza virus
MLSTVLGVSIL

SEQ ID NO: 532216 - protein, 11 aa, Influenza virus
MLSTVLGVSVL

SEQ ID NO: 532217 - protein, 11 aa, Influenza virus
MMAMKYPITAD

SEQ ID NO: 532218 - protein, 11 aa, Influenza virus
MMAMKYPITAE

SEQ ID NO: 532219 - protein, 11 aa, Influenza virus
MMAMKYPITAN

SEQ ID NO: 532220 - protein, 11 aa, Influenza virus
MMAMRYPITAD

SEQ ID NO: 532221 - protein, 11 aa, Influenza virus
MMAYMLERELV

SEQ ID NO: 532222 - protein, 11 aa, Influenza virus
MMDGWYGFRHQ

SEQ ID NO: 532223 - protein, 11 aa, Influenza virus
MMDQVREGRNP

SEQ ID NO: 532224 - protein, 11 aa, Influenza virus
MMDQVRESRNP

SEQ ID NO: 532225 - protein, 11 aa, Influenza virus
MMEAMVSRARI

SEQ ID NO: 532226 - protein, 11 aa, Influenza virus
MMGMFNMLSTV

SEQ ID NO: 532227 - protein, 11 aa, Influenza virus
MMIWHSNLNDA

SEQ ID NO: 532228 - protein, 11 aa, Influenza virus
MMIWHSNLNDT

SEQ ID NO: 532229 - protein, 11 aa, Influenza virus
MMKAVRGDLNF

SEQ ID NO: 532230 - protein, 11 aa, Influenza virus
MMMGMFNMLST

SEQ ID NO: 532231 - protein, 11 aa, Influenza virus
MMSRARIDARI

SEQ ID NO: 532232 - protein, 11 aa, Influenza virus
MMTHTSQYICS

SEQ ID NO: 532233 - protein, 11 aa, Influenza virus
MMWEINGPDSV

SEQ ID NO: 532234 - protein, 11 aa, Influenza virus
MMWEINGPESV

SEQ ID NO: 532235 - protein, 11 aa, Influenza virus
MMWEVNGPESV

SEQ ID NO: 532236 - protein, 11 aa, Influenza virus
MNELGIPFHLG

SEQ ID NO: 532237 - protein, 11 aa, Influenza virus
MNELGVPFHLA

SEQ ID NO: 532238 - protein, 11 aa, Influenza virus
MNELGVPFHLG

SEQ ID NO: 532239 - protein, 11 aa, Influenza virus
MNELGVPFHMG

SEQ ID NO: 532240 - protein, 11 aa, Influenza virus
MNELGVPFYLG

SEQ ID NO: 532241 - protein, 11 aa, Influenza virus
MNELGVSFHLG

SEQ ID NO: 532242 - protein, 11 aa, Influenza virus
MNGNYDSIRGE

SEQ ID NO: 532243 - protein, 11 aa, Influenza virus
MNGQSGRIDFH

SEQ ID NO: 532244 - protein, 11 aa, Influenza virus
MNGQSGRIDFY

SEQ ID NO: 532245 - protein, 11 aa, Influenza virus
MNIQFEAVGRE

SEQ ID NO: 532246 - protein, 11 aa, Influenza virus
MNIQFTAVGKE

SEQ ID NO: 532247 - protein, 11 aa, Influenza virus
MNIQFTSVGKE

SEQ ID NO: 532248 - protein, 11 aa, Influenza virus
MNKLFERVRRQ

SEQ ID NO: 532249 - protein, 11 aa, Influenza virus
MNKLYEKVRRQ

SEQ ID NO: 532250 - protein, 11 aa, Influenza virus
MNKLYERVKRQ

SEQ ID NO: 532251 - protein, 11 aa, Influenza virus
MNKLYERVRKQ

SEQ ID NO: 532252 - protein, 11 aa, Influenza virus
MNKLYERVRRQ

SEQ ID NO: 532253 - protein, 11 aa, Influenza virus
MNLLIGISNVG

SEQ ID NO: 532254 - protein, 11 aa, Influenza virus
MNNEGSYFFGD

SEQ ID NO: 532255 - protein, 11 aa, Influenza virus
MNNETILETGY

SEQ ID NO: 532256 - protein, 11 aa, Influenza virus
MNNQVFPQLNQ

SEQ ID NO: 532257 - protein, 11 aa, Influenza virus
MNPNQKIICIS

SEQ ID NO: 532258 - protein, 11 aa, Influenza virus
MNPNQKIITID

SEQ ID NO: 532259 - protein, 11 aa, Influenza virus
MNPNQKIITIG

SEQ ID NO: 532260 - protein, 11 aa, Influenza virus
MNPNQKILCAS

SEQ ID NO: 532261 - protein, 11 aa, Influenza virus
MNPNQKILCTS

SEQ ID NO: 532262 - protein, 11 aa, Influenza virus
MNPNQKILFAS

SEQ ID NO: 532263 - protein, 11 aa, Influenza virus
MNPNQKIMCIS

SEQ ID NO: 532264 - protein, 11 aa, Influenza virus
MNPNQKITCIS

SEQ ID NO: 532265 - protein, 11 aa, Influenza virus
MNPNQKLFALS

SEQ ID NO: 532266 - protein, 11 aa, Influenza virus
MNPNQKLFASS

SEQ ID NO: 532267 - protein, 11 aa, Influenza virus
MNPNQKLFTLS

SEQ ID NO: 532268 - protein, 11 aa, Influenza virus
MNPNQKTITIG

SEQ ID NO: 532269 - protein, 11 aa, Influenza virus
MNPNQMIITIG

SEQ ID NO: 532270 - protein, 11 aa, Influenza virus
MNPNQNLFTLS

SEQ ID NO: 532271 - protein, 11 aa, Influenza virus
MNPNQRILCTS

SEQ ID NO: 532272 - protein, 11 aa, Influenza virus
MNPNQSIITIG

SEQ ID NO: 532273 - protein, 11 aa, Influenza virus
MNPSQKLFALS

SEQ ID NO: 532274 - protein, 11 aa, Influenza virus
MNREFEVMNHE

SEQ ID NO: 532275 - protein, 11 aa, Influenza virus
MNREFEVVDHE

SEQ ID NO: 532276 - protein, 11 aa, Influenza virus
MNREFEVVNHE

SEQ ID NO: 532277 - protein, 11 aa, Influenza virus
MNREFGVVNHE

SEQ ID NO: 532278 - protein, 11 aa, Influenza virus
MNTALLNASCA

SEQ ID NO: 532279 - protein, 11 aa, Influenza virus
MNTQFEAIGRE

SEQ ID NO: 532280 - protein, 11 aa, Influenza virus
MNTQFEAVGKE

SEQ ID NO: 532281 - protein, 11 aa, Influenza virus
MNTQFEAVGRE

SEQ ID NO: 532282 - protein, 11 aa, Influenza virus
MNTQFETVGKE

SEQ ID NO: 532283 - protein, 11 aa, Influenza virus
MNTQFTAVGKE

SEQ ID NO: 532284 - protein, 11 aa, Influenza virus
MNTQFTSVGKE

SEQ ID NO: 532285 - protein, 11 aa, Influenza virus
MNTQFTVVGKE

SEQ ID NO: 532286 - protein, 11 aa, Influenza virus
MNTQIIVILVL

SEQ ID NO: 532287 - protein, 11 aa, Influenza virus
MNTSKPFQNIC

SEQ ID NO: 532288 - protein, 11 aa, Influenza virus
MNTSKPFQNTS

SEQ ID NO: 532289 - protein, 11 aa, Influenza virus
MNTSKPLQNTS

SEQ ID NO: 532290 - protein, 11 aa, Influenza virus
MPASRYLTDMT

SEQ ID NO: 532291 - protein, 11 aa, Influenza virus
MPFHNIHPLTI

SEQ ID NO: 532292 - protein, 11 aa, Influenza virus
MPFHNVHPLTI

SEQ ID NO: 532293 - protein, 11 aa, Influenza virus
MPLHNIHPLTI

SEQ ID NO: 532294 - protein, 11 aa, Influenza virus
MQALQLLFEVE

SEQ ID NO: 532295 - protein, 11 aa, Influenza virus
MQALQLLLEVE

SEQ ID NO: 532296 - protein, 11 aa, Influenza virus
MQFSSFTVNVR

SEQ ID NO: 532297 - protein, 11 aa, Influenza virus
MQFSSLAVNVR

SEQ ID NO: 532298 - protein, 11 aa, Influenza virus
MQFSSLTVNVR

SEQ ID NO: 532299 - protein, 11 aa, Influenza virus
MQFSSLTVSVR

SEQ ID NO: 532300 - protein, 11 aa, Influenza virus
MQGSTLPRRSG

SEQ ID NO: 532301 - protein, 11 aa, Influenza virus
MQIRGFVHFVE

SEQ ID NO: 532302 - protein, 11 aa, Influenza virus
MQIRGFVYFVE

SEQ ID NO: 532303 - protein, 11 aa, Influenza virus
MQLKDNAKEVG

SEQ ID NO: 532304 - protein, 11 aa, Influenza virus
MQLRDNAKEIG

SEQ ID NO: 532305 - protein, 11 aa, Influenza virus
MQLRDNAKELG

SEQ ID NO: 532306 - protein, 11 aa, Influenza virus
MQLRDNAKETG

SEQ ID NO: 532307 - protein, 11 aa, Influenza virus
MQLRDNVKELG

SEQ ID NO: 532308 - protein, 11 aa, Influenza virus
MQNGSCRCMFC

SEQ ID NO: 532309 - protein, 11 aa, Influenza virus
MQNGSYRCMFC

SEQ ID NO: 532310 - protein, 11 aa, Influenza virus
MQNKLNNVIDK

SEQ ID NO: 532311 - protein, 11 aa, Influenza virus
MQNRIQIDPVK

SEQ ID NO: 532312 - protein, 11 aa, Influenza virus
MQNRLNNVIDK

SEQ ID NO: 532313 - protein, 11 aa, Influenza virus
MQRFRRPDSSW

SEQ ID NO: 532314 - protein, 11 aa, Influenza virus
MRCTISLVKTT

SEQ ID NO: 532315 - protein, 11 aa, Influenza virus
MRDSIKSWRNN

SEQ ID NO: 532316 - protein, 11 aa, Influenza virus
MREPFISCSHF

SEQ ID NO: 532317 - protein, 11 aa, Influenza virus
MREPFISCSHL

SEQ ID NO: 532318 - protein, 11 aa, Influenza virus
MRINNETILET

SEQ ID NO: 532319 - protein, 11 aa, Influenza virus
MRINNETIVET

SEQ ID NO: 532320 - protein, 11 aa, Influenza virus
MRISNETILET

SEQ ID NO: 532321 - protein, 11 aa, Influenza virus
MRISSSFSFGG

SEQ ID NO: 532322 - protein, 11 aa, Influenza virus
MRKKRGLFGAI

SEQ ID NO: 532323 - protein, 11 aa, Influenza virus
MRKKRGLFGAK

SEQ ID NO: 532324 - protein, 11 aa, Influenza virus
MRNIPEKQTRG

SEQ ID NO: 532325 - protein, 11 aa, Influenza virus
MRNIPERQTRG

SEQ ID NO: 532326 - protein, 11 aa, Influenza virus
MRNIPGKQAKG

SEQ ID NO: 532327 - protein, 11 aa, Influenza virus
MRNVPEKQTRG

SEQ ID NO: 532328 - protein, 11 aa, Influenza virus
MRNVPERQTRG

SEQ ID NO: 532329 - protein, 11 aa, Influenza virus
MRNVPETQTRG

SEQ ID NO: 532330 - protein, 11 aa, Influenza virus
MRPCFWVELIR

SEQ ID NO: 532331 - protein, 11 aa, Influenza virus
MRPCFWVELVR

SEQ ID NO: 532332 - protein, 11 aa, Influenza virus
MRRCLLQSLQQ

SEQ ID NO: 532333 - protein, 11 aa, Influenza virus
MRTPIAFLTSS

SEQ ID NO: 532334 - protein, 11 aa, Influenza virus
MRTQESECACV

SEQ ID NO: 532335 - protein, 11 aa, Influenza virus
MRTQESECVCQ

SEQ ID NO: 532336 - protein, 11 aa, Influenza virus
MRTQESSCTCI

SEQ ID NO: 532337 - protein, 11 aa, Influenza virus
MRWLTLKLGQF

SEQ ID NO: 532338 - protein, 11 aa, Influenza virus
MRWLTLKSEQF

SEQ ID NO: 532339 - protein, 11 aa, Influenza virus
MRWLTLKSGQF

SEQ ID NO: 532340 - protein, 11 aa, Influenza virus
MSCFVFVALIL

SEQ ID NO: 532341 - protein, 11 aa, Influenza virus
MSCHIGVAPSP

SEQ ID NO: 532342 - protein, 11 aa, Influenza virus
MSCPIGEAPSP

SEQ ID NO: 532343 - protein, 11 aa, Influenza virus
MSCPIGEVPSP

SEQ ID NO: 532344 - protein, 11 aa, Influenza virus
MSCPIGVAPSP

SEQ ID NO: 532345 - protein, 11 aa, Influenza virus
MSCPLGEAPSP

SEQ ID NO: 532346 - protein, 11 aa, Influenza virus
MSCPMGVAPSP

SEQ ID NO: 532347 - protein, 11 aa, Influenza virus
MSCPVGEAPSP

SEQ ID NO: 532348 - protein, 11 aa, Influenza virus
MSCPVGVAPSP

SEQ ID NO: 532349 - protein, 11 aa, Influenza virus
MSDIEAMASQG

SEQ ID NO: 532350 - protein, 11 aa, Influenza virus
MSDIEIMASQG

SEQ ID NO: 532351 - protein, 11 aa, Influenza virus
MSDIGAMASQG

SEQ ID NO: 532352 - protein, 11 aa, Influenza virus
MSDINIMASQG

SEQ ID NO: 532353 - protein, 11 aa, Influenza virus
MSDSIKSWRKD

SEQ ID NO: 532354 - protein, 11 aa, Influenza virus
MSELGVPFHLG

SEQ ID NO: 532355 - protein, 11 aa, Influenza virus
MSFQGRGVFEL

SEQ ID NO: 532356 - protein, 11 aa, Influenza virus
MSGPNDNASAV

SEQ ID NO: 532357 - protein, 11 aa, Influenza virus
MSGPNNNASAV

SEQ ID NO: 532358 - protein, 11 aa, Influenza virus
MSGYSGIFSVE

SEQ ID NO: 532359 - protein, 11 aa, Influenza virus
MSICISGPNNN

SEQ ID NO: 532360 - protein, 11 aa, Influenza virus
MSICMSGPNDN

SEQ ID NO: 532361 - protein, 11 aa, Influenza virus
MSICMSGPNNN

SEQ ID NO: 532362 - protein, 11 aa, Influenza virus
MSICVSGPNNN

SEQ ID NO: 532363 - protein, 11 aa, Influenza virus
MSIGITVIKNN

SEQ ID NO: 532364 - protein, 11 aa, Influenza virus
MSIGVAVIKNN

SEQ ID NO: 532365 - protein, 11 aa, Influenza virus
MSIGVTVIKNN

SEQ ID NO: 532366 - protein, 11 aa, Influenza virus
MSIGVTVIRNN

SEQ ID NO: 532367 - protein, 11 aa, Influenza virus
MSKEGSYFFGD

SEQ ID NO: 532368 - protein, 11 aa, Influenza virus
MSKKKSYINKT

SEQ ID NO: 532369 - protein, 11 aa, Influenza virus
MSKKKSYINRT

SEQ ID NO: 532370 - protein, 11 aa, Influenza virus
MSKRKSYINKT

SEQ ID NO: 532371 - protein, 11 aa, Influenza virus
MSLLTEVETYV

SEQ ID NO: 532372 - protein, 11 aa, Influenza virus
MSLSRTREILT

SEQ ID NO: 532373 - protein, 11 aa, Influenza virus
MSNEGSYFFGD

SEQ ID NO: 532374 - protein, 11 aa, Influenza virus
MSNNSTEKVDT

SEQ ID NO: 532375 - protein, 11 aa, Influenza virus
MSQPRTREILT

SEQ ID NO: 532376 - protein, 11 aa, Influenza virus
MSQSRTREILT

SEQ ID NO: 532377 - protein, 11 aa, Influenza virus
MSQSRTRGILT

SEQ ID NO: 532378 - protein, 11 aa, Influenza virus
MSRARIDARID

SEQ ID NO: 532379 - protein, 11 aa, Influenza virus
MSTNAYDRICI

SEQ ID NO: 532380 - protein, 11 aa, Influenza virus
MSTPLGTPPTV

SEQ ID NO: 532381 - protein, 11 aa, Influenza virus
MSVCISGPNNN

SEQ ID NO: 532382 - protein, 11 aa, Influenza virus
MSVCMSGPNNN

SEQ ID NO: 532383 - protein, 11 aa, Influenza virus
MSVGVTVIKNN

SEQ ID NO: 532384 - protein, 11 aa, Influenza virus
MSVLLGSSPNA

SEQ ID NO: 532385 - protein, 11 aa, Influenza virus
MSVPLGSSPNA

SEQ ID NO: 532386 - protein, 11 aa, Influenza virus
MSVPMGSSPNA

SEQ ID NO: 532387 - protein, 11 aa, Influenza virus
MTDGNASGKAD

SEQ ID NO: 532388 - protein, 11 aa, Influenza virus
MTDGPANKQAS

SEQ ID NO: 532389 - protein, 11 aa, Influenza virus
MTDGPANNQAS

SEQ ID NO: 532390 - protein, 11 aa, Influenza virus
MTDGPANSQAS

SEQ ID NO: 532391 - protein, 11 aa, Influenza virus
MTDGPASNQAS

SEQ ID NO: 532392 - protein, 11 aa, Influenza virus
MTDGPASSQAY

SEQ ID NO: 532393 - protein, 11 aa, Influenza virus
MTDGPSDAQAF

SEQ ID NO: 532394 - protein, 11 aa, Influenza virus
MTDGSANSQAY

SEQ ID NO: 532395 - protein, 11 aa, Influenza virus
MTDGSASGKAD

SEQ ID NO: 532396 - protein, 11 aa, Influenza virus
MTDGSASGKAE

SEQ ID NO: 532397 - protein, 11 aa, Influenza virus
MTDGSASGQAY

SEQ ID NO: 532398 - protein, 11 aa, Influenza virus
MTDGSASGRAD

SEQ ID NO: 532399 - protein, 11 aa, Influenza virus
MTDGSASRKAD

SEQ ID NO: 532400 - protein, 11 aa, Influenza virus
MTDGSASSQAH

SEQ ID NO: 532401 - protein, 11 aa, Influenza virus
MTDGSASSQAY

SEQ ID NO: 532402 - protein, 11 aa, Influenza virus
MTDSEMLNLYE

SEQ ID NO: 532403 - protein, 11 aa, Influenza virus
MTDSEMNKLFE

SEQ ID NO: 532404 - protein, 11 aa, Influenza virus
MTDSIKSWRKD

SEQ ID NO: 532405 - protein, 11 aa, Influenza virus
MTDSIKSWRRD

SEQ ID NO: 532406 - protein, 11 aa, Influenza virus
MTEIWSYNAEL

SEQ ID NO: 532407 - protein, 11 aa, Influenza virus
MTEVWSYNAEF

SEQ ID NO: 532408 - protein, 11 aa, Influenza virus
MTEVWSYNAEL

SEQ ID NO: 532409 - protein, 11 aa, Influenza virus
MTHTSQYICSP

SEQ ID NO: 532410 - protein, 11 aa, Influenza virus
MTIASDILKRM

SEQ ID NO: 532411 - protein, 11 aa, Influenza virus
MTIASDILTRM

SEQ ID NO: 532412 - protein, 11 aa, Influenza virus
MTICIQGNNDN

SEQ ID NO: 532413 - protein, 11 aa, Influenza virus
MTICVQGKNDN

SEQ ID NO: 532414 - protein, 11 aa, Influenza virus
MTICVQGNNDN

SEQ ID NO: 532415 - protein, 11 aa, Influenza virus
MTICVQGNNKN

SEQ ID NO: 532416 - protein, 11 aa, Influenza virus
MTICVQGNNNN

SEQ ID NO: 532417 - protein, 11 aa, Influenza virus
MTKDAERGKLK

SEQ ID NO: 532418 - protein, 11 aa, Influenza virus
MTLDFHDSNVK

SEQ ID NO: 532419 - protein, 11 aa, Influenza virus
MTRGLFGAIAG

SEQ ID NO: 532420 - protein, 11 aa, Influenza virus
MTSIRNNTYDH

SEQ ID NO: 532421 - protein, 11 aa, Influenza virus
MVAYMLERELV

SEQ ID NO: 532422 - protein, 11 aa, Influenza virus
MVDGWYGFHHS

SEQ ID NO: 532423 - protein, 11 aa, Influenza virus
MVDGWYGFRHH

SEQ ID NO: 532424 - protein, 11 aa, Influenza virus
MVDGWYGFRHQ

SEQ ID NO: 532425 - protein, 11 aa, Influenza virus
MVDGWYGYHHE

SEQ ID NO: 532426 - protein, 11 aa, Influenza virus
MVDGWYGYHHN

SEQ ID NO: 532427 - protein, 11 aa, Influenza virus
MVDGWYGYHHQ

SEQ ID NO: 532428 - protein, 11 aa, Influenza virus
MVDGWYGYHHS

SEQ ID NO: 532429 - protein, 11 aa, Influenza virus
MVDQVRESRNP

SEQ ID NO: 532430 - protein, 11 aa, Influenza virus
MVDTILERNVT

SEQ ID NO: 532431 - protein, 11 aa, Influenza virus
MVEAESSVKEK

SEQ ID NO: 532432 - protein, 11 aa, Influenza virus
MVEAMISRARI

SEQ ID NO: 532433 - protein, 11 aa, Influenza virus
MVEAMMSRARI

SEQ ID NO: 532434 - protein, 11 aa, Influenza virus
MVEAMVSRARI

SEQ ID NO: 532435 - protein, 11 aa, Influenza virus
MVFCGVSGEVP

SEQ ID NO: 532436 - protein, 11 aa, Influenza virus
MVGLILAFIMW

SEQ ID NO: 532437 - protein, 11 aa, Influenza virus
MVIASTTAKAM

SEQ ID NO: 532438 - protein, 11 aa, Influenza virus
MVKAVRGDLNF

SEQ ID NO: 532439 - protein, 11 aa, Influenza virus
MVKRGINDRNF

SEQ ID NO: 532440 - protein, 11 aa, Influenza virus
MVKSDKICLGH

SEQ ID NO: 532441 - protein, 11 aa, Influenza virus
MVLASTTAKAM

SEQ ID NO: 532442 - protein, 11 aa, Influenza virus
MVLSAFDERRN

SEQ ID NO: 532443 - protein, 11 aa, Influenza virus
MVNERTLDFHD

SEQ ID NO: 532444 - protein, 11 aa, Influenza virus
MVNGWYGFRHQ

SEQ ID NO: 532445 - protein, 11 aa, Influenza virus
MVRSDKICLGH

SEQ ID NO: 532446 - protein, 11 aa, Influenza virus
MVSPLAITWWN

SEQ ID NO: 532447 - protein, 11 aa, Influenza virus
MVSPLAVTWWN

SEQ ID NO: 532448 - protein, 11 aa, Influenza virus
MVSRARIDARI

SEQ ID NO: 532449 - protein, 11 aa, Influenza virus
MVSRARIDARV

SEQ ID NO: 532450 - protein, 11 aa, Influenza virus
MVTFCGLDNEP

SEQ ID NO: 532451 - protein, 11 aa, Influenza virus
MVWDANGWVST

SEQ ID NO: 532452 - protein, 11 aa, Influenza virus
MVWDANGWVTA

SEQ ID NO: 532453 - protein, 11 aa, Influenza virus
MWACNSGNCRF

SEQ ID NO: 532454 - protein, 11 aa, Influenza virus
MWACQKGNIKC

SEQ ID NO: 532455 - protein, 11 aa, Influenza virus
MWACQKGNIRC

SEQ ID NO: 532456 - protein, 11 aa, Influenza virus
MWACQRGNIRC

SEQ ID NO: 532457 - protein, 11 aa, Influenza virus
MWACSNGNCRF

SEQ ID NO: 532458 - protein, 11 aa, Influenza virus
MWACSNGSCRF

SEQ ID NO: 532459 - protein, 11 aa, Influenza virus
MWACSSGNCRF

SEQ ID NO: 532460 - protein, 11 aa, Influenza virus
MWALGENMAPE

SEQ ID NO: 532461 - protein, 11 aa, Influenza virus
MWEINGPDSVL

SEQ ID NO: 532462 - protein, 11 aa, Influenza virus
MWEINGPESVL

SEQ ID NO: 532463 - protein, 11 aa, Influenza virus
MWEVNGPESVL

SEQ ID NO: 532464 - protein, 11 aa, Influenza virus
MWTCNSGNCRF

SEQ ID NO: 532465 - protein, 11 aa, Influenza virus
MWTYNAELLVL

SEQ ID NO: 532466 - protein, 11 aa, Influenza virus
MYALHQGTTIR

SEQ ID NO: 532467 - protein, 11 aa, Influenza virus
MYQKCCNLFEK

SEQ ID NO: 532468 - protein, 11 aa, Influenza virus
MYQKCCNLFER

SEQ ID NO: 532469 - protein, 11 aa, Influenza virus
MYQKCCSLFEK

SEQ ID NO: 532470 - protein, 11 aa, Influenza virus
MYQKCCTLFEK

SEQ ID NO: 532471 - protein, 11 aa, Influenza virus
MYQRCCNLFEK

SEQ ID NO: 532472 - protein, 11 aa, Influenza virus
MYSDFHFIDEQ

SEQ ID NO: 532473 - protein, 11 aa, Influenza virus
MYSDFHFIDER

SEQ ID NO: 532474 - protein, 11 aa, Influenza virus
MYSDFHFINEL

SEQ ID NO: 532475 - protein, 11 aa, Influenza virus
MYSDFHFINEQ

SEQ ID NO: 532476 - protein, 11 aa, Influenza virus
MYSDFHFINER

SEQ ID NO: 532477 - protein, 11 aa, Influenza virus
NAALGSPGCDH

SEQ ID NO: 532478 - protein, 11 aa, Influenza virus
NAASYKRIRLF

SEQ ID NO: 532479 - protein, 11 aa, Influenza virus
NADHRIYWIRK

SEQ ID NO: 532480 - protein, 11 aa, Influenza virus
NADKICLGHHA

SEQ ID NO: 532481 - protein, 11 aa, Influenza virus
NADLEALMEWL

SEQ ID NO: 532482 - protein, 11 aa, Influenza virus
NADLLVAMENQ

SEQ ID NO: 532483 - protein, 11 aa, Influenza virus
NADVLVALENQ

SEQ ID NO: 532484 - protein, 11 aa, Influenza virus
NAEDKGNGCFE

SEQ ID NO: 532485 - protein, 11 aa, Influenza virus
NAEDLGNGCFK

SEQ ID NO: 532486 - protein, 11 aa, Influenza virus
NAEDMGNGCFK

SEQ ID NO: 532487 - protein, 11 aa, Influenza virus
NAEDMGNGCFR

SEQ ID NO: 532488 - protein, 11 aa, Influenza virus
NAEDMGNGCFT

SEQ ID NO: 532489 - protein, 11 aa, Influenza virus
NAEDMGNGCLK

SEQ ID NO: 532490 - protein, 11 aa, Influenza virus
NAEDQGNGCFE

SEQ ID NO: 532491 - protein, 11 aa, Influenza virus
NAEDRGNGCFE

SEQ ID NO: 532492 - protein, 11 aa, Influenza virus
NAEEDCTGCFE

SEQ ID NO: 532493 - protein, 11 aa, Influenza virus
NAEEDGKGCFE

SEQ ID NO: 532494 - protein, 11 aa, Influenza virus
NAEEDGNGCFE

SEQ ID NO: 532495 - protein, 11 aa, Influenza virus
NAEEDGRGCFE

SEQ ID NO: 532496 - protein, 11 aa, Influenza virus
NAEEDGTGCFE

SEQ ID NO: 532497 - protein, 11 aa, Influenza virus
NAEFFVLMENE

SEQ ID NO: 532498 - protein, 11 aa, Influenza virus
NAEFLVALENQ

SEQ ID NO: 532499 - protein, 11 aa, Influenza virus
NAEFLVAMENQ

SEQ ID NO: 532500 - protein, 11 aa, Influenza virus
NAEFLVAVENQ

SEQ ID NO: 532501 - protein, 11 aa, Influenza virus
NAEGIGIAADR

SEQ ID NO: 532502 - protein, 11 aa, Influenza virus
NAEGTGIAADR

SEQ ID NO: 532503 - protein, 11 aa, Influenza virus
NAEGTGMAADQ

SEQ ID NO: 532504 - protein, 11 aa, Influenza virus
NAEGTGMAADR

SEQ ID NO: 532505 - protein, 11 aa, Influenza virus
NAEGTGTAADL

SEQ ID NO: 532506 - protein, 11 aa, Influenza virus
NAEIEDLIFLA

SEQ ID NO: 532507 - protein, 11 aa, Influenza virus
NAEIEDLIFLT

SEQ ID NO: 532508 - protein, 11 aa, Influenza virus
NAEIEDLIFMA

SEQ ID NO: 532509 - protein, 11 aa, Influenza virus
NAEIEDLIFSA

SEQ ID NO: 532510 - protein, 11 aa, Influenza virus
NAEIEDLTFLA

SEQ ID NO: 532511 - protein, 11 aa, Influenza virus
NAEILVALENQ

SEQ ID NO: 532512 - protein, 11 aa, Influenza virus
NAEILVLMENE

SEQ ID NO: 532513 - protein, 11 aa, Influenza virus
NAELFVLMENE

SEQ ID NO: 532514 - protein, 11 aa, Influenza virus
NAELIVLLENQ

SEQ ID NO: 532515 - protein, 11 aa, Influenza virus
NAELLIAMENQ

SEQ ID NO: 532516 - protein, 11 aa, Influenza virus
NAELLILLENE

SEQ ID NO: 532517 - protein, 11 aa, Influenza virus
NAELLVALENQ

SEQ ID NO: 532518 - protein, 11 aa, Influenza virus
NAELLVAMENQ

SEQ ID NO: 532519 - protein, 11 aa, Influenza virus
NAELLVLIENE

SEQ ID NO: 532520 - protein, 11 aa, Influenza virus
NAELLVLIENQ

SEQ ID NO: 532521 - protein, 11 aa, Influenza virus
NAELLVLLEDE

SEQ ID NO: 532522 - protein, 11 aa, Influenza virus
NAELLVLLENE

SEQ ID NO: 532523 - protein, 11 aa, Influenza virus
NAELLVLLENG

SEQ ID NO: 532524 - protein, 11 aa, Influenza virus
NAELLVLLENQ

SEQ ID NO: 532525 - protein, 11 aa, Influenza virus
NAELLVLLGNQ

SEQ ID NO: 532526 - protein, 11 aa, Influenza virus
NAELLVLMENE

SEQ ID NO: 532527 - protein, 11 aa, Influenza virus
NAEVLVLMENE

SEQ ID NO: 532528 - protein, 11 aa, Influenza virus
NAGKDPKKTGG

SEQ ID NO: 532529 - protein, 11 aa, Influenza virus
NAGLLVALENQ

SEQ ID NO: 532530 - protein, 11 aa, Influenza virus
NAHDRICIGYQ

SEQ ID NO: 532531 - protein, 11 aa, Influenza virus
NAHILVTREPY

SEQ ID NO: 532532 - protein, 11 aa, Influenza virus
NAIDAGDGCFE

SEQ ID NO: 532533 - protein, 11 aa, Influenza virus
NAIDAGNGCFD

SEQ ID NO: 532534 - protein, 11 aa, Influenza virus
NAIDEGDGCFN

SEQ ID NO: 532535 - protein, 11 aa, Influenza virus
NAIDEGDGCFS

SEQ ID NO: 532536 - protein, 11 aa, Influenza virus
NAIDEGNGCFE

SEQ ID NO: 532537 - protein, 11 aa, Influenza virus
NAIDNGDGCFE

SEQ ID NO: 532538 - protein, 11 aa, Influenza virus
NAIDTGDGCFE

SEQ ID NO: 532539 - protein, 11 aa, Influenza virus
NAIDTGKGCFD

SEQ ID NO: 532540 - protein, 11 aa, Influenza virus
NAIDTGNGCFD

SEQ ID NO: 532541 - protein, 11 aa, Influenza virus
NAIGDCPKYIK

SEQ ID NO: 532542 - protein, 11 aa, Influenza virus
NAINEGNGCFE

SEQ ID NO: 532543 - protein, 11 aa, Influenza virus
NAIRFGEGEQI

SEQ ID NO: 532544 - protein, 11 aa, Influenza virus
NAIRFGESEQI

SEQ ID NO: 532545 - protein, 11 aa, Influenza virus
NAIRFGESEQV

SEQ ID NO: 532546 - protein, 11 aa, Influenza virus
NAISTTFPYTG

SEQ ID NO: 532547 - protein, 11 aa, Influenza virus
NAITRSGQNHG

SEQ ID NO: 532548 - protein, 11 aa, Influenza virus
NAKDEGNGCFP

SEQ ID NO: 532549 - protein, 11 aa, Influenza virus
NAKDEGNGCFT

SEQ ID NO: 532550 - protein, 11 aa, Influenza virus
NAKDLGNGCFE

SEQ ID NO: 532551 - protein, 11 aa, Influenza virus
NAKEIGNGCFE

SEQ ID NO: 532552 - protein, 11 aa, Influenza virus
NAKEIGNGCFK

SEQ ID NO: 532553 - protein, 11 aa, Influenza virus
NAKELGNGCFE

SEQ ID NO: 532554 - protein, 11 aa, Influenza virus
NAKEMGNGCFE

SEQ ID NO: 532555 - protein, 11 aa, Influenza virus
NAKETGNGCFE

SEQ ID NO: 532556 - protein, 11 aa, Influenza virus
NAKEVGNGCFE

SEQ ID NO: 532557 - protein, 11 aa, Influenza virus
NAKEWGNGCFE

SEQ ID NO: 532558 - protein, 11 aa, Influenza virus
NAKLLVLIEND

SEQ ID NO: 532559 - protein, 11 aa, Influenza virus
NAKLLVLLEND

SEQ ID NO: 532560 - protein, 11 aa, Influenza virus
NAKLLVLLENG

SEQ ID NO: 532561 - protein, 11 aa, Influenza virus
NALDTGDGCFE

SEQ ID NO: 532562 - protein, 11 aa, Influenza virus
NALGDCPKYIK

SEQ ID NO: 532563 - protein, 11 aa, Influenza virus
NALGECPKYIK

SEQ ID NO: 532564 - protein, 11 aa, Influenza virus
NALGNCPKYIK

SEQ ID NO: 532565 - protein, 11 aa, Influenza virus
NALLKHRFEII

SEQ ID NO: 532566 - protein, 11 aa, Influenza virus
NALNGNGDPNN

SEQ ID NO: 532567 - protein, 11 aa, Influenza virus
NALSGNGDPNN

SEQ ID NO: 532568 - protein, 11 aa, Influenza virus
NALSIAPIMFS

SEQ ID NO: 532569 - protein, 11 aa, Influenza virus
NALTGGQSFYR

SEQ ID NO: 532570 - protein, 11 aa, Influenza virus
NAMDAGNGCFD

SEQ ID NO: 532571 - protein, 11 aa, Influenza virus
NANDLGNGCFE

SEQ ID NO: 532572 - protein, 11 aa, Influenza virus
NANTLSSVNTN

SEQ ID NO: 532573 - protein, 11 aa, Influenza virus
NANTLSSVTTN

SEQ ID NO: 532574 - protein, 11 aa, Influenza virus
NANTLTSVTTN

SEQ ID NO: 532575 - protein, 11 aa, Influenza virus
NAPHKLCFPGE

SEQ ID NO: 532576 - protein, 11 aa, Influenza virus
NAPHKLCYPGE

SEQ ID NO: 532577 - protein, 11 aa, Influenza virus
NAPNKFCYPGE

SEQ ID NO: 532578 - protein, 11 aa, Influenza virus
NAPNKLCFPGE

SEQ ID NO: 532579 - protein, 11 aa, Influenza virus
NAPNKLCYPGE

SEQ ID NO: 532580 - protein, 11 aa, Influenza virus
NAPSGIEYNGK

SEQ ID NO: 532581 - protein, 11 aa, Influenza virus
NAPSGVEYNGK

SEQ ID NO: 532582 - protein, 11 aa, Influenza virus
NAQAFYKILKI

SEQ ID NO: 532583 - protein, 11 aa, Influenza virus
NAQEIGNGCFE

SEQ ID NO: 532584 - protein, 11 aa, Influenza virus
NAQGEGIAADY

SEQ ID NO: 532585 - protein, 11 aa, Influenza virus
NAQGEGTAADY

SEQ ID NO: 532586 - protein, 11 aa, Influenza virus
NAQGIGQAADY

SEQ ID NO: 532587 - protein, 11 aa, Influenza virus
NAQGQGTAADY

SEQ ID NO: 532588 - protein, 11 aa, Influenza virus
NAQGSGYAADL

SEQ ID NO: 532589 - protein, 11 aa, Influenza virus
NAQGTGQAADY

SEQ ID NO: 532590 - protein, 11 aa, Influenza virus
NAQHIEECSCY

SEQ ID NO: 532591 - protein, 11 aa, Influenza virus
NAQHVEECSCY

SEQ ID NO: 532592 - protein, 11 aa, Influenza virus
NAQLLVLLENE

SEQ ID NO: 532593 - protein, 11 aa, Influenza virus
NAQLLVWLENE

SEQ ID NO: 532594 - protein, 11 aa, Influenza virus
NARELGNGCFE

SEQ ID NO: 532595 - protein, 11 aa, Influenza virus
NARLLVLLEND

SEQ ID NO: 532596 - protein, 11 aa, Influenza virus
NARLLVLLENE

SEQ ID NO: 532597 - protein, 11 aa, Influenza virus
NASCAAMDDFQ

SEQ ID NO: 532598 - protein, 11 aa, Influenza virus
NASCAAMDEFQ

SEQ ID NO: 532599 - protein, 11 aa, Influenza virus
NASCAAMEDFQ

SEQ ID NO: 532600 - protein, 11 aa, Influenza virus
NASRHHMGECP

SEQ ID NO: 532601 - protein, 11 aa, Influenza virus
NASRHYMGECP

SEQ ID NO: 532602 - protein, 11 aa, Influenza virus
NASRYYMGECP

SEQ ID NO: 532603 - protein, 11 aa, Influenza virus
NASTGAQSFYR

SEQ ID NO: 532604 - protein, 11 aa, Influenza virus
NASTGGQAFYR

SEQ ID NO: 532605 - protein, 11 aa, Influenza virus
NASTGGQSFYR

SEQ ID NO: 532606 - protein, 11 aa, Influenza virus
NASWFNSFLAH

SEQ ID NO: 532607 - protein, 11 aa, Influenza virus
NASWFNSFLIH

SEQ ID NO: 532608 - protein, 11 aa, Influenza virus
NASWFNSFLKH

SEQ ID NO: 532609 - protein, 11 aa, Influenza virus
NASWFNSFLTH

SEQ ID NO: 532610 - protein, 11 aa, Influenza virus
NASWFNSFLVH

SEQ ID NO: 532611 - protein, 11 aa, Influenza virus
NATATVYYDRR

SEQ ID NO: 532612 - protein, 11 aa, Influenza virus
NATATVYYERR

SEQ ID NO: 532613 - protein, 11 aa, Influenza virus
NATATVYYNGR

SEQ ID NO: 532614 - protein, 11 aa, Influenza virus
NATATVYYNKR

SEQ ID NO: 532615 - protein, 11 aa, Influenza virus
NATATVYYNRR

SEQ ID NO: 532616 - protein, 11 aa, Influenza virus
NATDTVDTLTE

SEQ ID NO: 532617 - protein, 11 aa, Influenza virus
NATETVEITGI

SEQ ID NO: 532618 - protein, 11 aa, Influenza virus
NAVDEGNGCFE

SEQ ID NO: 532619 - protein, 11 aa, Influenza virus
NAVDTGDGCFE

SEQ ID NO: 532620 - protein, 11 aa, Influenza virus
NAVDTGNGCFD

SEQ ID NO: 532621 - protein, 11 aa, Influenza virus
NAVRFGESEQI

SEQ ID NO: 532622 - protein, 11 aa, Influenza virus
NAYDRICIGYQ

SEQ ID NO: 532623 - protein, 11 aa, Influenza virus
NCDTKCQTPLG

SEQ ID NO: 532624 - protein, 11 aa, Influenza virus
NCEIKCQTPLG

SEQ ID NO: 532625 - protein, 11 aa, Influenza virus
NCETKCQSPLG

SEQ ID NO: 532626 - protein, 11 aa, Influenza virus
NCETKCQTPLG

SEQ ID NO: 532627 - protein, 11 aa, Influenza virus
NCIESIRNGTY

SEQ ID NO: 532628 - protein, 11 aa, Influenza virus
NCIKPCFWVEL

SEQ ID NO: 532629 - protein, 11 aa, Influenza virus
NCINRCFYVEL

SEQ ID NO: 532630 - protein, 11 aa, Influenza virus
NCIRPCFWVEL

SEQ ID NO: 532631 - protein, 11 aa, Influenza virus
NCLYASPQLEG

SEQ ID NO: 532632 - protein, 11 aa, Influenza virus
NCMERIRNNTY

SEQ ID NO: 532633 - protein, 11 aa, Influenza virus
NCMESIRNNTY

SEQ ID NO: 532634 - protein, 11 aa, Influenza virus
NCMRPCFWVEL

SEQ ID NO: 532635 - protein, 11 aa, Influenza virus
NCPKYIKSGQL

SEQ ID NO: 532636 - protein, 11 aa, Influenza virus
NCPKYVKQGSL

SEQ ID NO: 532637 - protein, 11 aa, Influenza virus
NCTIPCFWVEM

SEQ ID NO: 532638 - protein, 11 aa, Influenza virus
NCTVPCFWVEM

SEQ ID NO: 532639 - protein, 11 aa, Influenza virus
NCWSFALAQGA

SEQ ID NO: 532640 - protein, 11 aa, Influenza virus
NCWSFALAQGV

SEQ ID NO: 532641 - protein, 11 aa, Influenza virus
NCYQFALGQGT

SEQ ID NO: 532642 - protein, 11 aa, Influenza virus
NCYWVMTDGPA

SEQ ID NO: 532643 - protein, 11 aa, Influenza virus
NDATYQRTRAL

SEQ ID NO: 532644 - protein, 11 aa, Influenza virus
NDAYAVIHYGG

SEQ ID NO: 532645 - protein, 11 aa, Influenza virus
NDDIDQSLIIA

SEQ ID NO: 532646 - protein, 11 aa, Influenza virus
NDDVDQSLIIA

SEQ ID NO: 532647 - protein, 11 aa, Influenza virus
NDDVDQSLVIA

SEQ ID NO: 532648 - protein, 11 aa, Influenza virus
NDERGNPGVKG

SEQ ID NO: 532649 - protein, 11 aa, Influenza virus
NDEVDQSLIIA

SEQ ID NO: 532650 - protein, 11 aa, Influenza virus
NDGKVECVCRD

SEQ ID NO: 532651 - protein, 11 aa, Influenza virus
NDKHSNGTIKD

SEQ ID NO: 532652 - protein, 11 aa, Influenza virus
NDKHSNGTMKD

SEQ ID NO: 532653 - protein, 11 aa, Influenza virus
NDKHSNGTVKD

SEQ ID NO: 532654 - protein, 11 aa, Influenza virus
NDKHSNNTVKD

SEQ ID NO: 532655 - protein, 11 aa, Influenza virus
NDKTLDLHDAN

SEQ ID NO: 532656 - protein, 11 aa, Influenza virus
NDKTLDMHDAN

SEQ ID NO: 532657 - protein, 11 aa, Influenza virus
NDKTLNMHDAN

SEQ ID NO: 532658 - protein, 11 aa, Influenza virus
NDKYHQIEKEF

SEQ ID NO: 532659 - protein, 11 aa, Influenza virus
NDLGNGCFEFW

SEQ ID NO: 532660 - protein, 11 aa, Influenza virus
NDLGPATAQMA

SEQ ID NO: 532661 - protein, 11 aa, Influenza virus
NDLYGAQSLSI

SEQ ID NO: 532662 - protein, 11 aa, Influenza virus
NDLYGTQPLSI

SEQ ID NO: 532663 - protein, 11 aa, Influenza virus
NDLYGTQSLSI

SEQ ID NO: 532664 - protein, 11 aa, Influenza virus
NDNATATVYYD

SEQ ID NO: 532665 - protein, 11 aa, Influenza virus
NDNATATVYYN

SEQ ID NO: 532666 - protein, 11 aa, Influenza virus
NDNWSGYSGSF

SEQ ID NO: 532667 - protein, 11 aa, Influenza virus
NDPSGYAQTDC

SEQ ID NO: 532668 - protein, 11 aa, Influenza virus
NDPWVLLNASW

SEQ ID NO: 532669 - protein, 11 aa, Influenza virus
NDPYPGNNBNG

SEQ ID NO: 532670 - protein, 11 aa, Influenza virus
NDPYPGNNNGV

SEQ ID NO: 532671 - protein, 11 aa, Influenza virus
NDPYPGNNNKG

SEQ ID NO: 532672 - protein, 11 aa, Influenza virus
NDPYPGNNNNG

SEQ ID NO: 532673 - protein, 11 aa, Influenza virus
NDQGAGYAADK

SEQ ID NO: 532674 - protein, 11 aa, Influenza virus
NDQGSGYAADK

SEQ ID NO: 532675 - protein, 11 aa, Influenza virus
NDQGTGQAADY

SEQ ID NO: 532676 - protein, 11 aa, Influenza virus
NDQIEDLWAYN

SEQ ID NO: 532677 - protein, 11 aa, Influenza virus
NDQITDIWAYN

SEQ ID NO: 532678 - protein, 11 aa, Influenza virus
NDRHSNGTVKD

SEQ ID NO: 532679 - protein, 11 aa, Influenza virus
NDRHSNNTVKD

SEQ ID NO: 532680 - protein, 11 aa, Influenza virus
NDRNFWRGDNG

SEQ ID NO: 532681 - protein, 11 aa, Influenza virus
NDRNFWRGENG

SEQ ID NO: 532682 - protein, 11 aa, Influenza virus
NDRSPFRALVS

SEQ ID NO: 532683 - protein, 11 aa, Influenza virus
NDRSPHRTLMS

SEQ ID NO: 532684 - protein, 11 aa, Influenza virus
NDRTLDLHDAN

SEQ ID NO: 532685 - protein, 11 aa, Influenza virus
NDSCMDTIRNG

SEQ ID NO: 532686 - protein, 11 aa, Influenza virus
NDSCMEAIRNG

SEQ ID NO: 532687 - protein, 11 aa, Influenza virus
NDSCMETIRNG

SEQ ID NO: 532688 - protein, 11 aa, Influenza virus
NDTDVVNFLSM

SEQ ID NO: 532689 - protein, 11 aa, Influenza virus
NDTDVVNFVSM

SEQ ID NO: 532690 - protein, 11 aa, Influenza virus
NDTDVVNYVSM

SEQ ID NO: 532691 - protein, 11 aa, Influenza virus
NDTINYYNETF

SEQ ID NO: 532692 - protein, 11 aa, Influenza virus
NDTITFSFNGA

SEQ ID NO: 532693 - protein, 11 aa, Influenza virus
NDTTYQRTRAL

SEQ ID NO: 532694 - protein, 11 aa, Influenza virus
NDTVNFSFNGA

SEQ ID NO: 532695 - protein, 11 aa, Influenza virus
NDTVTFIFNGA

SEQ ID NO: 532696 - protein, 11 aa, Influenza virus
NDTVTFNFNGA

SEQ ID NO: 532697 - protein, 11 aa, Influenza virus
NDTVTFSFNGA

SEQ ID NO: 532698 - protein, 11 aa, Influenza virus
NDTVTFTFNGA

SEQ ID NO: 532699 - protein, 11 aa, Influenza virus
NDVWLGRTVSN

SEQ ID NO: 532700 - protein, 11 aa, Influenza virus
NDVWLGRTVST

SEQ ID NO: 532701 - protein, 11 aa, Influenza virus
NDVWMGRTISK

SEQ ID NO: 532702 - protein, 11 aa, Influenza virus
NDWSGYSGSFI

SEQ ID NO: 532703 - protein, 11 aa, Influenza virus
NDWSGYSGSFS

SEQ ID NO: 532704 - protein, 11 aa, Influenza virus
NDWSGYSGSFT

SEQ ID NO: 532705 - protein, 11 aa, Influenza virus
NDWSGYSGSFV

SEQ ID NO: 532706 - protein, 11 aa, Influenza virus
NECIEKIRNGT

SEQ ID NO: 532707 - protein, 11 aa, Influenza virus
NECIEKVRNGT

SEQ ID NO: 532708 - protein, 11 aa, Influenza virus
NECIERVRNGT

SEQ ID NO: 532709 - protein, 11 aa, Influenza virus
NECMETIKNGT

SEQ ID NO: 532710 - protein, 11 aa, Influenza virus
NECRFYALSQG

SEQ ID NO: 532711 - protein, 11 aa, Influenza virus
NECRTFFLTQG

SEQ ID NO: 532712 - protein, 11 aa, Influenza virus
NECYNPCFYVE

SEQ ID NO: 532713 - protein, 11 aa, Influenza virus
NEDGDIIFLWG

SEQ ID NO: 532714 - protein, 11 aa, Influenza virus
NEDGNIIFLWG

SEQ ID NO: 532715 - protein, 11 aa, Influenza virus
NEEALRQIIRE

SEQ ID NO: 532716 - protein, 11 aa, Influenza virus
NEEALRQKIME

SEQ ID NO: 532717 - protein, 11 aa, Influenza virus
NEEGDIIFLWG

SEQ ID NO: 532718 - protein, 11 aa, Influenza virus
NEEGTGIAADK

SEQ ID NO: 532719 - protein, 11 aa, Influenza virus
NEEGTGIAADR

SEQ ID NO: 532720 - protein, 11 aa, Influenza virus
NEEGTGVAADK

SEQ ID NO: 532721 - protein, 11 aa, Influenza virus
NEERGNPGVKG

SEQ ID NO: 532722 - protein, 11 aa, Influenza virus
NEERGSPGVKG

SEQ ID NO: 532723 - protein, 11 aa, Influenza virus
NEFNEIEQQIG

SEQ ID NO: 532724 - protein, 11 aa, Influenza virus
NEFNEVEQQIG

SEQ ID NO: 532725 - protein, 11 aa, Influenza virus
NEFNKACELTD

SEQ ID NO: 532726 - protein, 11 aa, Influenza virus
NEFSEIEQQIG

SEQ ID NO: 532727 - protein, 11 aa, Influenza virus
NEFTEIEQQIG

SEQ ID NO: 532728 - protein, 11 aa, Influenza virus
NEFTEVEKQIG

SEQ ID NO: 532729 - protein, 11 aa, Influenza virus
NEFTEVEQQIG

SEQ ID NO: 532730 - protein, 11 aa, Influenza virus
NEGALRQKIME

SEQ ID NO: 532731 - protein, 11 aa, Influenza virus
NEGHIEECSCY

SEQ ID NO: 532732 - protein, 11 aa, Influenza virus
NEGIMNTSKPF

SEQ ID NO: 532733 - protein, 11 aa, Influenza virus
NEGKVECICRD

SEQ ID NO: 532734 - protein, 11 aa, Influenza virus
NEGKVECVCRD

SEQ ID NO: 532735 - protein, 11 aa, Influenza virus
NEGNGCFELLH

SEQ ID NO: 532736 - protein, 11 aa, Influenza virus
NEGSYFFGDNA

SEQ ID NO: 532737 - protein, 11 aa, Influenza virus
NEGSYFFGDSA

SEQ ID NO: 532738 - protein, 11 aa, Influenza virus
NEGVINTSKPF

SEQ ID NO: 532739 - protein, 11 aa, Influenza virus
NEGVMNTSKPF

SEQ ID NO: 532740 - protein, 11 aa, Influenza virus
NEGVMNTSKPL

SEQ ID NO: 532741 - protein, 11 aa, Influenza virus
NEHSNGTIHDR

SEQ ID NO: 532742 - protein, 11 aa, Influenza virus
NEHSNGTTHDR

SEQ ID NO: 532743 - protein, 11 aa, Influenza virus
NEIEHQIGNVI

SEQ ID NO: 532744 - protein, 11 aa, Influenza virus
NEIEQQIGNVI

SEQ ID NO: 532745 - protein, 11 aa, Influenza virus
NEIEYQIGNVI

SEQ ID NO: 532746 - protein, 11 aa, Influenza virus
NEIKGVELSSM

SEQ ID NO: 532747 - protein, 11 aa, Influenza virus
NEIKGVKLSNM

SEQ ID NO: 532748 - protein, 11 aa, Influenza virus
NEIKGVKLSSM

SEQ ID NO: 532749 - protein, 11 aa, Influenza virus
NEITTKINNII

SEQ ID NO: 532750 - protein, 11 aa, Influenza virus
NEKFHQIEKEF

SEQ ID NO: 532751 - protein, 11 aa, Influenza virus
NEKGNPGVKGW

SEQ ID NO: 532752 - protein, 11 aa, Influenza virus
NEKGNQGVKGW

SEQ ID NO: 532753 - protein, 11 aa, Influenza virus
NEKKAKLANVV

SEQ ID NO: 532754 - protein, 11 aa, Influenza virus
NEKTLDLHDSN

SEQ ID NO: 532755 - protein, 11 aa, Influenza virus
NEKYHQIEKEF

SEQ ID NO: 532756 - protein, 11 aa, Influenza virus
NELGIPFHLGT

SEQ ID NO: 532757 - protein, 11 aa, Influenza virus
NELGNGCFEFY

SEQ ID NO: 532758 - protein, 11 aa, Influenza virus
NELGVPFHLAT

SEQ ID NO: 532759 - protein, 11 aa, Influenza virus
NELGVPFHLGT

SEQ ID NO: 532760 - protein, 11 aa, Influenza virus
NELGVPFYLGT

SEQ ID NO: 532761 - protein, 11 aa, Influenza virus
NELGVSFHLGT

SEQ ID NO: 532762 - protein, 11 aa, Influenza virus
NELYGTQSLSI

SEQ ID NO: 532763 - protein, 11 aa, Influenza virus
NEMTLDFHDSN

SEQ ID NO: 532764 - protein, 11 aa, Influenza virus
NENATATVYYN

SEQ ID NO: 532765 - protein, 11 aa, Influenza virus
NENGDIIFLWG

SEQ ID NO: 532766 - protein, 11 aa, Influenza virus
NENPAHKSQLI

SEQ ID NO: 532767 - protein, 11 aa, Influenza virus
NENPAHKSQLV

SEQ ID NO: 532768 - protein, 11 aa, Influenza virus
NENPVHKSQLI

SEQ ID NO: 532769 - protein, 11 aa, Influenza virus
NENPVHKSQLV

SEQ ID NO: 532770 - protein, 11 aa, Influenza virus
NENQNPRIFLA

SEQ ID NO: 532771 - protein, 11 aa, Influenza virus
NENQNPRMFLA

SEQ ID NO: 532772 - protein, 11 aa, Influenza virus
NENQNPRVFLA

SEQ ID NO: 532773 - protein, 11 aa, Influenza virus
NENQNPRVFLT

SEQ ID NO: 532774 - protein, 11 aa, Influenza virus
NENQSPRMFLA

SEQ ID NO: 532775 - protein, 11 aa, Influenza virus
NEPGSGDWPDG

SEQ ID NO: 532776 - protein, 11 aa, Influenza virus
NEPGSGNWPDG

SEQ ID NO: 532777 - protein, 11 aa, Influenza virus
NEPNGYAQTDC

SEQ ID NO: 532778 - protein, 11 aa, Influenza virus
NEPSGYAQTDC

SEQ ID NO: 532779 - protein, 11 aa, Influenza virus
NEPTGYAQTDC

SEQ ID NO: 532780 - protein, 11 aa, Influenza virus
NEPYPGNNNNG

SEQ ID NO: 532781 - protein, 11 aa, Influenza virus
NEQAAEAMEVA

SEQ ID NO: 532782 - protein, 11 aa, Influenza virus
NEQGMGMAADK

SEQ ID NO: 532783 - protein, 11 aa, Influenza virus
NEQGSGYAADK

SEQ ID NO: 532784 - protein, 11 aa, Influenza virus
NEQGSGYAADL

SEQ ID NO: 532785 - protein, 11 aa, Influenza virus
NEQGSGYAADQ

SEQ ID NO: 532786 - protein, 11 aa, Influenza virus
NEQGSGYAADR

SEQ ID NO: 532787 - protein, 11 aa, Influenza virus
NEQGTGIAADK

SEQ ID NO: 532788 - protein, 11 aa, Influenza virus
NEQGTGIAAEK

SEQ ID NO: 532789 - protein, 11 aa, Influenza virus
NEQGVGIAADK

SEQ ID NO: 532790 - protein, 11 aa, Influenza virus
NEQGVGMAADK

SEQ ID NO: 532791 - protein, 11 aa, Influenza virus
NEQTDLYKVAT

SEQ ID NO: 532792 - protein, 11 aa, Influenza virus
NERGLFGAIAG

SEQ ID NO: 532793 - protein, 11 aa, Influenza virus
NERGNPGVKGW

SEQ ID NO: 532794 - protein, 11 aa, Influenza virus
NERGNQGVKGW

SEQ ID NO: 532795 - protein, 11 aa, Influenza virus
NERGTQGVKGW

SEQ ID NO: 532796 - protein, 11 aa, Influenza virus
NERGYPGVKGW

SEQ ID NO: 532797 - protein, 11 aa, Influenza virus
NERILDFHDSN

SEQ ID NO: 532798 - protein, 11 aa, Influenza virus
NERTIWTSGSS

SEQ ID NO: 532799 - protein, 11 aa, Influenza virus
NERTLDFHDFN

SEQ ID NO: 532800 - protein, 11 aa, Influenza virus
NERTLDFHDSN

SEQ ID NO: 532801 - protein, 11 aa, Influenza virus
NERTLDLHDAN

SEQ ID NO: 532802 - protein, 11 aa, Influenza virus
NERTLDLHDSN

SEQ ID NO: 532803 - protein, 11 aa, Influenza virus
NERTLDMHDAN

SEQ ID NO: 532804 - protein, 11 aa, Influenza virus
NERTLDMHDVN

SEQ ID NO: 532805 - protein, 11 aa, Influenza virus
NERTLDQHDAN

SEQ ID NO: 532806 - protein, 11 aa, Influenza virus
NERTLDYHDSH

SEQ ID NO: 532807 - protein, 11 aa, Influenza virus
NERTLDYHDSN

SEQ ID NO: 532808 - protein, 11 aa, Influenza virus
NERTLEFHDSN

SEQ ID NO: 532809 - protein, 11 aa, Influenza virus
NERTLGFHDSN

SEQ ID NO: 532810 - protein, 11 aa, Influenza virus
NERTLYFHDSN

SEQ ID NO: 532811 - protein, 11 aa, Influenza virus
NESADMSIGIT

SEQ ID NO: 532812 - protein, 11 aa, Influenza virus
NESADMSIGVT

SEQ ID NO: 532813 - protein, 11 aa, Influenza virus
NESGRLIDFLK

SEQ ID NO: 532814 - protein, 11 aa, Influenza virus
NESGRLMDFLK

SEQ ID NO: 532815 - protein, 11 aa, Influenza virus
NETCSALFVYS

SEQ ID NO: 532816 - protein, 11 aa, Influenza virus
NETFVNMTNVQ

SEQ ID NO: 532817 - protein, 11 aa, Influenza virus
NETFVNVTHVQ

SEQ ID NO: 532818 - protein, 11 aa, Influenza virus
NETFVNVTNVQ

SEQ ID NO: 532819 - protein, 11 aa, Influenza virus
NETIIETGYVC

SEQ ID NO: 532820 - protein, 11 aa, Influenza virus
NETILETGYIC

SEQ ID NO: 532821 - protein, 11 aa, Influenza virus
NETILETGYVC

SEQ ID NO: 532822 - protein, 11 aa, Influenza virus
NETILETRYVC

SEQ ID NO: 532823 - protein, 11 aa, Influenza virus
NETIVETGYVC

SEQ ID NO: 532824 - protein, 11 aa, Influenza virus
NEVEQQIGNVI

SEQ ID NO: 532825 - protein, 11 aa, Influenza virus
NEVGAKILTSE

SEQ ID NO: 532826 - protein, 11 aa, Influenza virus
NEVGARIITSE

SEQ ID NO: 532827 - protein, 11 aa, Influenza virus
NEVGARILASE

SEQ ID NO: 532828 - protein, 11 aa, Influenza virus
NEVGARILTSE

SEQ ID NO: 532829 - protein, 11 aa, Influenza virus
NEVKLEENTTY

SEQ ID NO: 532830 - protein, 11 aa, Influenza virus
NEWSGYSGSFV

SEQ ID NO: 532831 - protein, 11 aa, Influenza virus
NFDSNGNFIAP

SEQ ID NO: 532832 - protein, 11 aa, Influenza virus
NFEGWIVGNPA

SEQ ID NO: 532833 - protein, 11 aa, Influenza virus
NFEKEGYSLVG

SEQ ID NO: 532834 - protein, 11 aa, Influenza virus
NFESNGNFIAP

SEQ ID NO: 532835 - protein, 11 aa, Influenza virus
NFESNGNFITP

SEQ ID NO: 532836 - protein, 11 aa, Influenza virus
NFESNGNLIAP

SEQ ID NO: 532837 - protein, 11 aa, Influenza virus
NFESTGNLIAP

SEQ ID NO: 532838 - protein, 11 aa, Influenza virus
NFESTGNLVAP

SEQ ID NO: 532839 - protein, 11 aa, Influenza virus
NFFHKCNDSCM

SEQ ID NO: 532840 - protein, 11 aa, Influenza virus
NFHYEECSCYP

SEQ ID NO: 532841 - protein, 11 aa, Influenza virus
NFIAPENAYKI

SEQ ID NO: 532842 - protein, 11 aa, Influenza virus
NFIAPEYAFKI

SEQ ID NO: 532843 - protein, 11 aa, Influenza virus
NFIAPEYAYIV

SEQ ID NO: 532844 - protein, 11 aa, Influenza virus
NFIAPEYAYKI

SEQ ID NO: 532845 - protein, 11 aa, Influenza virus
NFIAPEYAYKV

SEQ ID NO: 532846 - protein, 11 aa, Influenza virus
NFIAPEYAYRI

SEQ ID NO: 532847 - protein, 11 aa, Influenza virus
NFITPEYAYKI

SEQ ID NO: 532848 - protein, 11 aa, Influenza virus
NFKPNIGPRPF

SEQ ID NO: 532849 - protein, 11 aa, Influenza virus
NFLSMEFSLTD

SEQ ID NO: 532850 - protein, 11 aa, Influenza virus
NFPQTANTYRN

SEQ ID NO: 532851 - protein, 11 aa, Influenza virus
NFPQTTNTYRN

SEQ ID NO: 532852 - protein, 11 aa, Influenza virus
NFPRTTNTYRN

SEQ ID NO: 532853 - protein, 11 aa, Influenza virus
NFQPNIGPRPL

SEQ ID NO: 532854 - protein, 11 aa, Influenza virus
NFSFNGAFIAP

SEQ ID NO: 532855 - protein, 11 aa, Influenza virus
NFSMELPSFGV

SEQ ID NO: 532856 - protein, 11 aa, Influenza virus
NFVNRANQRLN

SEQ ID NO: 532857 - protein, 11 aa, Influenza virus
NFVPVVGARPQ

SEQ ID NO: 532858 - protein, 11 aa, Influenza virus
NFVSMEFSLTD

SEQ ID NO: 532859 - protein, 11 aa, Influenza virus
NFWRGDNGRRT

SEQ ID NO: 532860 - protein, 11 aa, Influenza virus
NFWRGENGRKT

SEQ ID NO: 532861 - protein, 11 aa, Influenza virus
NFWRGENGRRT

SEQ ID NO: 532862 - protein, 11 aa, Influenza virus
NFYYEECSCYP

SEQ ID NO: 532863 - protein, 11 aa, Influenza virus
NGAFIAPDRAS

SEQ ID NO: 532864 - protein, 11 aa, Influenza virus
NGAFIAPDRAT

SEQ ID NO: 532865 - protein, 11 aa, Influenza virus
NGAFIAPDRVS

SEQ ID NO: 532866 - protein, 11 aa, Influenza virus
NGAFIAPNRAS

SEQ ID NO: 532867 - protein, 11 aa, Influenza virus
NGAFVAPDRAS

SEQ ID NO: 532868 - protein, 11 aa, Influenza virus
NGAFVAPDRVS

SEQ ID NO: 532869 - protein, 11 aa, Influenza virus
NGAKVNTLTER

SEQ ID NO: 532870 - protein, 11 aa, Influenza virus
NGALGSPGCDH

SEQ ID NO: 532871 - protein, 11 aa, Influenza virus
NGALGSPGCDR

SEQ ID NO: 532872 - protein, 11 aa, Influenza virus
NGAVAVLKYKG

SEQ ID NO: 532873 - protein, 11 aa, Influenza virus
NGAVAVLKYND

SEQ ID NO: 532874 - protein, 11 aa, Influenza virus
NGAVAVLKYNG

SEQ ID NO: 532875 - protein, 11 aa, Influenza virus
NGCFDILHKCD

SEQ ID NO: 532876 - protein, 11 aa, Influenza virus
NGCFDILHKCN

SEQ ID NO: 532877 - protein, 11 aa, Influenza virus
NGCFEFWHKCD

SEQ ID NO: 532878 - protein, 11 aa, Influenza virus
NGCFEFWHKCN

SEQ ID NO: 532879 - protein, 11 aa, Influenza virus
NGCFEFYHKCD

SEQ ID NO: 532880 - protein, 11 aa, Influenza virus
NGCFEFYHKCN

SEQ ID NO: 532881 - protein, 11 aa, Influenza virus
NGCFEFYHRCD

SEQ ID NO: 532882 - protein, 11 aa, Influenza virus
NGCFEIFHKCD

SEQ ID NO: 532883 - protein, 11 aa, Influenza virus
NGCFEIFHQCD

SEQ ID NO: 532884 - protein, 11 aa, Influenza virus
NGCFEIFHRCD

SEQ ID NO: 532885 - protein, 11 aa, Influenza virus
NGCFELLHKCN

SEQ ID NO: 532886 - protein, 11 aa, Influenza virus
NGCFKIYHKCD

SEQ ID NO: 532887 - protein, 11 aa, Influenza virus
NGCFKIYHKCN

SEQ ID NO: 532888 - protein, 11 aa, Influenza virus
NGCFTFYHKCD

SEQ ID NO: 532889 - protein, 11 aa, Influenza virus
NGCFTFYHKCN

SEQ ID NO: 532890 - protein, 11 aa, Influenza virus
NGCFTFYHRCD

SEQ ID NO: 532891 - protein, 11 aa, Influenza virus
NGCFTIYHKCD

SEQ ID NO: 532892 - protein, 11 aa, Influenza virus
NGCIEGKLSQM

SEQ ID NO: 532893 - protein, 11 aa, Influenza virus
NGCIESKLSQM

SEQ ID NO: 532894 - protein, 11 aa, Influenza virus
NGCLKIYHKCD

SEQ ID NO: 532895 - protein, 11 aa, Influenza virus
NGDDVWMGRTI

SEQ ID NO: 532896 - protein, 11 aa, Influenza virus
NGDGCFEILHK

SEQ ID NO: 532897 - protein, 11 aa, Influenza virus
NGDIIFLWGIH

SEQ ID NO: 532898 - protein, 11 aa, Influenza virus
NGDPNNMDKAV

SEQ ID NO: 532899 - protein, 11 aa, Influenza virus
NGDPNNMDRAV

SEQ ID NO: 532900 - protein, 11 aa, Influenza virus
NGDPSNMDRAV

SEQ ID NO: 532901 - protein, 11 aa, Influenza virus
NGDYARLYIWG

SEQ ID NO: 532902 - protein, 11 aa, Influenza virus
NGDYTRLYIWG

SEQ ID NO: 532903 - protein, 11 aa, Influenza virus
NGELRHLFSGI

SEQ ID NO: 532904 - protein, 11 aa, Influenza virus
NGELRHLFSGV

SEQ ID NO: 532905 - protein, 11 aa, Influenza virus
NGEPGVKGFGF

SEQ ID NO: 532906 - protein, 11 aa, Influenza virus
NGFAPFSKDNS

SEQ ID NO: 532907 - protein, 11 aa, Influenza virus
NGFCFTVMTDG

SEQ ID NO: 532908 - protein, 11 aa, Influenza virus
NGFEILLIEDG

SEQ ID NO: 532909 - protein, 11 aa, Influenza virus
NGFEMLKIPNA

SEQ ID NO: 532910 - protein, 11 aa, Influenza virus
NGFLDVWTYNA

SEQ ID NO: 532911 - protein, 11 aa, Influenza virus
NGGFLAPRYGY

SEQ ID NO: 532912 - protein, 11 aa, Influenza virus
NGGHIEECSCY

SEQ ID NO: 532913 - protein, 11 aa, Influenza virus
NGGLGVKGFGF

SEQ ID NO: 532914 - protein, 11 aa, Influenza virus
NGGLIAPDRVS

SEQ ID NO: 532915 - protein, 11 aa, Influenza virus
NGGLIAPRYGY

SEQ ID NO: 532916 - protein, 11 aa, Influenza virus
NGGLIAPSRVS

SEQ ID NO: 532917 - protein, 11 aa, Influenza virus
NGGLIAPSRVT

SEQ ID NO: 532918 - protein, 11 aa, Influenza virus
NGGLLAPKYGY

SEQ ID NO: 532919 - protein, 11 aa, Influenza virus
NGGLLAPRYGY

SEQ ID NO: 532920 - protein, 11 aa, Influenza virus
NGGPGVKGFGF

SEQ ID NO: 532921 - protein, 11 aa, Influenza virus
NGICPVVFTDG

SEQ ID NO: 532922 - protein, 11 aa, Influenza virus
NGICTVVMTDG

SEQ ID NO: 532923 - protein, 11 aa, Influenza virus
NGIITDTFKSW

SEQ ID NO: 532924 - protein, 11 aa, Influenza virus
NGIITDTLKSW

SEQ ID NO: 532925 - protein, 11 aa, Influenza virus
NGIKVDTLTEK

SEQ ID NO: 532926 - protein, 11 aa, Influenza virus
NGIPPLELGDC

SEQ ID NO: 532927 - protein, 11 aa, Influenza virus
NGIRIGSKGDV

SEQ ID NO: 532928 - protein, 11 aa, Influenza virus
NGIRIGSKGHV

SEQ ID NO: 532929 - protein, 11 aa, Influenza virus
NGIRIGSRGEV

SEQ ID NO: 532930 - protein, 11 aa, Influenza virus
NGIRIGSRGHI

SEQ ID NO: 532931 - protein, 11 aa, Influenza virus
NGIRIGSRGHV

SEQ ID NO: 532932 - protein, 11 aa, Influenza virus
NGIRVGSRGHV

SEQ ID NO: 532933 - protein, 11 aa, Influenza virus
NGISPIHLGDC

SEQ ID NO: 532934 - protein, 11 aa, Influenza virus
NGISPVHLGDC

SEQ ID NO: 532935 - protein, 11 aa, Influenza virus
NGKAPISLGDC

SEQ ID NO: 532936 - protein, 11 aa, Influenza virus
NGKEPISLGDC

SEQ ID NO: 532937 - protein, 11 aa, Influenza virus
NGKFEFIAEDF

SEQ ID NO: 532938 - protein, 11 aa, Influenza virus
NGKFEFIAEEF

SEQ ID NO: 532939 - protein, 11 aa, Influenza virus
NGKFEFIVEKF

SEQ ID NO: 532940 - protein, 11 aa, Influenza virus
NGKGRYGVKGF

SEQ ID NO: 532941 - protein, 11 aa, Influenza virus
NGKLCKLNGIP

SEQ ID NO: 532942 - protein, 11 aa, Influenza virus
NGKLCRLRGIP

SEQ ID NO: 532943 - protein, 11 aa, Influenza virus
NGKLCRLSGIP

SEQ ID NO: 532944 - protein, 11 aa, Influenza virus
NGKLEFIAEEF

SEQ ID NO: 532945 - protein, 11 aa, Influenza virus
NGKLNRLIEKT

SEQ ID NO: 532946 - protein, 11 aa, Influenza virus
NGKLNRLIERT

SEQ ID NO: 532947 - protein, 11 aa, Influenza virus
NGKQPISLGDC

SEQ ID NO: 532948 - protein, 11 aa, Influenza virus
NGKSGACKRAD

SEQ ID NO: 532949 - protein, 11 aa, Influenza virus
NGKSGACKRAN

SEQ ID NO: 532950 - protein, 11 aa, Influenza virus
NGKSLGIQSDA

SEQ ID NO: 532951 - protein, 11 aa, Influenza virus
NGKSSACKRAN

SEQ ID NO: 532952 - protein, 11 aa, Influenza virus
NGKVECICRDN

SEQ ID NO: 532953 - protein, 11 aa, Influenza virus
NGKWREQLSQK

SEQ ID NO: 532954 - protein, 11 aa, Influenza virus
NGKYPVIKGDY

SEQ ID NO: 532955 - protein, 11 aa, Influenza virus
NGNDVWMGRTI

SEQ ID NO: 532956 - protein, 11 aa, Influenza virus
NGNFIAPENAY

SEQ ID NO: 532957 - protein, 11 aa, Influenza virus
NGNFIAPEYAF

SEQ ID NO: 532958 - protein, 11 aa, Influenza virus
NGNFIAPEYAY

SEQ ID NO: 532959 - protein, 11 aa, Influenza virus
NGNFITPEYAY

SEQ ID NO: 532960 - protein, 11 aa, Influenza virus
NGNGDPNNMDK

SEQ ID NO: 532961 - protein, 11 aa, Influenza virus
NGNGDPNNMDR

SEQ ID NO: 532962 - protein, 11 aa, Influenza virus
NGNGDPSNMDR

SEQ ID NO: 532963 - protein, 11 aa, Influenza virus
NGNLIAPEFGY

SEQ ID NO: 532964 - protein, 11 aa, Influenza virus
NGNLIAPEYGF

SEQ ID NO: 532965 - protein, 11 aa, Influenza virus
NGNLIAPEYGH

SEQ ID NO: 532966 - protein, 11 aa, Influenza virus
NGNLIAPEYGY

SEQ ID NO: 532967 - protein, 11 aa, Influenza virus
NGNLIAPRGYF

SEQ ID NO: 532968 - protein, 11 aa, Influenza virus
NGNLIAPRGYY

SEQ ID NO: 532969 - protein, 11 aa, Influenza virus
NGNLIAPWYAF

SEQ ID NO: 532970 - protein, 11 aa, Influenza virus
NGNLIAPWYAY

SEQ ID NO: 532971 - protein, 11 aa, Influenza virus
NGNLVAPRGYF

SEQ ID NO: 532972 - protein, 11 aa, Influenza virus
NGNLVAPWYAY

SEQ ID NO: 532973 - protein, 11 aa, Influenza virus
NGNMRCTISLV

SEQ ID NO: 532974 - protein, 11 aa, Influenza virus
NGNYARLYIWG

SEQ ID NO: 532975 - protein, 11 aa, Influenza virus
NGNYDSIRGEF

SEQ ID NO: 532976 - protein, 11 aa, Influenza virus
NGNYGPINVTK

SEQ ID NO: 532977 - protein, 11 aa, Influenza virus
NGPDSVLVNTY

SEQ ID NO: 532978 - protein, 11 aa, Influenza virus
NGPESVLINTY

SEQ ID NO: 532979 - protein, 11 aa, Influenza virus
NGPESVLVNTY

SEQ ID NO: 532980 - protein, 11 aa, Influenza virus
NGQAGRIDFHW

SEQ ID NO: 532981 - protein, 11 aa, Influenza virus
NGQAGRMTFYW

SEQ ID NO: 532982 - protein, 11 aa, Influenza virus
NGQFGRIDFHW

SEQ ID NO: 532983 - protein, 11 aa, Influenza virus
NGQFGRINFHW

SEQ ID NO: 532984 - protein, 11 aa, Influenza virus
NGQGSGYAADK

SEQ ID NO: 532985 - protein, 11 aa, Influenza virus
NGQGSGYAADQ

SEQ ID NO: 532986 - protein, 11 aa, Influenza virus
NGQKSWMKIYW

SEQ ID NO: 532987 - protein, 11 aa, Influenza virus
NGQKSWTKIYW

SEQ ID NO: 532988 - protein, 11 aa, Influenza virus
NGQRGRIDFHW

SEQ ID NO: 532989 - protein, 11 aa, Influenza virus
NGQRSWMKIYW

SEQ ID NO: 532990 - protein, 11 aa, Influenza virus
NGQSGRIDFHW

SEQ ID NO: 532991 - protein, 11 aa, Influenza virus
NGQSGRIDFYW

SEQ ID NO: 532992 - protein, 11 aa, Influenza virus
NGQSGRIEFHW

SEQ ID NO: 532993 - protein, 11 aa, Influenza virus
NGQSGRINFHW

SEQ ID NO: 532994 - protein, 11 aa, Influenza virus
NGQSGRIVFHW

SEQ ID NO: 532995 - protein, 11 aa, Influenza virus
NGQTGRIDFHW

SEQ ID NO: 532996 - protein, 11 aa, Influenza virus
NGRAPISLGDC

SEQ ID NO: 532997 - protein, 11 aa, Influenza virus
NGREWSYIVER

SEQ ID NO: 532998 - protein, 11 aa, Influenza virus
NGRFEFIAEEF

SEQ ID NO: 532999 - protein, 11 aa, Influenza virus
NGRLTTTIKTW

SEQ ID NO: 533000 - protein, 11 aa, Influenza virus
NGRSSFFRNVV

SEQ ID NO: 533001 - protein, 11 aa, Influenza virus
NGRTLDLHDAN

SEQ ID NO: 533002 - protein, 11 aa, Influenza virus
NGRTLDMHDAN

SEQ ID NO: 533003 - protein, 11 aa, Influenza virus
NGRTLGLHDAN

SEQ ID NO: 533004 - protein, 11 aa, Influenza virus
NGSCAVVMTDG

SEQ ID NO: 533005 - protein, 11 aa, Influenza virus
NGSCFTIMTDG

SEQ ID NO: 533006 - protein, 11 aa, Influenza virus
NGSCFTLMTDG

SEQ ID NO: 533007 - protein, 11 aa, Influenza virus
NGSCFTVLTDG

SEQ ID NO: 533008 - protein, 11 aa, Influenza virus
NGSCFTVMTDG

SEQ ID NO: 533009 - protein, 11 aa, Influenza virus
NGSCTVVMTDG

SEQ ID NO: 533010 - protein, 11 aa, Influenza virus
NGSIPNDKPFQ

SEQ ID NO: 533011 - protein, 11 aa, Influenza virus
NGSIPNEKPFQ

SEQ ID NO: 533012 - protein, 11 aa, Influenza virus
NGSIPNGKPFQ

SEQ ID NO: 533013 - protein, 11 aa, Influenza virus
NGSIPNNKPFQ

SEQ ID NO: 533014 - protein, 11 aa, Influenza virus
NGSISNDKPFQ

SEQ ID NO: 533015 - protein, 11 aa, Influenza virus
NGSMQCRICIG

SEQ ID NO: 533016 - protein, 11 aa, Influenza virus
NGTAKHIEECS

SEQ ID NO: 533017 - protein, 11 aa, Influenza virus
NGTCAVVMTDG

SEQ ID NO: 533018 - protein, 11 aa, Influenza virus
NGTCTVIMTDG

SEQ ID NO: 533019 - protein, 11 aa, Influenza virus
NGTCTVVMTDG

SEQ ID NO: 533020 - protein, 11 aa, Influenza virus
NGTCVVIMTDG

SEQ ID NO: 533021 - protein, 11 aa, Influenza virus
NGTCVVVMTDG

SEQ ID NO: 533022 - protein, 11 aa, Influenza virus
NGTIHDRAAFR

SEQ ID NO: 533023 - protein, 11 aa, Influenza virus
NGTIHDRSPFR

SEQ ID NO: 533024 - protein, 11 aa, Influenza virus
NGTIHDRSPYR

SEQ ID NO: 533025 - protein, 11 aa, Influenza virus
NGTIHDRSQFR

SEQ ID NO: 533026 - protein, 11 aa, Influenza virus
NGTIHDRSQYR

SEQ ID NO: 533027 - protein, 11 aa, Influenza virus
NGTIHDRTAFR

SEQ ID NO: 533028 - protein, 11 aa, Influenza virus
NGTIHDRTTFR

SEQ ID NO: 533029 - protein, 11 aa, Influenza virus
NGTIIKTLTNE

SEQ ID NO: 533030 - protein, 11 aa, Influenza virus
NGTIKDRSPYR

SEQ ID NO: 533031 - protein, 11 aa, Influenza virus
NGTINDRSPFR

SEQ ID NO: 533032 - protein, 11 aa, Influenza virus
NGTIVKTLTNE

SEQ ID NO: 533033 - protein, 11 aa, Influenza virus
NGTIVKTLTSE

SEQ ID NO: 533034 - protein, 11 aa, Influenza virus
NGTKINTLTER

SEQ ID NO: 533035 - protein, 11 aa, Influenza virus
NGTKVDTLTEK

SEQ ID NO: 533036 - protein, 11 aa, Influenza virus
NGTKVNTLTEK

SEQ ID NO: 533037 - protein, 11 aa, Influenza virus
NGTKVNTLTER

SEQ ID NO: 533038 - protein, 11 aa, Influenza virus
NGTMHDRSPFR

SEQ ID NO: 533039 - protein, 11 aa, Influenza virus
NGTMKDRSPYR

SEQ ID NO: 533040 - protein, 11 aa, Influenza virus
NGTSKIKMKWG

SEQ ID NO: 533041 - protein, 11 aa, Influenza virus
NGTSKVKMKWG

SEQ ID NO: 533042 - protein, 11 aa, Influenza virus
NGTSVKTLTDN

SEQ ID NO: 533043 - protein, 11 aa, Influenza virus
NGTTGNPIICL

SEQ ID NO: 533044 - protein, 11 aa, Influenza virus
NGTTHDRTAFR

SEQ ID NO: 533045 - protein, 11 aa, Influenza virus
NGTVKDRSPFR

SEQ ID NO: 533046 - protein, 11 aa, Influenza virus
NGTVKDRSPYR

SEQ ID NO: 533047 - protein, 11 aa, Influenza virus
NGTWAVVMTDG

SEQ ID NO: 533048 - protein, 11 aa, Influenza virus
NGTYDHKDFEE

SEQ ID NO: 533049 - protein, 11 aa, Influenza virus
NGTYDHKDYEE

SEQ ID NO: 533050 - protein, 11 aa, Influenza virus
NGTYDHKEFEE

SEQ ID NO: 533051 - protein, 11 aa, Influenza virus
NGTYDHKEFEK

SEQ ID NO: 533052 - protein, 11 aa, Influenza virus
NGTYDHKEYEE

SEQ ID NO: 533053 - protein, 11 aa, Influenza virus
NGTYDHNIYRD

SEQ ID NO: 533054 - protein, 11 aa, Influenza virus
NGTYDYPKYEE

SEQ ID NO: 533055 - protein, 11 aa, Influenza virus
NGTYDYPKYSE

SEQ ID NO: 533056 - protein, 11 aa, Influenza virus
NGTYDYPKYSK

SEQ ID NO: 533057 - protein, 11 aa, Influenza virus
NGTYDYSKYEE

SEQ ID NO: 533058 - protein, 11 aa, Influenza virus
NGTYNHEDYKE

SEQ ID NO: 533059 - protein, 11 aa, Influenza virus
NGTYNHEDYRE

SEQ ID NO: 533060 - protein, 11 aa, Influenza virus
NGTYNHKDYEE

SEQ ID NO: 533061 - protein, 11 aa, Influenza virus
NGTYNHKEYEE

SEQ ID NO: 533062 - protein, 11 aa, Influenza virus
NGTYNRKEYEE

SEQ ID NO: 533063 - protein, 11 aa, Influenza virus
NGTYNYPKYEE

SEQ ID NO: 533064 - protein, 11 aa, Influenza virus
NGTYNYPKYSE

SEQ ID NO: 533065 - protein, 11 aa, Influenza virus
NGTYYYPKYEE

SEQ ID NO: 533066 - protein, 11 aa, Influenza virus
NGVCPVVFTDG

SEQ ID NO: 533067 - protein, 11 aa, Influenza virus
NGVILEENTTY

SEQ ID NO: 533068 - protein, 11 aa, Influenza virus
NGVITDTLKSW

SEQ ID NO: 533069 - protein, 11 aa, Influenza virus
NGVKGFAYLDG

SEQ ID NO: 533070 - protein, 11 aa, Influenza virus
NGVKGFSYLDE

SEQ ID NO: 533071 - protein, 11 aa, Influenza virus
NGVKGFSYLDG

SEQ ID NO: 533072 - protein, 11 aa, Influenza virus
NGVKGFSYLNG

SEQ ID NO: 533073 - protein, 11 aa, Influenza virus
NGVKLEENSTY

SEQ ID NO: 533074 - protein, 11 aa, Influenza virus
NGVKLEENTSY

SEQ ID NO: 533075 - protein, 11 aa, Influenza virus
NGVKLEENTTY

SEQ ID NO: 533076 - protein, 11 aa, Influenza virus
NGVKVDGSSSA

SEQ ID NO: 533077 - protein, 11 aa, Influenza virus
NGVPVTSSIDL

SEQ ID NO: 533078 - protein, 11 aa, Influenza virus
NGVPVTSSVDL

SEQ ID NO: 533079 - protein, 11 aa, Influenza virus
NGVQDIIDNDN

SEQ ID NO: 533080 - protein, 11 aa, Influenza virus
NGVQDIIDNNN

SEQ ID NO: 533081 - protein, 11 aa, Influenza virus
NGVRIGSKGDV

SEQ ID NO: 533082 - protein, 11 aa, Influenza virus
NGVRLEENTTY

SEQ ID NO: 533083 - protein, 11 aa, Influenza virus
NGVSPIHLGDC

SEQ ID NO: 533084 - protein, 11 aa, Influenza virus
NGVSPVHLGDC

SEQ ID NO: 533085 - protein, 11 aa, Influenza virus
NGVTNKVNSII

SEQ ID NO: 533086 - protein, 11 aa, Influenza virus
NGWEGLIDGWY

SEQ ID NO: 533087 - protein, 11 aa, Influenza virus
NGWEGLINGWY

SEQ ID NO: 533088 - protein, 11 aa, Influenza virus
NGWEGLVDGWY

SEQ ID NO: 533089 - protein, 11 aa, Influenza virus
NGWEGMIDGWY

SEQ ID NO: 533090 - protein, 11 aa, Influenza virus
NGWEGMMDGWY

SEQ ID NO: 533091 - protein, 11 aa, Influenza virus
NGWEGMVDGWY

SEQ ID NO: 533092 - protein, 11 aa, Influenza virus
NGWEGMVNGWY

SEQ ID NO: 533093 - protein, 11 aa, Influenza virus
NGWQGLIDGWY

SEQ ID NO: 533094 - protein, 11 aa, Influenza virus
NGWVSTDKDSN

SEQ ID NO: 533095 - protein, 11 aa, Influenza virus
NGWVSTDKNSN

SEQ ID NO: 533096 - protein, 11 aa, Influenza virus
NGWVTADKDSN

SEQ ID NO: 533097 - protein, 11 aa, Influenza virus
NGWYGFQHQNE

SEQ ID NO: 533098 - protein, 11 aa, Influenza virus
NGWYGFQHRND

SEQ ID NO: 533099 - protein, 11 aa, Influenza virus
NGWYGFQHRNE

SEQ ID NO: 533100 - protein, 11 aa, Influenza virus
NGWYGFRHQNA

SEQ ID NO: 533101 - protein, 11 aa, Influenza virus
NGWYGFRHQNS

SEQ ID NO: 533102 - protein, 11 aa, Influenza virus
NGYIEGKLSQM

SEQ ID NO: 533103 - protein, 11 aa, Influenza virus
NGYKDVILWFS

SEQ ID NO: 533104 - protein, 11 aa, Influenza virus
NHEDYKEESQL

SEQ ID NO: 533105 - protein, 11 aa, Influenza virus
NHEDYREESQL

SEQ ID NO: 533106 - protein, 11 aa, Influenza virus
NHEGEGIPLYD

SEQ ID NO: 533107 - protein, 11 aa, Influenza virus
NHGICAVATTH

SEQ ID NO: 533108 - protein, 11 aa, Influenza virus
NHGSLVLSLWM

SEQ ID NO: 533109 - protein, 11 aa, Influenza virus
NHKDYEEEAKL

SEQ ID NO: 533110 - protein, 11 aa, Influenza virus
NHKEYEEEAKL

SEQ ID NO: 533111 - protein, 11 aa, Influenza virus
NHLIGKTNQQF

SEQ ID NO: 533112 - protein, 11 aa, Influenza virus
NHQFELIDNEF

SEQ ID NO: 533113 - protein, 11 aa, Influenza virus
NHSMSDIEAMA

SEQ ID NO: 533114 - protein, 11 aa, Influenza virus
NHTDELCPSPL

SEQ ID NO: 533115 - protein, 11 aa, Influenza virus
NHTEYRQEALQ

SEQ ID NO: 533116 - protein, 11 aa, Influenza virus
NHTGTYCSLNG

SEQ ID NO: 533117 - protein, 11 aa, Influenza virus
NHTTINNITNV

SEQ ID NO: 533118 - protein, 11 aa, Influenza virus
NHVEVVSAKEL

SEQ ID NO: 533119 - protein, 11 aa, Influenza virus
NICEKLEQSGL

SEQ ID NO: 533120 - protein, 11 aa, Influenza virus
NICKPYIGKCP

SEQ ID NO: 533121 - protein, 11 aa, Influenza virus
NIDKNALGDCP

SEQ ID NO: 533122 - protein, 11 aa, Influenza virus
NIDKNALGECP

SEQ ID NO: 533123 - protein, 11 aa, Influenza virus
NIDRFLRVRDQ

SEQ ID NO: 533124 - protein, 11 aa, Influenza virus
NIDRNAIGDCP

SEQ ID NO: 533125 - protein, 11 aa, Influenza virus
NIDRNALGDCP

SEQ ID NO: 533126 - protein, 11 aa, Influenza virus
NIDSRAVGKCP

SEQ ID NO: 533127 - protein, 11 aa, Influenza virus
NIDSWAVGRCP

SEQ ID NO: 533128 - protein, 11 aa, Influenza virus
NIEKNALGDCP

SEQ ID NO: 533129 - protein, 11 aa, Influenza virus
NIERNALGDCP

SEQ ID NO: 533130 - protein, 11 aa, Influenza virus
NIERNALGNCP

SEQ ID NO: 533131 - protein, 11 aa, Influenza virus
NIESNGNLIAP

SEQ ID NO: 533132 - protein, 11 aa, Influenza virus
NIEVTNATELV

SEQ ID NO: 533133 - protein, 11 aa, Influenza virus
NIFNMERIKEL

SEQ ID NO: 533134 - protein, 11 aa, Influenza virus
NIGPRALVRGQ

SEQ ID NO: 533135 - protein, 11 aa, Influenza virus
NIGPRPFVRGQ

SEQ ID NO: 533136 - protein, 11 aa, Influenza virus
NIGPRPLIRGQ

SEQ ID NO: 533137 - protein, 11 aa, Influenza virus
NIGPRPLVMGQ

SEQ ID NO: 533138 - protein, 11 aa, Influenza virus
NIGPRPLVREQ

SEQ ID NO: 533139 - protein, 11 aa, Influenza virus
NIGPRPLVRGQ

SEQ ID NO: 533140 - protein, 11 aa, Influenza virus
NIGSRPRVRNQ

SEQ ID NO: 533141 - protein, 11 aa, Influenza virus
NIHPLAIGECP

SEQ ID NO: 533142 - protein, 11 aa, Influenza virus
NIHPLTIGECP

SEQ ID NO: 533143 - protein, 11 aa, Influenza virus
NIHPLTIGKCP

SEQ ID NO: 533144 - protein, 11 aa, Influenza virus
NIIDKMNGNYD

SEQ ID NO: 533145 - protein, 11 aa, Influenza virus
NIIEKMNGNYD

SEQ ID NO: 533146 - protein, 11 aa, Influenza virus
NIIFLWGIHHP

SEQ ID NO: 533147 - protein, 11 aa, Influenza virus
NIIFSHNGGLI

SEQ ID NO: 533148 - protein, 11 aa, Influenza virus
NILEKTHNGKL

SEQ ID NO: 533149 - protein, 11 aa, Influenza virus
NILKGKFQTAA

SEQ ID NO: 533150 - protein, 11 aa, Influenza virus
NILLSPEEVSE

SEQ ID NO: 533151 - protein, 11 aa, Influenza virus
NILRTHESECV

SEQ ID NO: 533152 - protein, 11 aa, Influenza virus
NILRTQDSECV

SEQ ID NO: 533153 - protein, 11 aa, Influenza virus
NILRTQESECI

SEQ ID NO: 533154 - protein, 11 aa, Influenza virus
NILRTQESECQ

SEQ ID NO: 533155 - protein, 11 aa, Influenza virus
NILRTQESECV

SEQ ID NO: 533156 - protein, 11 aa, Influenza virus
NILRTQESSCT

SEQ ID NO: 533157 - protein, 11 aa, Influenza virus
NILSIAPIMFS

SEQ ID NO: 533158 - protein, 11 aa, Influenza virus
NILSMAPIMFS

SEQ ID NO: 533159 - protein, 11 aa, Influenza virus
NIMASQGTKRS

SEQ ID NO: 533160 - protein, 11 aa, Influenza virus
NIMRTQESECV

SEQ ID NO: 533161 - protein, 11 aa, Influenza virus
NINFMPYISFA

SEQ ID NO: 533162 - protein, 11 aa, Influenza virus
NINIREWSYLI

SEQ ID NO: 533163 - protein, 11 aa, Influenza virus
NINPVKLSSGY

SEQ ID NO: 533164 - protein, 11 aa, Influenza virus
NINPVTLSSGY

SEQ ID NO: 533165 - protein, 11 aa, Influenza virus
NINRITYGACP

SEQ ID NO: 533166 - protein, 11 aa, Influenza virus
NINSVKLSSGY

SEQ ID NO: 533167 - protein, 11 aa, Influenza virus
NIPGKQAKGLF

SEQ ID NO: 533168 - protein, 11 aa, Influenza virus
NIPQIESRGLF

SEQ ID NO: 533169 - protein, 11 aa, Influenza virus
NIPSIQSRGLF

SEQ ID NO: 533170 - protein, 11 aa, Influenza virus
NIPSVQSRGLF

SEQ ID NO: 533171 - protein, 11 aa, Influenza virus
NIPVTQTMELV

SEQ ID NO: 533172 - protein, 11 aa, Influenza virus
NIPVTQVEELV

SEQ ID NO: 533173 - protein, 11 aa, Influenza virus
NIQFEAVGREF

SEQ ID NO: 533174 - protein, 11 aa, Influenza virus
NIQFTAVGKEF

SEQ ID NO: 533175 - protein, 11 aa, Influenza virus
NIQFTSVGKEF

SEQ ID NO: 533176 - protein, 11 aa, Influenza virus
NIREWSYLIED

SEQ ID NO: 533177 - protein, 11 aa, Influenza virus
NIRIGSKGDVF

SEQ ID NO: 533178 - protein, 11 aa, Influenza virus
NIRNLHIPEAG

SEQ ID NO: 533179 - protein, 11 aa, Influenza virus
NIRNLHIPEVC

SEQ ID NO: 533180 - protein, 11 aa, Influenza virus
NITAASLNDDG

SEQ ID NO: 533181 - protein, 11 aa, Influenza virus
NITEIVYLNHT

SEQ ID NO: 533182 - protein, 11 aa, Influenza virus
NITEIVYLNNT

SEQ ID NO: 533183 - protein, 11 aa, Influenza virus
NITEIVYLNST

SEQ ID NO: 533184 - protein, 11 aa, Influenza virus
NITFLHNGGLI

SEQ ID NO: 533185 - protein, 11 aa, Influenza virus
NITFSDNGGLI

SEQ ID NO: 533186 - protein, 11 aa, Influenza virus
NITFSHNGGLI

SEQ ID NO: 533187 - protein, 11 aa, Influenza virus
NITKIVYLNST

SEQ ID NO: 533188 - protein, 11 aa, Influenza virus
NITVTHAKDIL

SEQ ID NO: 533189 - protein, 11 aa, Influenza virus
NITVTHAQDIL

SEQ ID NO: 533190 - protein, 11 aa, Influenza virus
NITVTHSVELL

SEQ ID NO: 533191 - protein, 11 aa, Influenza virus
NITVTHSVNLL

SEQ ID NO: 533192 - protein, 11 aa, Influenza virus
NITVTSSVELV

SEQ ID NO: 533193 - protein, 11 aa, Influenza virus
NIVDKMNREFE

SEQ ID NO: 533194 - protein, 11 aa, Influenza virus
NIVDKMNREFG

SEQ ID NO: 533195 - protein, 11 aa, Influenza virus
NIVRRAAVSAD

SEQ ID NO: 533196 - protein, 11 aa, Influenza virus
NIVRRAIVSAD

SEQ ID NO: 533197 - protein, 11 aa, Influenza virus
NIVRRATVSAD

SEQ ID NO: 533198 - protein, 11 aa, Influenza virus
NIVRRATVSTD

SEQ ID NO: 533199 - protein, 11 aa, Influenza virus
NIWAYNAELLV

SEQ ID NO: 533200 - protein, 11 aa, Influenza virus
NIWITREPYVS

SEQ ID NO: 533201 - protein, 11 aa, Influenza virus
NIWSYNAQLLV

SEQ ID NO: 533202 - protein, 11 aa, Influenza virus
NIYKILSIYSC

SEQ ID NO: 533203 - protein, 11 aa, Influenza virus
NIYRDEAINNR

SEQ ID NO: 533204 - protein, 11 aa, Influenza virus
NKACELTDSIW

SEQ ID NO: 533205 - protein, 11 aa, Influenza virus
NKACELTDSSW

SEQ ID NO: 533206 - protein, 11 aa, Influenza virus
NKACELTDSTW

SEQ ID NO: 533207 - protein, 11 aa, Influenza virus
NKACELTDSVW

SEQ ID NO: 533208 - protein, 11 aa, Influenza virus
NKACELTGSSW

SEQ ID NO: 533209 - protein, 11 aa, Influenza virus
NKCIERVRNGT

SEQ ID NO: 533210 - protein, 11 aa, Influenza virus
NKCIESIRNGT

SEQ ID NO: 533211 - protein, 11 aa, Influenza virus
NKCMETIKNGT

SEQ ID NO: 533212 - protein, 11 aa, Influenza virus
NKCYQFALGQG

SEQ ID NO: 533213 - protein, 11 aa, Influenza virus
NKDGDIIFLWG

SEQ ID NO: 533214 - protein, 11 aa, Influenza virus
NKFAAICTHLE

SEQ ID NO: 533215 - protein, 11 aa, Influenza virus
NKFAAICTHME

SEQ ID NO: 533216 - protein, 11 aa, Influenza virus
NKFASICTHLE

SEQ ID NO: 533217 - protein, 11 aa, Influenza virus
NKHSNDTIHDR

SEQ ID NO: 533218 - protein, 11 aa, Influenza virus
NKHSNDTVHDR

SEQ ID NO: 533219 - protein, 11 aa, Influenza virus
NKHSNGTIHDR

SEQ ID NO: 533220 - protein, 11 aa, Influenza virus
NKHSNGTKHDR

SEQ ID NO: 533221 - protein, 11 aa, Influenza virus
NKHSNGTTHDR

SEQ ID NO: 533222 - protein, 11 aa, Influenza virus
NKHSNSTTHDR

SEQ ID NO: 533223 - protein, 11 aa, Influenza virus
NKHWSGYSGSF

SEQ ID NO: 533224 - protein, 11 aa, Influenza virus
NKIEFEPFQSL

SEQ ID NO: 533225 - protein, 11 aa, Influenza virus
NKINNIVDKMN

SEQ ID NO: 533226 - protein, 11 aa, Influenza virus
NKINSIIDKMN

SEQ ID NO: 533227 - protein, 11 aa, Influenza virus
NKITNKVNNIV

SEQ ID NO: 533228 - protein, 11 aa, Influenza virus
NKKMEDGFLDI

SEQ ID NO: 533229 - protein, 11 aa, Influenza virus
NKKMEDGFLDV

SEQ ID NO: 533230 - protein, 11 aa, Influenza virus
NKKMEDGFLNV

SEQ ID NO: 533231 - protein, 11 aa, Influenza virus
NKLAAICTHLE

SEQ ID NO: 533232 - protein, 11 aa, Influenza virus
NKLEFEPFQSL

SEQ ID NO: 533233 - protein, 11 aa, Influenza virus
NKLFERVRRQL

SEQ ID NO: 533234 - protein, 11 aa, Influenza virus
NKLITVGSSKY

SEQ ID NO: 533235 - protein, 11 aa, Influenza virus
NKLNNVIDKMN

SEQ ID NO: 533236 - protein, 11 aa, Influenza virus
NKLNNVIDKMY

SEQ ID NO: 533237 - protein, 11 aa, Influenza virus
NKLYEKVRRQL

SEQ ID NO: 533238 - protein, 11 aa, Influenza virus
NKLYERVKRQL

SEQ ID NO: 533239 - protein, 11 aa, Influenza virus
NKLYERVRKQL

SEQ ID NO: 533240 - protein, 11 aa, Influenza virus
NKLYERVRRQL

SEQ ID NO: 533241 - protein, 11 aa, Influenza virus
NKLYGAGNKLI

SEQ ID NO: 533242 - protein, 11 aa, Influenza virus
NKLYGTGNKLI

SEQ ID NO: 533243 - protein, 11 aa, Influenza virus
NKLYVNKNPYT

SEQ ID NO: 533244 - protein, 11 aa, Influenza virus
NKMARLGKGYM

SEQ ID NO: 533245 - protein, 11 aa, Influenza virus
NKMARLGRGYM

SEQ ID NO: 533246 - protein, 11 aa, Influenza virus
NKMEFEPFQSL

SEQ ID NO: 533247 - protein, 11 aa, Influenza virus
NKNATATVYYD

SEQ ID NO: 533248 - protein, 11 aa, Influenza virus
NKNEIKGVKLS

SEQ ID NO: 533249 - protein, 11 aa, Influenza virus
NKNPYTLVSTK

SEQ ID NO: 533250 - protein, 11 aa, Influenza virus
NKNWSGYSGAF

SEQ ID NO: 533251 - protein, 11 aa, Influenza virus
NKNWSGYSGSF

SEQ ID NO: 533252 - protein, 11 aa, Influenza virus
NKQASYKIFKS

SEQ ID NO: 533253 - protein, 11 aa, Influenza virus
NKQFELIDNEF

SEQ ID NO: 533254 - protein, 11 aa, Influenza virus
NKRLCKVEGWV

SEQ ID NO: 533255 - protein, 11 aa, Influenza virus
NKSLCKIEGWV

SEQ ID NO: 533256 - protein, 11 aa, Influenza virus
NKSLCKVEGWV

SEQ ID NO: 533257 - protein, 11 aa, Influenza virus
NKSLCNVEGWV

SEQ ID NO: 533258 - protein, 11 aa, Influenza virus
NKSLCSVEGWV

SEQ ID NO: 533259 - protein, 11 aa, Influenza virus
NKTFQNIDKNA

SEQ ID NO: 533260 - protein, 11 aa, Influenza virus
NKTFQNIDRNA

SEQ ID NO: 533261 - protein, 11 aa, Influenza virus
NKTFQNIEKNA

SEQ ID NO: 533262 - protein, 11 aa, Influenza virus
NKTFQNIERNA

SEQ ID NO: 533263 - protein, 11 aa, Influenza virus
NKTFQNISPVW

SEQ ID NO: 533264 - protein, 11 aa, Influenza virus
NKTFQNVSPIW

SEQ ID NO: 533265 - protein, 11 aa, Influenza virus
NKTFQNVSPLW

SEQ ID NO: 533266 - protein, 11 aa, Influenza virus
NKTFQNVSPVW

SEQ ID NO: 533267 - protein, 11 aa, Influenza virus
NKTGTFEFTSF

SEQ ID NO: 533268 - protein, 11 aa, Influenza virus
NKTKKMTITFL

SEQ ID NO: 533269 - protein, 11 aa, Influenza virus
NKTVINNITTT

SEQ ID NO: 533270 - protein, 11 aa, Influenza virus
NKVARLGKGYM

SEQ ID NO: 533271 - protein, 11 aa, Influenza virus
NKVCTKGKKAV

SEQ ID NO: 533272 - protein, 11 aa, Influenza virus
NKVEFEPFQSL

SEQ ID NO: 533273 - protein, 11 aa, Influenza virus
NKVKEIGNGCF

SEQ ID NO: 533274 - protein, 11 aa, Influenza virus
NKVNNIVDKMN

SEQ ID NO: 533275 - protein, 11 aa, Influenza virus
NKVNSIIDKMN

SEQ ID NO: 533276 - protein, 11 aa, Influenza virus
NKVNSIIEKMN

SEQ ID NO: 533277 - protein, 11 aa, Influenza virus
NKVNSIIGKMN

SEQ ID NO: 533278 - protein, 11 aa, Influenza virus
NKVNSIINKMN

SEQ ID NO: 533279 - protein, 11 aa, Influenza virus
NKVNSVIEKMN

SEQ ID NO: 533280 - protein, 11 aa, Influenza virus
NKVNSVVEKMN

SEQ ID NO: 533281 - protein, 11 aa, Influenza virus
NKVNTVIEKMN

SEQ ID NO: 533282 - protein, 11 aa, Influenza virus
NKVRMQLRDNV

SEQ ID NO: 533283 - protein, 11 aa, Influenza virus
NKWGDILDGVT

SEQ ID NO: 533284 - protein, 11 aa, Influenza virus
NKWGNVLDGVT

SEQ ID NO: 533285 - protein, 11 aa, Influenza virus
NKWSGYSGSFI

SEQ ID NO: 533286 - protein, 11 aa, Influenza virus
NKYLEEHPNAG

SEQ ID NO: 533287 - protein, 11 aa, Influenza virus
NKYLEEHPSAG

SEQ ID NO: 533288 - protein, 11 aa, Influenza virus
NKYLEEHPSTG

SEQ ID NO: 533289 - protein, 11 aa, Influenza virus
NLCQVECVCRD

SEQ ID NO: 533290 - protein, 11 aa, Influenza virus
NLCRFLETRTV

SEQ ID NO: 533291 - protein, 11 aa, Influenza virus
NLDLNMGQPFY

SEQ ID NO: 533292 - protein, 11 aa, Influenza virus
NLDYQIGYVCS

SEQ ID NO: 533293 - protein, 11 aa, Influenza virus
NLEELRFVFSI

SEQ ID NO: 533294 - protein, 11 aa, Influenza virus
NLEELRFVFSN

SEQ ID NO: 533295 - protein, 11 aa, Influenza virus
NLEELRFVFSS

SEQ ID NO: 533296 - protein, 11 aa, Influenza virus
NLEKRLENLNK

SEQ ID NO: 533297 - protein, 11 aa, Influenza virus
NLEKRLGNLNK

SEQ ID NO: 533298 - protein, 11 aa, Influenza virus
NLERRLENLNK

SEQ ID NO: 533299 - protein, 11 aa, Influenza virus
NLERRLENLSK

SEQ ID NO: 533300 - protein, 11 aa, Influenza virus
NLESRSGFEMV

SEQ ID NO: 533301 - protein, 11 aa, Influenza virus
NLFDEVKRRLS

SEQ ID NO: 533302 - protein, 11 aa, Influenza virus
NLFDEVRRRLS

SEQ ID NO: 533303 - protein, 11 aa, Influenza virus
NLFEKFFPSSS

SEQ ID NO: 533304 - protein, 11 aa, Influenza virus
NLFTLSGVAIA

SEQ ID NO: 533305 - protein, 11 aa, Influenza virus
NLGKVECVCRD

SEQ ID NO: 533306 - protein, 11 aa, Influenza virus
NLGLNIGLHLK

SEQ ID NO: 533307 - protein, 11 aa, Influenza virus
NLGLNIGLHLR

SEQ ID NO: 533308 - protein, 11 aa, Influenza virus
NLGLNVGLHLK

SEQ ID NO: 533309 - protein, 11 aa, Influenza virus
NLGQVECVCRD

SEQ ID NO: 533310 - protein, 11 aa, Influenza virus
NLHAYISFRNL

SEQ ID NO: 533311 - protein, 11 aa, Influenza virus
NLHIPEAGLKW

SEQ ID NO: 533312 - protein, 11 aa, Influenza virus
NLHIPEVCLKW

SEQ ID NO: 533313 - protein, 11 aa, Influenza virus
NLIAPEFGYLL

SEQ ID NO: 533314 - protein, 11 aa, Influenza virus
NLIAPEYGFKI

SEQ ID NO: 533315 - protein, 11 aa, Influenza virus
NLIAPEYGFRI

SEQ ID NO: 533316 - protein, 11 aa, Influenza virus
NLIAPEYGHLI

SEQ ID NO: 533317 - protein, 11 aa, Influenza virus
NLIAPEYGHLT

SEQ ID NO: 533318 - protein, 11 aa, Influenza virus
NLIAPEYGHLV

SEQ ID NO: 533319 - protein, 11 aa, Influenza virus
NLIAPEYGYLI

SEQ ID NO: 533320 - protein, 11 aa, Influenza virus
NLIAPRGHYKI

SEQ ID NO: 533321 - protein, 11 aa, Influenza virus
NLIAPRGHYKL

SEQ ID NO: 533322 - protein, 11 aa, Influenza virus
NLIAPRGHYRL

SEQ ID NO: 533323 - protein, 11 aa, Influenza virus
NLIAPRGYFKI

SEQ ID NO: 533324 - protein, 11 aa, Influenza virus
NLIAPRGYFKM

SEQ ID NO: 533325 - protein, 11 aa, Influenza virus
NLIAPRGYFKV

SEQ ID NO: 533326 - protein, 11 aa, Influenza virus
NLIAPRGYFRI

SEQ ID NO: 533327 - protein, 11 aa, Influenza virus
NLIAPRGYYKM

SEQ ID NO: 533328 - protein, 11 aa, Influenza virus
NLIGKTSWSYI

SEQ ID NO: 533329 - protein, 11 aa, Influenza virus
NLIIGISNVGL

SEQ ID NO: 533330 - protein, 11 aa, Influenza virus
NLIVFNTIGNL

SEQ ID NO: 533331 - protein, 11 aa, Influenza virus
NLKLATGLRNV

SEQ ID NO: 533332 - protein, 11 aa, Influenza virus
NLLHKCNDSCM

SEQ ID NO: 533333 - protein, 11 aa, Influenza virus
NLLIGISNIGL

SEQ ID NO: 533334 - protein, 11 aa, Influenza virus
NLLIGISNMSL

SEQ ID NO: 533335 - protein, 11 aa, Influenza virus
NLLIGISNVGL

SEQ ID NO: 533336 - protein, 11 aa, Influenza virus
NLLIGISNVVL

SEQ ID NO: 533337 - protein, 11 aa, Influenza virus
NLLIGVSNVGL

SEQ ID NO: 533338 - protein, 11 aa, Influenza virus
NLNDATYQRTR

SEQ ID NO: 533339 - protein, 11 aa, Influenza virus
NLNDTTYQRTR

SEQ ID NO: 533340 - protein, 11 aa, Influenza virus
NLNKKIDDGFL

SEQ ID NO: 533341 - protein, 11 aa, Influenza virus
NLNKKMEDGFL

SEQ ID NO: 533342 - protein, 11 aa, Influenza virus
NLNKKVDDGFI

SEQ ID NO: 533343 - protein, 11 aa, Influenza virus
NLNKKVDDGFL

SEQ ID NO: 533344 - protein, 11 aa, Influenza virus
NLNKKVDDGLL

SEQ ID NO: 533345 - protein, 11 aa, Influenza virus
NLNRKMEDGFL

SEQ ID NO: 533346 - protein, 11 aa, Influenza virus
NLNRKVDDGFL

SEQ ID NO: 533347 - protein, 11 aa, Influenza virus
NLNWSGYSGSF

SEQ ID NO: 533348 - protein, 11 aa, Influenza virus
NLQAYQKRMGL

SEQ ID NO: 533349 - protein, 11 aa, Influenza virus
NLQAYQKRMGV

SEQ ID NO: 533350 - protein, 11 aa, Influenza virus
NLQTYQKRMGV

SEQ ID NO: 533351 - protein, 11 aa, Influenza virus
NLSGYSGSFID

SEQ ID NO: 533352 - protein, 11 aa, Influenza virus
NLSPRTVGQCP

SEQ ID NO: 533353 - protein, 11 aa, Influenza virus
NLTKELCTINS

SEQ ID NO: 533354 - protein, 11 aa, Influenza virus
NLTKGLCTINS

SEQ ID NO: 533355 - protein, 11 aa, Influenza virus
NLTKRLCTINS

SEQ ID NO: 533356 - protein, 11 aa, Influenza virus
NLTRELCTINS

SEQ ID NO: 533357 - protein, 11 aa, Influenza virus
NLTRGLCTINS

SEQ ID NO: 533358 - protein, 11 aa, Influenza virus
NLVAPEYGFKI

SEQ ID NO: 533359 - protein, 11 aa, Influenza virus
NLVAPRGHYKL

SEQ ID NO: 533360 - protein, 11 aa, Influenza virus
NLWAYNAELLV

SEQ ID NO: 533361 - protein, 11 aa, Influenza virus
NLYASKNPYTL

SEQ ID NO: 533362 - protein, 11 aa, Influenza virus
NLYDKVRLQLK

SEQ ID NO: 533363 - protein, 11 aa, Influenza virus
NLYDKVRLQLR

SEQ ID NO: 533364 - protein, 11 aa, Influenza virus
NLYDKVRMQLK

SEQ ID NO: 533365 - protein, 11 aa, Influenza virus
NLYDKVRMQLR

SEQ ID NO: 533366 - protein, 11 aa, Influenza virus
NLYDRVRKQLR

SEQ ID NO: 533367 - protein, 11 aa, Influenza virus
NLYDRVRLQLR

SEQ ID NO: 533368 - protein, 11 aa, Influenza virus
NLYEKVRLQLR

SEQ ID NO: 533369 - protein, 11 aa, Influenza virus
NLYEKVRMQLR

SEQ ID NO: 533370 - protein, 11 aa, Influenza virus
NLYERVRKQLR

SEQ ID NO: 533371 - protein, 11 aa, Influenza virus
NLYGFIIKGRS

SEQ ID NO: 533372 - protein, 11 aa, Influenza virus
NLYGFIVKGRS

SEQ ID NO: 533373 - protein, 11 aa, Influenza virus
NLYNIRNLHIP

SEQ ID NO: 533374 - protein, 11 aa, Influenza virus
NLYNKVRMQLR

SEQ ID NO: 533375 - protein, 11 aa, Influenza virus
NLYVNKNPYTL

SEQ ID NO: 533376 - protein, 11 aa, Influenza virus
NMARAVKLYKK

SEQ ID NO: 533377 - protein, 11 aa, Influenza virus
NMDKAVKLYKK

SEQ ID NO: 533378 - protein, 11 aa, Influenza virus
NMDKAVKLYRK

SEQ ID NO: 533379 - protein, 11 aa, Influenza virus
NMDRAVKLYKK

SEQ ID NO: 533380 - protein, 11 aa, Influenza virus
NMDRAVKLYRK

SEQ ID NO: 533381 - protein, 11 aa, Influenza virus
NMERIKELRDL

SEQ ID NO: 533382 - protein, 11 aa, Influenza virus
NMERIKELRYL

SEQ ID NO: 533383 - protein, 11 aa, Influenza virus
NMGIYQILAIY

SEQ ID NO: 533384 - protein, 11 aa, Influenza virus
NMGKVECVCRD

SEQ ID NO: 533385 - protein, 11 aa, Influenza virus
NMGVYQILAIY

SEQ ID NO: 533386 - protein, 11 aa, Influenza virus
NMGVYQVLAIY

SEQ ID NO: 533387 - protein, 11 aa, Influenza virus
NMHDANVRNLH

SEQ ID NO: 533388 - protein, 11 aa, Influenza virus
NMIADRVDDAV

SEQ ID NO: 533389 - protein, 11 aa, Influenza virus
NMINDKIDDQI

SEQ ID NO: 533390 - protein, 11 aa, Influenza virus
NMINDKINDQI

SEQ ID NO: 533391 - protein, 11 aa, Influenza virus
NMINNDLGPAT

SEQ ID NO: 533392 - protein, 11 aa, Influenza virus
NMISDKIDDQI

SEQ ID NO: 533393 - protein, 11 aa, Influenza virus
NMLADRIDDAV

SEQ ID NO: 533394 - protein, 11 aa, Influenza virus
NMLADRVDDAV

SEQ ID NO: 533395 - protein, 11 aa, Influenza virus
NMLADWVDDAV

SEQ ID NO: 533396 - protein, 11 aa, Influenza virus
NMLSTVLGVSI

SEQ ID NO: 533397 - protein, 11 aa, Influenza virus
NMLSTVLGVSV

SEQ ID NO: 533398 - protein, 11 aa, Influenza virus
NMNWSGYSGSF

SEQ ID NO: 533399 - protein, 11 aa, Influenza virus
NMQNKLNNVID

SEQ ID NO: 533400 - protein, 11 aa, Influenza virus
NMQNRLNNVID

SEQ ID NO: 533401 - protein, 11 aa, Influenza virus
NMRCTISLVKT

SEQ ID NO: 533402 - protein, 11 aa, Influenza virus
NMSKKKSYINK

SEQ ID NO: 533403 - protein, 11 aa, Influenza virus
NMSKKKSYINR

SEQ ID NO: 533404 - protein, 11 aa, Influenza virus
NMSKRKSYINK

SEQ ID NO: 533405 - protein, 11 aa, Influenza virus
NMTNVQNNYTT

SEQ ID NO: 533406 - protein, 11 aa, Influenza virus
NNADHRIYWIR

SEQ ID NO: 533407 - protein, 11 aa, Influenza virus
NNADHRVYWIR

SEQ ID NO: 533408 - protein, 11 aa, Influenza virus
NNAIDEGDGCF

SEQ ID NO: 533409 - protein, 11 aa, Influenza virus
NNAKDEGNGCF

SEQ ID NO: 533410 - protein, 11 aa, Influenza virus
NNAKEIGNGCF

SEQ ID NO: 533411 - protein, 11 aa, Influenza virus
NNAKELGNGCF

SEQ ID NO: 533412 - protein, 11 aa, Influenza virus
NNAKEVGNGCF

SEQ ID NO: 533413 - protein, 11 aa, Influenza virus
NNAQEIGNGCF

SEQ ID NO: 533414 - protein, 11 aa, Influenza virus
NNATATVYYDR

SEQ ID NO: 533415 - protein, 11 aa, Influenza virus
NNATATVYYER

SEQ ID NO: 533416 - protein, 11 aa, Influenza virus
NNATDTVDTLT

SEQ ID NO: 533417 - protein, 11 aa, Influenza virus
NNBNGVKGFSY

SEQ ID NO: 533418 - protein, 11 aa, Influenza virus
NNCIESIRNGK

SEQ ID NO: 533419 - protein, 11 aa, Influenza virus
NNCIESIRNGT

SEQ ID NO: 533420 - protein, 11 aa, Influenza virus
NNCMESIRNNT

SEQ ID NO: 533421 - protein, 11 aa, Influenza virus
NNDLGPATAQM

SEQ ID NO: 533422 - protein, 11 aa, Influenza virus
NNDNATATVYY

SEQ ID NO: 533423 - protein, 11 aa, Influenza virus
NNDWSGYSGSF

SEQ ID NO: 533424 - protein, 11 aa, Influenza virus
NNECMETIKNG

SEQ ID NO: 533425 - protein, 11 aa, Influenza virus
NNEDGDIIFLW

SEQ ID NO: 533426 - protein, 11 aa, Influenza virus
NNEDGNIIFLW

SEQ ID NO: 533427 - protein, 11 aa, Influenza virus
NNEEGDIIFLW

SEQ ID NO: 533428 - protein, 11 aa, Influenza virus
NNEGSYFFGDN

SEQ ID NO: 533429 - protein, 11 aa, Influenza virus
NNEKGNPGVKG

SEQ ID NO: 533430 - protein, 11 aa, Influenza virus
NNEKGNQGVKG

SEQ ID NO: 533431 - protein, 11 aa, Influenza virus
NNENATATVYY

SEQ ID NO: 533432 - protein, 11 aa, Influenza virus
NNENGDIIFLW

SEQ ID NO: 533433 - protein, 11 aa, Influenza virus
NNEPGSGNWPD

SEQ ID NO: 533434 - protein, 11 aa, Influenza virus
NNEQGSGYAAD

SEQ ID NO: 533435 - protein, 11 aa, Influenza virus
NNERGNHGVKG

SEQ ID NO: 533436 - protein, 11 aa, Influenza virus
NNERGNPGVKG

SEQ ID NO: 533437 - protein, 11 aa, Influenza virus
NNERGNQGVKG

SEQ ID NO: 533438 - protein, 11 aa, Influenza virus
NNERGTQGVKG

SEQ ID NO: 533439 - protein, 11 aa, Influenza virus
NNETIIETGYV

SEQ ID NO: 533440 - protein, 11 aa, Influenza virus
NNETILETGYI

SEQ ID NO: 533441 - protein, 11 aa, Influenza virus
NNETILETGYV

SEQ ID NO: 533442 - protein, 11 aa, Influenza virus
NNETILETRYV

SEQ ID NO: 533443 - protein, 11 aa, Influenza virus
NNETIVETGYV

SEQ ID NO: 533444 - protein, 11 aa, Influenza virus
NNFVPVIGARP

SEQ ID NO: 533445 - protein, 11 aa, Influenza virus
NNFVPVMGARP

SEQ ID NO: 533446 - protein, 11 aa, Influenza virus
NNFVPVVGARP

SEQ ID NO: 533447 - protein, 11 aa, Influenza virus
NNFVPVVRARP

SEQ ID NO: 533448 - protein, 11 aa, Influenza virus
NNGDYARLYIW

SEQ ID NO: 533449 - protein, 11 aa, Influenza virus
NNGDYTRLYIW

SEQ ID NO: 533450 - protein, 11 aa, Influenza virus
NNGELRHLFSG

SEQ ID NO: 533451 - protein, 11 aa, Influenza virus
NNGKFEFIAED

SEQ ID NO: 533452 - protein, 11 aa, Influenza virus
NNGKFEFIAEE

SEQ ID NO: 533453 - protein, 11 aa, Influenza virus
NNGKFEFIVEK

SEQ ID NO: 533454 - protein, 11 aa, Influenza virus
NNGKGRYGVKG

SEQ ID NO: 533455 - protein, 11 aa, Influenza virus
NNGKLEFIAEE

SEQ ID NO: 533456 - protein, 11 aa, Influenza virus
NNGKVECICRD

SEQ ID NO: 533457 - protein, 11 aa, Influenza virus
NNGNYARLYIW

SEQ ID NO: 533458 - protein, 11 aa, Influenza virus
NNGRFEFIAEE

SEQ ID NO: 533459 - protein, 11 aa, Influenza virus
NNGSCRCTICI

SEQ ID NO: 533460 - protein, 11 aa, Influenza virus
NNGVKGFAYLD

SEQ ID NO: 533461 - protein, 11 aa, Influenza virus
NNGVKGFSYLD

SEQ ID NO: 533462 - protein, 11 aa, Influenza virus
NNGVKGFSYLN

SEQ ID NO: 533463 - protein, 11 aa, Influenza virus
NNHTTINNITN

SEQ ID NO: 533464 - protein, 11 aa, Influenza virus
NNIIDKMNGNY

SEQ ID NO: 533465 - protein, 11 aa, Influenza virus
NNIIEKMNGNY

SEQ ID NO: 533466 - protein, 11 aa, Influenza virus
NNILRTQESEC

SEQ ID NO: 533467 - protein, 11 aa, Influenza virus
NNIRIGSKGDV

SEQ ID NO: 533468 - protein, 11 aa, Influenza virus
NNIVDKMNREF

SEQ ID NO: 533469 - protein, 11 aa, Influenza virus
NNKDGDIIFLW

SEQ ID NO: 533470 - protein, 11 aa, Influenza virus
NNKHSNGTIHD

SEQ ID NO: 533471 - protein, 11 aa, Influenza virus
NNKHWSGYSGS

SEQ ID NO: 533472 - protein, 11 aa, Influenza virus
NNKNATATVYY

SEQ ID NO: 533473 - protein, 11 aa, Influenza virus
NNKNWSGYSGA

SEQ ID NO: 533474 - protein, 11 aa, Influenza virus
NNKNWSGYSGS

SEQ ID NO: 533475 - protein, 11 aa, Influenza virus
NNLTKGLCTIN

SEQ ID NO: 533476 - protein, 11 aa, Influenza virus
NNLTKRLCTIN

SEQ ID NO: 533477 - protein, 11 aa, Influenza virus
NNLTRELCTIN

SEQ ID NO: 533478 - protein, 11 aa, Influenza virus
NNLTRGLCKIN

SEQ ID NO: 533479 - protein, 11 aa, Influenza virus
NNLTRGLCTIN

SEQ ID NO: 533480 - protein, 11 aa, Influenza virus
NNMINNDLGPA

SEQ ID NO: 533481 - protein, 11 aa, Influenza virus
NNMNWSGYSGS

SEQ ID NO: 533482 - protein, 11 aa, Influenza virus
NNMVNNDLGPA

SEQ ID NO: 533483 - protein, 11 aa, Influenza virus
NNNASAIIWYN

SEQ ID NO: 533484 - protein, 11 aa, Influenza virus
NNNASAIVWYN

SEQ ID NO: 533485 - protein, 11 aa, Influenza virus
NNNASAVIWYK

SEQ ID NO: 533486 - protein, 11 aa, Influenza virus
NNNASAVIWYN

SEQ ID NO: 533487 - protein, 11 aa, Influenza virus
NNNASAVVWYN

SEQ ID NO: 533488 - protein, 11 aa, Influenza virus
NNNATATVYYD

SEQ ID NO: 533489 - protein, 11 aa, Influenza virus
NNNATATVYYN

SEQ ID NO: 533490 - protein, 11 aa, Influenza virus
NNNGELRHLFS

SEQ ID NO: 533491 - protein, 11 aa, Influenza virus
NNNGVKGFAYL

SEQ ID NO: 533492 - protein, 11 aa, Influenza virus
NNNGVKGFSYL

SEQ ID NO: 533493 - protein, 11 aa, Influenza virus
NNNKGAVFKSN

SEQ ID NO: 533494 - protein, 11 aa, Influenza virus
NNNLSGYSGSF

SEQ ID NO: 533495 - protein, 11 aa, Influenza virus
NNNNATATVYY

SEQ ID NO: 533496 - protein, 11 aa, Influenza virus
NNNNGVKGFAY

SEQ ID NO: 533497 - protein, 11 aa, Influenza virus
NNNNGVKGFSY

SEQ ID NO: 533498 - protein, 11 aa, Influenza virus
NNNNNTATLCL

SEQ ID NO: 533499 - protein, 11 aa, Influenza virus
NNNWFGYFGIF

SEQ ID NO: 533500 - protein, 11 aa, Influenza virus
NNNWSGYSGIF

SEQ ID NO: 533501 - protein, 11 aa, Influenza virus
NNNWSGYSGSF

SEQ ID NO: 533502 - protein, 11 aa, Influenza virus
NNPITGSPEAP

SEQ ID NO: 533503 - protein, 11 aa, Influenza virus
NNPITGSPGAP

SEQ ID NO: 533504 - protein, 11 aa, Influenza virus
NNPNWSGYSGA

SEQ ID NO: 533505 - protein, 11 aa, Influenza virus
NNQASYKIFKS

SEQ ID NO: 533506 - protein, 11 aa, Influenza virus
NNQASYRIFKS

SEQ ID NO: 533507 - protein, 11 aa, Influenza virus
NNQDWSGYSGA

SEQ ID NO: 533508 - protein, 11 aa, Influenza virus
NNQKWSGYSGA

SEQ ID NO: 533509 - protein, 11 aa, Influenza virus
NNQNWSGYSGA

SEQ ID NO: 533510 - protein, 11 aa, Influenza virus
NNQNWSGYSGS

SEQ ID NO: 533511 - protein, 11 aa, Influenza virus
NNQVFPQLNQT

SEQ ID NO: 533512 - protein, 11 aa, Influenza virus
NNRIKINPVTL

SEQ ID NO: 533513 - protein, 11 aa, Influenza virus
NNRKEPALIVW

SEQ ID NO: 533514 - protein, 11 aa, Influenza virus
NNRNWSGYSGS

SEQ ID NO: 533515 - protein, 11 aa, Influenza virus
NNRSGYSGIFS

SEQ ID NO: 533516 - protein, 11 aa, Influenza virus
NNSCMETIRNG

SEQ ID NO: 533517 - protein, 11 aa, Influenza virus
NNSSDTVDTLT

SEQ ID NO: 533518 - protein, 11 aa, Influenza virus
NNSTATLCLGH

SEQ ID NO: 533519 - protein, 11 aa, Influenza virus
NNSTDKIDTLT

SEQ ID NO: 533520 - protein, 11 aa, Influenza virus
NNSTDKVDTII

SEQ ID NO: 533521 - protein, 11 aa, Influenza virus
NNSTDKVDTLT

SEQ ID NO: 533522 - protein, 11 aa, Influenza virus
NNSTDKVNTII

SEQ ID NO: 533523 - protein, 11 aa, Influenza virus
NNSTDTVDTIL

SEQ ID NO: 533524 - protein, 11 aa, Influenza virus
NNSTDTVDTLI

SEQ ID NO: 533525 - protein, 11 aa, Influenza virus
NNSTDTVDTLL

SEQ ID NO: 533526 - protein, 11 aa, Influenza virus
NNSTDTVDTLT

SEQ ID NO: 533527 - protein, 11 aa, Influenza virus
NNSTDTVDTVL

SEQ ID NO: 533528 - protein, 11 aa, Influenza virus
NNSTDTVNTLI

SEQ ID NO: 533529 - protein, 11 aa, Influenza virus
NNSTDTVNTLM

SEQ ID NO: 533530 - protein, 11 aa, Influenza virus
NNSTDTVNTLT

SEQ ID NO: 533531 - protein, 11 aa, Influenza virus
NNSTEHVDTIM

SEQ ID NO: 533532 - protein, 11 aa, Influenza virus
NNSTEKVDTII

SEQ ID NO: 533533 - protein, 11 aa, Influenza virus
NNSTEQVDTIM

SEQ ID NO: 533534 - protein, 11 aa, Influenza virus
NNSTERVDTII

SEQ ID NO: 533535 - protein, 11 aa, Influenza virus
NNSTERVDTIM

SEQ ID NO: 533536 - protein, 11 aa, Influenza virus
NNSTETVNTLI

SEQ ID NO: 533537 - protein, 11 aa, Influenza virus
NNSTETVNTLS

SEQ ID NO: 533538 - protein, 11 aa, Influenza virus
NNSTETVNTLT

SEQ ID NO: 533539 - protein, 11 aa, Influenza virus
NNSTKQVDTIM

SEQ ID NO: 533540 - protein, 11 aa, Influenza virus
NNSTNTVNTLI

SEQ ID NO: 533541 - protein, 11 aa, Influenza virus
NNSTVQVDTIM

SEQ ID NO: 533542 - protein, 11 aa, Influenza virus
NNSWSGYSGIF

SEQ ID NO: 533543 - protein, 11 aa, Influenza virus
NNTCMETIRNG

SEQ ID NO: 533544 - protein, 11 aa, Influenza virus
NNTEPLCDVSG

SEQ ID NO: 533545 - protein, 11 aa, Influenza virus
NNTEPLCEVSG

SEQ ID NO: 533546 - protein, 11 aa, Influenza virus
NNTEPLCNVSG

SEQ ID NO: 533547 - protein, 11 aa, Influenza virus
NNTNGEQILII

SEQ ID NO: 533548 - protein, 11 aa, Influenza virus
NNTSGEQMLII

SEQ ID NO: 533549 - protein, 11 aa, Influenza virus
NNTSGEQMLVI

SEQ ID NO: 533550 - protein, 11 aa, Influenza virus
NNTSGKQMLII

SEQ ID NO: 533551 - protein, 11 aa, Influenza virus
NNTTGRDVLVI

SEQ ID NO: 533552 - protein, 11 aa, Influenza virus
NNTTGRDVLVL

SEQ ID NO: 533553 - protein, 11 aa, Influenza virus
NNTTGRDVLVM

SEQ ID NO: 533554 - protein, 11 aa, Influenza virus
NNTTLIENTYV

SEQ ID NO: 533555 - protein, 11 aa, Influenza virus
NNTTNYYNETF

SEQ ID NO: 533556 - protein, 11 aa, Influenza virus
NNTTVVENTYV

SEQ ID NO: 533557 - protein, 11 aa, Influenza virus
NNTVINNITTT

SEQ ID NO: 533558 - protein, 11 aa, Influenza virus
NNTVKDRSPYR

SEQ ID NO: 533559 - protein, 11 aa, Influenza virus
NNTVVNNITTT

SEQ ID NO: 533560 - protein, 11 aa, Influenza virus
NNTWLGRTISP

SEQ ID NO: 533561 - protein, 11 aa, Influenza virus
NNTYDHAQYRE

SEQ ID NO: 533562 - protein, 11 aa, Influenza virus
NNTYDHSHYRE

SEQ ID NO: 533563 - protein, 11 aa, Influenza virus
NNTYDHSQYRE

SEQ ID NO: 533564 - protein, 11 aa, Influenza virus
NNTYDHTQYRE

SEQ ID NO: 533565 - protein, 11 aa, Influenza virus
NNTYNHTEYRQ

SEQ ID NO: 533566 - protein, 11 aa, Influenza virus
NNTYNHTQYRE

SEQ ID NO: 533567 - protein, 11 aa, Influenza virus
NNVIDKMNKQF

SEQ ID NO: 533568 - protein, 11 aa, Influenza virus
NNVIDKMNKQL

SEQ ID NO: 533569 - protein, 11 aa, Influenza virus
NNVIDKMNNQF

SEQ ID NO: 533570 - protein, 11 aa, Influenza virus
NNVIDKMYKQF

SEQ ID NO: 533571 - protein, 11 aa, Influenza virus
NNVTVTSSVEL

SEQ ID NO: 533572 - protein, 11 aa, Influenza virus
NNWFGYFGIFF

SEQ ID NO: 533573 - protein, 11 aa, Influenza virus
NNWSGYSGIFS

SEQ ID NO: 533574 - protein, 11 aa, Influenza virus
NNWSGYSGSFI

SEQ ID NO: 533575 - protein, 11 aa, Influenza virus
NNWSGYSGSFS

SEQ ID NO: 533576 - protein, 11 aa, Influenza virus
NNYGVKGFGFR

SEQ ID NO: 533577 - protein, 11 aa, Influenza virus
NPAHKSQLIWM

SEQ ID NO: 533578 - protein, 11 aa, Influenza virus
NPAHKSQLVWM

SEQ ID NO: 533579 - protein, 11 aa, Influenza virus
NPALRMKWMMA

SEQ ID NO: 533580 - protein, 11 aa, Influenza virus
NPCFYVELIRG

SEQ ID NO: 533581 - protein, 11 aa, Influenza virus
NPDPGVKGFAF

SEQ ID NO: 533582 - protein, 11 aa, Influenza virus
NPEAYNFNEGS

SEQ ID NO: 533583 - protein, 11 aa, Influenza virus
NPGDSIIFNSI

SEQ ID NO: 533584 - protein, 11 aa, Influenza virus
NPGNAEIEDLI

SEQ ID NO: 533585 - protein, 11 aa, Influenza virus
NPGNAEIEDLT

SEQ ID NO: 533586 - protein, 11 aa, Influenza virus
NPGVKGWAFDN

SEQ ID NO: 533587 - protein, 11 aa, Influenza virus
NPGVKGWAFDS

SEQ ID NO: 533588 - protein, 11 aa, Influenza virus
NPGVKGWAFDY

SEQ ID NO: 533589 - protein, 11 aa, Influenza virus
NPIICLGHHAV

SEQ ID NO: 533590 - protein, 11 aa, Influenza virus
NPITGSPCAPG

SEQ ID NO: 533591 - protein, 11 aa, Influenza virus
NPITGSPGAPG

SEQ ID NO: 533592 - protein, 11 aa, Influenza virus
NPITGSPGSPG

SEQ ID NO: 533593 - protein, 11 aa, Influenza virus
NPITGSPGVPG

SEQ ID NO: 533594 - protein, 11 aa, Influenza virus
NPITGSPSAPG

SEQ ID NO: 533595 - protein, 11 aa, Influenza virus
NPKCDIHLKDQ

SEQ ID NO: 533596 - protein, 11 aa, Influenza virus
NPKCDIHLRDQ

SEQ ID NO: 533597 - protein, 11 aa, Influenza virus
NPKCDLYLNGR

SEQ ID NO: 533598 - protein, 11 aa, Influenza virus
NPKCDLYLSGR

SEQ ID NO: 533599 - protein, 11 aa, Influenza virus
NPKCDPYLNGR

SEQ ID NO: 533600 - protein, 11 aa, Influenza virus
NPKCDTHLKDQ

SEQ ID NO: 533601 - protein, 11 aa, Influenza virus
NPKCDVHLKDQ

SEQ ID NO: 533602 - protein, 11 aa, Influenza virus
NPKSKLFTLSG

SEQ ID NO: 533603 - protein, 11 aa, Influenza virus
NPLIKHENRMV

SEQ ID NO: 533604 - protein, 11 aa, Influenza virus
NPLIRHENRMV

SEQ ID NO: 533605 - protein, 11 aa, Influenza virus
NPMHQLLRHFQ

SEQ ID NO: 533606 - protein, 11 aa, Influenza virus
NPNQKIICISA

SEQ ID NO: 533607 - protein, 11 aa, Influenza virus
NPNQKIICIST

SEQ ID NO: 533608 - protein, 11 aa, Influenza virus
NPNQKIITIDS

SEQ ID NO: 533609 - protein, 11 aa, Influenza virus
NPNQKIITIGS

SEQ ID NO: 533610 - protein, 11 aa, Influenza virus
NPNQKIITMGS

SEQ ID NO: 533611 - protein, 11 aa, Influenza virus
NPNQKILCASA

SEQ ID NO: 533612 - protein, 11 aa, Influenza virus
NPNQKILCTSA

SEQ ID NO: 533613 - protein, 11 aa, Influenza virus
NPNQKILFASA

SEQ ID NO: 533614 - protein, 11 aa, Influenza virus
NPNQKIMCISA

SEQ ID NO: 533615 - protein, 11 aa, Influenza virus
NPNQKITCISA

SEQ ID NO: 533616 - protein, 11 aa, Influenza virus
NPNQKLFALSE

SEQ ID NO: 533617 - protein, 11 aa, Influenza virus
NPNQKLFALSG

SEQ ID NO: 533618 - protein, 11 aa, Influenza virus
NPNQKLFASSG

SEQ ID NO: 533619 - protein, 11 aa, Influenza virus
NPNQKLFTLSG

SEQ ID NO: 533620 - protein, 11 aa, Influenza virus
NPNQKTITIGS

SEQ ID NO: 533621 - protein, 11 aa, Influenza virus
NPNQMIITIGS

SEQ ID NO: 533622 - protein, 11 aa, Influenza virus
NPNQRILCTSA

SEQ ID NO: 533623 - protein, 11 aa, Influenza virus
NPNQSIITIGS

SEQ ID NO: 533624 - protein, 11 aa, Influenza virus
NPNWSGYSGAF

SEQ ID NO: 533625 - protein, 11 aa, Influenza virus
NPNWSGYSGSF

SEQ ID NO: 533626 - protein, 11 aa, Influenza virus
NPRIFLAMITY

SEQ ID NO: 533627 - protein, 11 aa, Influenza virus
NPRMFLAMITY

SEQ ID NO: 533628 - protein, 11 aa, Influenza virus
NPRVFLAMITY

SEQ ID NO: 533629 - protein, 11 aa, Influenza virus
NPRVFLTMITY

SEQ ID NO: 533630 - protein, 11 aa, Influenza virus
NPSAGKDPKKT

SEQ ID NO: 533631 - protein, 11 aa, Influenza virus
NPSCASNINIR

SEQ ID NO: 533632 - protein, 11 aa, Influenza virus
NPSCATNINIR

SEQ ID NO: 533633 - protein, 11 aa, Influenza virus
NPSHEGEGIPL

SEQ ID NO: 533634 - protein, 11 aa, Influenza virus
NPSLRMKWMMA

SEQ ID NO: 533635 - protein, 11 aa, Influenza virus
NPSQKLFALSG

SEQ ID NO: 533636 - protein, 11 aa, Influenza virus
NPTEEQAVDIC

SEQ ID NO: 533637 - protein, 11 aa, Influenza virus
NPTEEQAVEIC

SEQ ID NO: 533638 - protein, 11 aa, Influenza virus
NPTEEQAVGIC

SEQ ID NO: 533639 - protein, 11 aa, Influenza virus
NPTEEQAVNIC

SEQ ID NO: 533640 - protein, 11 aa, Influenza virus
NPVHKSQLIWM

SEQ ID NO: 533641 - protein, 11 aa, Influenza virus
NPVHKSQLVWM

SEQ ID NO: 533642 - protein, 11 aa, Influenza virus
NPVICLGHHAV

SEQ ID NO: 533643 - protein, 11 aa, Influenza virus
NPVICLGHHSV

SEQ ID NO: 533644 - protein, 11 aa, Influenza virus
NPVICMGHHAV

SEQ ID NO: 533645 - protein, 11 aa, Influenza virus
NPVKLSGGYKD

SEQ ID NO: 533646 - protein, 11 aa, Influenza virus
NPVKLSSGYKD

SEQ ID NO: 533647 - protein, 11 aa, Influenza virus
NPVRLSSGYKD

SEQ ID NO: 533648 - protein, 11 aa, Influenza virus
NPVTLSSGYKD

SEQ ID NO: 533649 - protein, 11 aa, Influenza virus
NPVTLTMGYKD

SEQ ID NO: 533650 - protein, 11 aa, Influenza virus
NPYTLVSTKEW

SEQ ID NO: 533651 - protein, 11 aa, Influenza virus
NQCMESIRNNT

SEQ ID NO: 533652 - protein, 11 aa, Influenza virus
NQDSFYRSMKW

SEQ ID NO: 533653 - protein, 11 aa, Influenza virus
NQDWSGYSGAF

SEQ ID NO: 533654 - protein, 11 aa, Influenza virus
NQEELKSLFSS

SEQ ID NO: 533655 - protein, 11 aa, Influenza virus
NQEELRFLFSS

SEQ ID NO: 533656 - protein, 11 aa, Influenza virus
NQEELRSLFSS

SEQ ID NO: 533657 - protein, 11 aa, Influenza virus
NQEYTSGRQEK

SEQ ID NO: 533658 - protein, 11 aa, Influenza virus
NQFALGQGTTL

SEQ ID NO: 533659 - protein, 11 aa, Influenza virus
NQGSFYRNMRW

SEQ ID NO: 533660 - protein, 11 aa, Influenza virus
NQGSFYRSIRW

SEQ ID NO: 533661 - protein, 11 aa, Influenza virus
NQGSFYRSMRW

SEQ ID NO: 533662 - protein, 11 aa, Influenza virus
NQHIIDLADSE

SEQ ID NO: 533663 - protein, 11 aa, Influenza virus
NQHTIDLADSE

SEQ ID NO: 533664 - protein, 11 aa, Influenza virus
NQHTIDLAESE

SEQ ID NO: 533665 - protein, 11 aa, Influenza virus
NQHTIDLTDAE

SEQ ID NO: 533666 - protein, 11 aa, Influenza virus
NQHTIDLTDSE

SEQ ID NO: 533667 - protein, 11 aa, Influenza virus
NQHTIDMADSE

SEQ ID NO: 533668 - protein, 11 aa, Influenza virus
NQHTIDMADST

SEQ ID NO: 533669 - protein, 11 aa, Influenza virus
NQHTIDMTDSE

SEQ ID NO: 533670 - protein, 11 aa, Influenza virus
NQHTIDSTDSE

SEQ ID NO: 533671 - protein, 11 aa, Influenza virus
NQHTIDVADSE

SEQ ID NO: 533672 - protein, 11 aa, Influenza virus
NQHTIDVTDSE

SEQ ID NO: 533673 - protein, 11 aa, Influenza virus
NQHTIEMTDSE

SEQ ID NO: 533674 - protein, 11 aa, Influenza virus
NQHTIHLTDSE

SEQ ID NO: 533675 - protein, 11 aa, Influenza virus
NQITGKLNRII

SEQ ID NO: 533676 - protein, 11 aa, Influenza virus
NQITGKLNRLI

SEQ ID NO: 533677 - protein, 11 aa, Influenza virus
NQKIITIGFVS

SEQ ID NO: 533678 - protein, 11 aa, Influenza virus
NQKIITIGSAS

SEQ ID NO: 533679 - protein, 11 aa, Influenza virus
NQKIITIGSIS

SEQ ID NO: 533680 - protein, 11 aa, Influenza virus
NQKIITIGSVS

SEQ ID NO: 533681 - protein, 11 aa, Influenza virus
NQKIITMGSVS

SEQ ID NO: 533682 - protein, 11 aa, Influenza virus
NQKILCASATA

SEQ ID NO: 533683 - protein, 11 aa, Influenza virus
NQKILCTSAIA

SEQ ID NO: 533684 - protein, 11 aa, Influenza virus
NQKILCTSATA

SEQ ID NO: 533685 - protein, 11 aa, Influenza virus
NQKILDEHDSN

SEQ ID NO: 533686 - protein, 11 aa, Influenza virus
NQKILFASATA

SEQ ID NO: 533687 - protein, 11 aa, Influenza virus
NQKIMTIGSVS

SEQ ID NO: 533688 - protein, 11 aa, Influenza virus
NQKLFALSGVA

SEQ ID NO: 533689 - protein, 11 aa, Influenza virus
NQKLFASSGIA

SEQ ID NO: 533690 - protein, 11 aa, Influenza virus
NQKLFTLSGVA

SEQ ID NO: 533691 - protein, 11 aa, Influenza virus
NQKTITIGSVS

SEQ ID NO: 533692 - protein, 11 aa, Influenza virus
NQKTLDEHDAN

SEQ ID NO: 533693 - protein, 11 aa, Influenza virus
NQKTLDEHDSN

SEQ ID NO: 533694 - protein, 11 aa, Influenza virus
NQKTLDKHDSN

SEQ ID NO: 533695 - protein, 11 aa, Influenza virus
NQNNTTVVENK

SEQ ID NO: 533696 - protein, 11 aa, Influenza virus
NQNNTTVVENT

SEQ ID NO: 533697 - protein, 11 aa, Influenza virus
NQNPRIFLAMI

SEQ ID NO: 533698 - protein, 11 aa, Influenza virus
NQNPRMFLAMI

SEQ ID NO: 533699 - protein, 11 aa, Influenza virus
NQNPRVFLAMI

SEQ ID NO: 533700 - protein, 11 aa, Influenza virus
NQNPRVFLTMI

SEQ ID NO: 533701 - protein, 11 aa, Influenza virus
NQNQNPRMFLA

SEQ ID NO: 533702 - protein, 11 aa, Influenza virus
NQNSTWVSQTY

SEQ ID NO: 533703 - protein, 11 aa, Influenza virus
NQNTIDLTDSE

SEQ ID NO: 533704 - protein, 11 aa, Influenza virus
NQNWSGYSGAF

SEQ ID NO: 533705 - protein, 11 aa, Influenza virus
NQNWSGYSGSF

SEQ ID NO: 533706 - protein, 11 aa, Influenza virus
NQPAATALANT

SEQ ID NO: 533707 - protein, 11 aa, Influenza virus
NQQFELIDNEF

SEQ ID NO: 533708 - protein, 11 aa, Influenza virus
NQQFELIDNKF

SEQ ID NO: 533709 - protein, 11 aa, Influenza virus
NQQFELIDSEF

SEQ ID NO: 533710 - protein, 11 aa, Influenza virus
NQQFELIGNEF

SEQ ID NO: 533711 - protein, 11 aa, Influenza virus
NQQFELINNEF

SEQ ID NO: 533712 - protein, 11 aa, Influenza virus
NQQFEMIDNEF

SEQ ID NO: 533713 - protein, 11 aa, Influenza virus
NQQFGLIDNEF

SEQ ID NO: 533714 - protein, 11 aa, Influenza virus
NQQFKLIDNEF

SEQ ID NO: 533715 - protein, 11 aa, Influenza virus
NQRGILEDEQM

SEQ ID NO: 533716 - protein, 11 aa, Influenza virus
NQRLNPMHQLL

SEQ ID NO: 533717 - protein, 11 aa, Influenza virus
NQRLNTMHQLL

SEQ ID NO: 533718 - protein, 11 aa, Influenza virus
NQSGRISIYWT

SEQ ID NO: 533719 - protein, 11 aa, Influenza virus
NQSPRMFLAMI

SEQ ID NO: 533720 - protein, 11 aa, Influenza virus
NQTKKMTITFL

SEQ ID NO: 533721 - protein, 11 aa, Influenza virus
NQTKTMTITFL

SEQ ID NO: 533722 - protein, 11 aa, Influenza virus
NQTLVSNNDWS

SEQ ID NO: 533723 - protein, 11 aa, Influenza virus
NQTYRNNRKEP

SEQ ID NO: 533724 - protein, 11 aa, Influenza virus
NQTYRNTRKEP

SEQ ID NO: 533725 - protein, 11 aa, Influenza virus
NQVEKRINMIA

SEQ ID NO: 533726 - protein, 11 aa, Influenza virus
NQVEKRINMLA

SEQ ID NO: 533727 - protein, 11 aa, Influenza virus
NQVENRINMLA

SEQ ID NO: 533728 - protein, 11 aa, Influenza virus
NQVEQRINMLA

SEQ ID NO: 533729 - protein, 11 aa, Influenza virus
NQVFPQLNQTY

SEQ ID NO: 533730 - protein, 11 aa, Influenza virus
NRANQRLNPMH

SEQ ID NO: 533731 - protein, 11 aa, Influenza virus
NRANQRLNTMH

SEQ ID NO: 533732 - protein, 11 aa, Influenza virus
NRCFYVELIRG

SEQ ID NO: 533733 - protein, 11 aa, Influenza virus
NRCFYVELVRG

SEQ ID NO: 533734 - protein, 11 aa, Influenza virus
NRCYQFALGQG

SEQ ID NO: 533735 - protein, 11 aa, Influenza virus
NRDITIGSICM

SEQ ID NO: 533736 - protein, 11 aa, Influenza virus
NREFEVMNHEF

SEQ ID NO: 533737 - protein, 11 aa, Influenza virus
NREFEVVDHEF

SEQ ID NO: 533738 - protein, 11 aa, Influenza virus
NREFEVVNHEF

SEQ ID NO: 533739 - protein, 11 aa, Influenza virus
NREFGVVNHEF

SEQ ID NO: 533740 - protein, 11 aa, Influenza virus
NRFIEKTNQQF

SEQ ID NO: 533741 - protein, 11 aa, Influenza virus
NRFYRTCKLLG

SEQ ID NO: 533742 - protein, 11 aa, Influenza virus
NRFYRTCKLVG

SEQ ID NO: 533743 - protein, 11 aa, Influenza virus
NRGLFGAIAGF

SEQ ID NO: 533744 - protein, 11 aa, Influenza virus
NRGLFGAKAGF

SEQ ID NO: 533745 - protein, 11 aa, Influenza virus
NRGSFYRSMRW

SEQ ID NO: 533746 - protein, 11 aa, Influenza virus
NRHSNGTIHDR

SEQ ID NO: 533747 - protein, 11 aa, Influenza virus
NRIFQPNIGPR

SEQ ID NO: 533748 - protein, 11 aa, Influenza virus
NRIFRPNIGPR

SEQ ID NO: 533749 - protein, 11 aa, Influenza virus
NRIIEKTNQQF

SEQ ID NO: 533750 - protein, 11 aa, Influenza virus
NRIKINPVTLT

SEQ ID NO: 533751 - protein, 11 aa, Influenza virus
NRIMINPVKLS

SEQ ID NO: 533752 - protein, 11 aa, Influenza virus
NRINMLADRID

SEQ ID NO: 533753 - protein, 11 aa, Influenza virus
NRIQIDPVKLS

SEQ ID NO: 533754 - protein, 11 aa, Influenza virus
NRIQIDQVKLS

SEQ ID NO: 533755 - protein, 11 aa, Influenza virus
NRIQIDSVKLS

SEQ ID NO: 533756 - protein, 11 aa, Influenza virus
NRKEPALIVWG

SEQ ID NO: 533757 - protein, 11 aa, Influenza virus
NRKEYEEEAKL

SEQ ID NO: 533758 - protein, 11 aa, Influenza virus
NRKMEDGFLDV

SEQ ID NO: 533759 - protein, 11 aa, Influenza virus
NRLIDKTNQQF

SEQ ID NO: 533760 - protein, 11 aa, Influenza virus
NRLIDRTNHQF

SEQ ID NO: 533761 - protein, 11 aa, Influenza virus
NRLIEKTNDKY

SEQ ID NO: 533762 - protein, 11 aa, Influenza virus
NRLIEKTNEKY

SEQ ID NO: 533763 - protein, 11 aa, Influenza virus
NRLIEKTNKQF

SEQ ID NO: 533764 - protein, 11 aa, Influenza virus
NRLIEKTNQQF

SEQ ID NO: 533765 - protein, 11 aa, Influenza virus
NRLIEKTNTEF

SEQ ID NO: 533766 - protein, 11 aa, Influenza virus
NRLIEKTNTQF

SEQ ID NO: 533767 - protein, 11 aa, Influenza virus
NRLIERTNEKY

SEQ ID NO: 533768 - protein, 11 aa, Influenza virus
NRLIERTNQQF

SEQ ID NO: 533769 - protein, 11 aa, Influenza virus
NRLIGKTNQQF

SEQ ID NO: 533770 - protein, 11 aa, Influenza virus
NRLISKTNQQF

SEQ ID NO: 533771 - protein, 11 aa, Influenza virus
NRLNINPVKLS

SEQ ID NO: 533772 - protein, 11 aa, Influenza virus
NRLNINPVTLS

SEQ ID NO: 533773 - protein, 11 aa, Influenza virus
NRLNINSVKLS

SEQ ID NO: 533774 - protein, 11 aa, Influenza virus
NRLNNVIDKMN

SEQ ID NO: 533775 - protein, 11 aa, Influenza virus
NRLSINPVKLS

SEQ ID NO: 533776 - protein, 11 aa, Influenza virus
NRMVIASTTAK

SEQ ID NO: 533777 - protein, 11 aa, Influenza virus
NRMVLASTTAK

SEQ ID NO: 533778 - protein, 11 aa, Influenza virus
NRNEIKGVKLS

SEQ ID NO: 533779 - protein, 11 aa, Influenza virus
NRNFKPNIGPR

SEQ ID NO: 533780 - protein, 11 aa, Influenza virus
NRNFQPNIGPR

SEQ ID NO: 533781 - protein, 11 aa, Influenza virus
NRNQPAATALA

SEQ ID NO: 533782 - protein, 11 aa, Influenza virus
NRNWSGYSGSF

SEQ ID NO: 533783 - protein, 11 aa, Influenza virus
NRPWIRFNSDL

SEQ ID NO: 533784 - protein, 11 aa, Influenza virus
NRPWIRFNSDP

SEQ ID NO: 533785 - protein, 11 aa, Influenza virus
NRPWIRFNSNL

SEQ ID NO: 533786 - protein, 11 aa, Influenza virus
NRPWIRINNET

SEQ ID NO: 533787 - protein, 11 aa, Influenza virus
NRPWISFDQNL

SEQ ID NO: 533788 - protein, 11 aa, Influenza virus
NRPWMRINNET

SEQ ID NO: 533789 - protein, 11 aa, Influenza virus
NRPWMRISNET

SEQ ID NO: 533790 - protein, 11 aa, Influenza virus
NRPWVRINNET

SEQ ID NO: 533791 - protein, 11 aa, Influenza virus
NRPWVRMNNET

SEQ ID NO: 533792 - protein, 11 aa, Influenza virus
NRPWVSFDQNL

SEQ ID NO: 533793 - protein, 11 aa, Influenza virus
NRPWVSFNHNL

SEQ ID NO: 533794 - protein, 11 aa, Influenza virus
NRPWVSFNQDL

SEQ ID NO: 533795 - protein, 11 aa, Influenza virus
NRPWVSFNQNL

SEQ ID NO: 533796 - protein, 11 aa, Influenza virus
NRQEIEGARLD

SEQ ID NO: 533797 - protein, 11 aa, Influenza virus
NRQEIEGVKLD

SEQ ID NO: 533798 - protein, 11 aa, Influenza virus
NRQEIEGVKLN

SEQ ID NO: 533799 - protein, 11 aa, Influenza virus
NRQEIEGVRLD

SEQ ID NO: 533800 - protein, 11 aa, Influenza virus
NRQEIGGVKLD

SEQ ID NO: 533801 - protein, 11 aa, Influenza virus
NRRLTTTIKPW

SEQ ID NO: 533802 - protein, 11 aa, Influenza virus
NRRLTTTIKTW

SEQ ID NO: 533803 - protein, 11 aa, Influenza virus
NRSFKPNIGPR

SEQ ID NO: 533804 - protein, 11 aa, Influenza virus
NRSFQPNIGPR

SEQ ID NO: 533805 - protein, 11 aa, Influenza virus
NRSFRPNIGPR

SEQ ID NO: 533806 - protein, 11 aa, Influenza virus
NRSGYSGIFSV

SEQ ID NO: 533807 - protein, 11 aa, Influenza virus
NRSGYSGSFID

SEQ ID NO: 533808 - protein, 11 aa, Influenza virus
NRSILNTSQRG

SEQ ID NO: 533809 - protein, 11 aa, Influenza virus
NRSPYRALMSC

SEQ ID NO: 533810 - protein, 11 aa, Influenza virus
NRTFQNIDKNA

SEQ ID NO: 533811 - protein, 11 aa, Influenza virus
NRTFQNIDRNA

SEQ ID NO: 533812 - protein, 11 aa, Influenza virus
NRTFQNVSPLW

SEQ ID NO: 533813 - protein, 11 aa, Influenza virus
NRTGTFEFTSF

SEQ ID NO: 533814 - protein, 11 aa, Influenza virus
NRTHQYSEKGK

SEQ ID NO: 533815 - protein, 11 aa, Influenza virus
NRTHQYSEKGR

SEQ ID NO: 533816 - protein, 11 aa, Influenza virus
NRTHQYSERGK

SEQ ID NO: 533817 - protein, 11 aa, Influenza virus
NRTHQYSERGR

SEQ ID NO: 533818 - protein, 11 aa, Influenza virus
NRYLEEHPSAG

SEQ ID NO: 533819 - protein, 11 aa, Influenza virus
NRYLEENPSAG

SEQ ID NO: 533820 - protein, 11 aa, Influenza virus
NSADHRIYWIR

SEQ ID NO: 533821 - protein, 11 aa, Influenza virus
NSADHRVYWIR

SEQ ID NO: 533822 - protein, 11 aa, Influenza virus
NSAHHRVYWIR

SEQ ID NO: 533823 - protein, 11 aa, Influenza virus
NSALGSPGCDH

SEQ ID NO: 533824 - protein, 11 aa, Influenza virus
NSCIESIRNGT

SEQ ID NO: 533825 - protein, 11 aa, Influenza virus
NSCMETIRNGT

SEQ ID NO: 533826 - protein, 11 aa, Influenza virus
NSDFICVGWSS

SEQ ID NO: 533827 - protein, 11 aa, Influenza virus
NSDFLCVGWSS

SEQ ID NO: 533828 - protein, 11 aa, Influenza virus
NSDFMCVGWSS

SEQ ID NO: 533829 - protein, 11 aa, Influenza virus
NSDLDYQIGYI

SEQ ID NO: 533830 - protein, 11 aa, Influenza virus
NSDLDYQIGYV

SEQ ID NO: 533831 - protein, 11 aa, Influenza virus
NSDLEALMEWL

SEQ ID NO: 533832 - protein, 11 aa, Influenza virus
NSDLNYQIGYI

SEQ ID NO: 533833 - protein, 11 aa, Influenza virus
NSDVLVTREPY

SEQ ID NO: 533834 - protein, 11 aa, Influenza virus
NSDWSGYSGSF

SEQ ID NO: 533835 - protein, 11 aa, Influenza virus
NSEFICVGWSS

SEQ ID NO: 533836 - protein, 11 aa, Influenza virus
NSEFLCVGWSS

SEQ ID NO: 533837 - protein, 11 aa, Influenza virus
NSEGIGQAADL

SEQ ID NO: 533838 - protein, 11 aa, Influenza virus
NSEGMGQAADL

SEQ ID NO: 533839 - protein, 11 aa, Influenza virus
NSEGRGQAADL

SEQ ID NO: 533840 - protein, 11 aa, Influenza virus
NSEGTGIAADR

SEQ ID NO: 533841 - protein, 11 aa, Influenza virus
NSEGTGIVADR

SEQ ID NO: 533842 - protein, 11 aa, Influenza virus
NSEGTGMAADQ

SEQ ID NO: 533843 - protein, 11 aa, Influenza virus
NSEGTGQAADL

SEQ ID NO: 533844 - protein, 11 aa, Influenza virus
NSEGTGQAGDL

SEQ ID NO: 533845 - protein, 11 aa, Influenza virus
NSEGTGTAADL

SEQ ID NO: 533846 - protein, 11 aa, Influenza virus
NSEMNKLYERV

SEQ ID NO: 533847 - protein, 11 aa, Influenza virus
NSFEQITFIQA

SEQ ID NO: 533848 - protein, 11 aa, Influenza virus
NSFEQITFLQA

SEQ ID NO: 533849 - protein, 11 aa, Influenza virus
NSFEQITFMQA

SEQ ID NO: 533850 - protein, 11 aa, Influenza virus
NSFFSRLNWLT

SEQ ID NO: 533851 - protein, 11 aa, Influenza virus
NSFLAHALKLV

SEQ ID NO: 533852 - protein, 11 aa, Influenza virus
NSFLTHALRFL

SEQ ID NO: 533853 - protein, 11 aa, Influenza virus
NSFSRTELINP

SEQ ID NO: 533854 - protein, 11 aa, Influenza virus
NSFSRTELIPP

SEQ ID NO: 533855 - protein, 11 aa, Influenza virus
NSFSRTELISP

SEQ ID NO: 533856 - protein, 11 aa, Influenza virus
NSFVPVVGARP

SEQ ID NO: 533857 - protein, 11 aa, Influenza virus
NSFYAELKWLI

SEQ ID NO: 533858 - protein, 11 aa, Influenza virus
NSFYAELKWLV

SEQ ID NO: 533859 - protein, 11 aa, Influenza virus
NSGDYARLYIW

SEQ ID NO: 533860 - protein, 11 aa, Influenza virus
NSGKVECVCRD

SEQ ID NO: 533861 - protein, 11 aa, Influenza virus
NSGYKDIILWF

SEQ ID NO: 533862 - protein, 11 aa, Influenza virus
NSHYEECSCYP

SEQ ID NO: 533863 - protein, 11 aa, Influenza virus
NSIAVFCGTSG

SEQ ID NO: 533864 - protein, 11 aa, Influenza virus
NSIGNLIAPRG

SEQ ID NO: 533865 - protein, 11 aa, Influenza virus
NSIIDKMNTQF

SEQ ID NO: 533866 - protein, 11 aa, Influenza virus
NSIIEKMNIQF

SEQ ID NO: 533867 - protein, 11 aa, Influenza virus
NSIIEKMNTQF

SEQ ID NO: 533868 - protein, 11 aa, Influenza virus
NSIIGKMNTQF

SEQ ID NO: 533869 - protein, 11 aa, Influenza virus
NSIINKMNTQF

SEQ ID NO: 533870 - protein, 11 aa, Influenza virus
NSIISMCSSTE

SEQ ID NO: 533871 - protein, 11 aa, Influenza virus
NSIIVFCGTSG

SEQ ID NO: 533872 - protein, 11 aa, Influenza virus
NSIRIGSKGDI

SEQ ID NO: 533873 - protein, 11 aa, Influenza virus
NSIRIGSKGDV

SEQ ID NO: 533874 - protein, 11 aa, Influenza virus
NSIRIGSRGDV

SEQ ID NO: 533875 - protein, 11 aa, Influenza virus
NSIRLAAGGAI

SEQ ID NO: 533876 - protein, 11 aa, Influenza virus
NSIRLAAGGDI

SEQ ID NO: 533877 - protein, 11 aa, Influenza virus
NSIRLSADGDI

SEQ ID NO: 533878 - protein, 11 aa, Influenza virus
NSIRLSAGGAI

SEQ ID NO: 533879 - protein, 11 aa, Influenza virus
NSIRLSAGGAV

SEQ ID NO: 533880 - protein, 11 aa, Influenza virus
NSIRLSAGGDI

SEQ ID NO: 533881 - protein, 11 aa, Influenza virus
NSIRLSAGGHI

SEQ ID NO: 533882 - protein, 11 aa, Influenza virus
NSIRLSAGGNI

SEQ ID NO: 533883 - protein, 11 aa, Influenza virus
NSIRLSASGDI

SEQ ID NO: 533884 - protein, 11 aa, Influenza virus
NSIRVSAGGDI

SEQ ID NO: 533885 - protein, 11 aa, Influenza virus
NSIVAFCGTSG

SEQ ID NO: 533886 - protein, 11 aa, Influenza virus
NSIVALCGSKE

SEQ ID NO: 533887 - protein, 11 aa, Influenza virus
NSIVALCGSKK

SEQ ID NO: 533888 - protein, 11 aa, Influenza virus
NSIVALCGSRE

SEQ ID NO: 533889 - protein, 11 aa, Influenza virus
NSIVSMCSSTE

SEQ ID NO: 533890 - protein, 11 aa, Influenza virus
NSIVTFCGLBN

SEQ ID NO: 533891 - protein, 11 aa, Influenza virus
NSIVTFCGLDN

SEQ ID NO: 533892 - protein, 11 aa, Influenza virus
NSIVTFCGLNN

SEQ ID NO: 533893 - protein, 11 aa, Influenza virus
NSIVVFCGASG

SEQ ID NO: 533894 - protein, 11 aa, Influenza virus
NSIVVFCGTPG

SEQ ID NO: 533895 - protein, 11 aa, Influenza virus
NSIVVFCGTSA

SEQ ID NO: 533896 - protein, 11 aa, Influenza virus
NSIVVFCGTSG

SEQ ID NO: 533897 - protein, 11 aa, Influenza virus
NSIVVFWGTSG

SEQ ID NO: 533898 - protein, 11 aa, Influenza virus
NSIWTSSSSTV

SEQ ID NO: 533899 - protein, 11 aa, Influenza virus
NSIYASPQLEG

SEQ ID NO: 533900 - protein, 11 aa, Influenza virus
NSKFESVAWSA

SEQ ID NO: 533901 - protein, 11 aa, Influenza virus
NSLIALCGSPF

SEQ ID NO: 533902 - protein, 11 aa, Influenza virus
NSLIALCGSPI

SEQ ID NO: 533903 - protein, 11 aa, Influenza virus
NSLIALCGSPV

SEQ ID NO: 533904 - protein, 11 aa, Influenza virus
NSLKLAIGLRN

SEQ ID NO: 533905 - protein, 11 aa, Influenza virus
NSLVALCGSPI

SEQ ID NO: 533906 - protein, 11 aa, Influenza virus
NSLVALCGSPV

SEQ ID NO: 533907 - protein, 11 aa, Influenza virus
NSLYASPQLEG

SEQ ID NO: 533908 - protein, 11 aa, Influenza virus
NSLYASSQLEG

SEQ ID NO: 533909 - protein, 11 aa, Influenza virus
NSLYSSPQLEG

SEQ ID NO: 533910 - protein, 11 aa, Influenza virus
NSMVTFCGLDN

SEQ ID NO: 533911 - protein, 11 aa, Influenza virus
NSNAITRSGQN

SEQ ID NO: 533912 - protein, 11 aa, Influenza virus
NSNGVQDIIDN

SEQ ID NO: 533913 - protein, 11 aa, Influenza virus
NSNLDYQIGYV

SEQ ID NO: 533914 - protein, 11 aa, Influenza virus
NSNNGVKGFSY

SEQ ID NO: 533915 - protein, 11 aa, Influenza virus
NSNWSGYSGIF

SEQ ID NO: 533916 - protein, 11 aa, Influenza virus
NSNWSGYSGSF

SEQ ID NO: 533917 - protein, 11 aa, Influenza virus
NSPLPFQNIDS

SEQ ID NO: 533918 - protein, 11 aa, Influenza virus
NSQASYKIFKS

SEQ ID NO: 533919 - protein, 11 aa, Influenza virus
NSQGEGTAADY

SEQ ID NO: 533920 - protein, 11 aa, Influenza virus
NSQGSGYAADK

SEQ ID NO: 533921 - protein, 11 aa, Influenza virus
NSQGSGYAADR

SEQ ID NO: 533922 - protein, 11 aa, Influenza virus
NSRFESVAWSA

SEQ ID NO: 533923 - protein, 11 aa, Influenza virus
NSSCAAMDDFQ

SEQ ID NO: 533924 - protein, 11 aa, Influenza virus
NSSDICYPGKF

SEQ ID NO: 533925 - protein, 11 aa, Influenza virus
NSSDICYPGRF

SEQ ID NO: 533926 - protein, 11 aa, Influenza virus
NSSDKVDTLLE

SEQ ID NO: 533927 - protein, 11 aa, Influenza virus
NSSDTVDTLTE

SEQ ID NO: 533928 - protein, 11 aa, Influenza virus
NSSEKVDTLLE

SEQ ID NO: 533929 - protein, 11 aa, Influenza virus
NSSEKVNTLLE

SEQ ID NO: 533930 - protein, 11 aa, Influenza virus
NSSERVDTLLE

SEQ ID NO: 533931 - protein, 11 aa, Influenza virus
NSSILTDSQTA

SEQ ID NO: 533932 - protein, 11 aa, Influenza virus
NSSKPFQNASR

SEQ ID NO: 533933 - protein, 11 aa, Influenza virus
NSSKPFQNTSR

SEQ ID NO: 533934 - protein, 11 aa, Influenza virus
NSSKPLQNASR

SEQ ID NO: 533935 - protein, 11 aa, Influenza virus
NSSLTHALREL

SEQ ID NO: 533936 - protein, 11 aa, Influenza virus
NSSMPFHNIHP

SEQ ID NO: 533937 - protein, 11 aa, Influenza virus
NSSMPFHNVHP

SEQ ID NO: 533938 - protein, 11 aa, Influenza virus
NSSMPLHNIHP

SEQ ID NO: 533939 - protein, 11 aa, Influenza virus
NSSRPFQNASR

SEQ ID NO: 533940 - protein, 11 aa, Influenza virus
NSSYVCSGLVG

SEQ ID NO: 533941 - protein, 11 aa, Influenza virus
NSTCVVVMTDG

SEQ ID NO: 533942 - protein, 11 aa, Influenza virus
NSTDKIDTLTE

SEQ ID NO: 533943 - protein, 11 aa, Influenza virus
NSTDKVDTIIE

SEQ ID NO: 533944 - protein, 11 aa, Influenza virus
NSTDKVDTLTE

SEQ ID NO: 533945 - protein, 11 aa, Influenza virus
NSTDKVNTIIE

SEQ ID NO: 533946 - protein, 11 aa, Influenza virus
NSTDTVDTILE

SEQ ID NO: 533947 - protein, 11 aa, Influenza virus
NSTDTVDTLIE

SEQ ID NO: 533948 - protein, 11 aa, Influenza virus
NSTDTVDTLLE

SEQ ID NO: 533949 - protein, 11 aa, Influenza virus
NSTDTVDTLTE

SEQ ID NO: 533950 - protein, 11 aa, Influenza virus
NSTDTVDTVLE

SEQ ID NO: 533951 - protein, 11 aa, Influenza virus
NSTDTVDTVRE

SEQ ID NO: 533952 - protein, 11 aa, Influenza virus
NSTDTVNTLIE

SEQ ID NO: 533953 - protein, 11 aa, Influenza virus
NSTDTVNTLME

SEQ ID NO: 533954 - protein, 11 aa, Influenza virus
NSTDTVNTLTE

SEQ ID NO: 533955 - protein, 11 aa, Influenza virus
NSTEKVDTIIE

SEQ ID NO: 533956 - protein, 11 aa, Influenza virus
NSTEKVDTLLE

SEQ ID NO: 533957 - protein, 11 aa, Influenza virus
NSTERVDTIIE

SEQ ID NO: 533958 - protein, 11 aa, Influenza virus
NSTETVNTLIE

SEQ ID NO: 533959 - protein, 11 aa, Influenza virus
NSTETVNTLSE

SEQ ID NO: 533960 - protein, 11 aa, Influenza virus
NSTETVNTLTE

SEQ ID NO: 533961 - protein, 11 aa, Influenza virus
NSTNTVNTLIE

SEQ ID NO: 533962 - protein, 11 aa, Influenza virus
NSTTHDRTAFR

SEQ ID NO: 533963 - protein, 11 aa, Influenza virus
NSTVVNNITTT

SEQ ID NO: 533964 - protein, 11 aa, Influenza virus
NSTYKILSIYS

SEQ ID NO: 533965 - protein, 11 aa, Influenza virus
NSVIEKMNIQF

SEQ ID NO: 533966 - protein, 11 aa, Influenza virus
NSVIEKMNTQF

SEQ ID NO: 533967 - protein, 11 aa, Influenza virus
NSVKLSSGYKD

SEQ ID NO: 533968 - protein, 11 aa, Influenza virus
NSVRIGSKGDV

SEQ ID NO: 533969 - protein, 11 aa, Influenza virus
NSVRLSAGGDI

SEQ ID NO: 533970 - protein, 11 aa, Influenza virus
NSVRLSASGDI

SEQ ID NO: 533971 - protein, 11 aa, Influenza virus
NSVVEKMNTQF

SEQ ID NO: 533972 - protein, 11 aa, Influenza virus
NSVVVFCGTSG

SEQ ID NO: 533973 - protein, 11 aa, Influenza virus
NSWHIFGKDNA

SEQ ID NO: 533974 - protein, 11 aa, Influenza virus
NSWHIFSKDNA

SEQ ID NO: 533975 - protein, 11 aa, Influenza virus
NSWHILSKDNA

SEQ ID NO: 533976 - protein, 11 aa, Influenza virus
NSWHIYGKDNA

SEQ ID NO: 533977 - protein, 11 aa, Influenza virus
NSWLGRTISKD

SEQ ID NO: 533978 - protein, 11 aa, Influenza virus
NSWLGRTTSKD

SEQ ID NO: 533979 - protein, 11 aa, Influenza virus
NSWSGYSGIFS

SEQ ID NO: 533980 - protein, 11 aa, Influenza virus
NSWSYIVEKPN

SEQ ID NO: 533981 - protein, 11 aa, Influenza virus
NTALLNASCAA

SEQ ID NO: 533982 - protein, 11 aa, Influenza virus
NTALSTIALLI

SEQ ID NO: 533983 - protein, 11 aa, Influenza virus
NTAMLNASCAA

SEQ ID NO: 533984 - protein, 11 aa, Influenza virus
NTASRSGYEML

SEQ ID NO: 533985 - protein, 11 aa, Influenza virus
NTCIESIRNGT

SEQ ID NO: 533986 - protein, 11 aa, Influenza virus
NTCMETIRNGT

SEQ ID NO: 533987 - protein, 11 aa, Influenza virus
NTDLEALMEWI

SEQ ID NO: 533988 - protein, 11 aa, Influenza virus
NTDLEALMEWL

SEQ ID NO: 533989 - protein, 11 aa, Influenza virus
NTDLEVLMEWL

SEQ ID NO: 533990 - protein, 11 aa, Influenza virus
NTDLGAPLELR

SEQ ID NO: 533991 - protein, 11 aa, Influenza virus
NTDLGSPLELR

SEQ ID NO: 533992 - protein, 11 aa, Influenza virus
NTDLGTPLELR

SEQ ID NO: 533993 - protein, 11 aa, Influenza virus
NTDWSGYSGSF

SEQ ID NO: 533994 - protein, 11 aa, Influenza virus
NTEFESIESEF

SEQ ID NO: 533995 - protein, 11 aa, Influenza virus
NTELLVLMENE

SEQ ID NO: 533996 - protein, 11 aa, Influenza virus
NTEPLCDVSGF

SEQ ID NO: 533997 - protein, 11 aa, Influenza virus
NTEPLCEVSGF

SEQ ID NO: 533998 - protein, 11 aa, Influenza virus
NTEPLCNVSGF

SEQ ID NO: 533999 - protein, 11 aa, Influenza virus
NTFGDCPKYVN

SEQ ID NO: 534000 - protein, 11 aa, Influenza virus
NTGSYVRLYLW

SEQ ID NO: 534001 - protein, 11 aa, Influenza virus
NTIDLTDSEMN

SEQ ID NO: 534002 - protein, 11 aa, Influenza virus
NTIGDCPKYMN

SEQ ID NO: 534003 - protein, 11 aa, Influenza virus
NTIGDCPKYVN

SEQ ID NO: 534004 - protein, 11 aa, Influenza virus
NTIGNCPKYVN

SEQ ID NO: 534005 - protein, 11 aa, Influenza virus
NTIGNLIAPRG

SEQ ID NO: 534006 - protein, 11 aa, Influenza virus
NTIGNLVAPRG

SEQ ID NO: 534007 - protein, 11 aa, Influenza virus
NTIIENNVTVT

SEQ ID NO: 534008 - protein, 11 aa, Influenza virus
NTIIESNVTVT

SEQ ID NO: 534009 - protein, 11 aa, Influenza virus
NTILEKNVTVT

SEQ ID NO: 534010 - protein, 11 aa, Influenza virus
NTINRIFQPNI

SEQ ID NO: 534011 - protein, 11 aa, Influenza virus
NTINRNFQPNI

SEQ ID NO: 534012 - protein, 11 aa, Influenza virus
NTINRSFQPNI

SEQ ID NO: 534013 - protein, 11 aa, Influenza virus
NTINRSFRPNI

SEQ ID NO: 534014 - protein, 11 aa, Influenza virus
NTKCQTSLGGI

SEQ ID NO: 534015 - protein, 11 aa, Influenza virus
NTKCQTSLGGV

SEQ ID NO: 534016 - protein, 11 aa, Influenza virus
NTKCQTSMGGI

SEQ ID NO: 534017 - protein, 11 aa, Influenza virus
NTKCQTSMGGV

SEQ ID NO: 534018 - protein, 11 aa, Influenza virus
NTKCQTSVGGI

SEQ ID NO: 534019 - protein, 11 aa, Influenza virus
NTKLPFQNLSP

SEQ ID NO: 534020 - protein, 11 aa, Influenza virus
NTKWNENQNPR

SEQ ID NO: 534021 - protein, 11 aa, Influenza virus
NTLIEQNIPVT

SEQ ID NO: 534022 - protein, 11 aa, Influenza virus
NTLIEQNVPVT

SEQ ID NO: 534023 - protein, 11 aa, Influenza virus
NTLKLATGMRN

SEQ ID NO: 534024 - protein, 11 aa, Influenza virus
NTLLENDVPVT

SEQ ID NO: 534025 - protein, 11 aa, Influenza virus
NTLLKHRFEII

SEQ ID NO: 534026 - protein, 11 aa, Influenza virus
NTLSEQNVPVT

SEQ ID NO: 534027 - protein, 11 aa, Influenza virus
NTLSSVNTNTI

SEQ ID NO: 534028 - protein, 11 aa, Influenza virus
NTLSSVTTNTI

SEQ ID NO: 534029 - protein, 11 aa, Influenza virus
NTLTEKGIEVV

SEQ ID NO: 534030 - protein, 11 aa, Influenza virus
NTLTEKGVEVV

SEQ ID NO: 534031 - protein, 11 aa, Influenza virus
NTLTEQNVPVT

SEQ ID NO: 534032 - protein, 11 aa, Influenza virus
NTLTEREVEVV

SEQ ID NO: 534033 - protein, 11 aa, Influenza virus
NTLTERGIEVV

SEQ ID NO: 534034 - protein, 11 aa, Influenza virus
NTLTERGVEVV

SEQ ID NO: 534035 - protein, 11 aa, Influenza virus
NTLTSVTTNTI

SEQ ID NO: 534036 - protein, 11 aa, Influenza virus
NTMHQLLRHFQ

SEQ ID NO: 534037 - protein, 11 aa, Influenza virus
NTMTKDAERGK

SEQ ID NO: 534038 - protein, 11 aa, Influenza virus
NTNGEQILIIW

SEQ ID NO: 534039 - protein, 11 aa, Influenza virus
NTNKTFQNIDR

SEQ ID NO: 534040 - protein, 11 aa, Influenza virus
NTNKTFQNIEK

SEQ ID NO: 534041 - protein, 11 aa, Influenza virus
NTNKTFQNIER

SEQ ID NO: 534042 - protein, 11 aa, Influenza virus
NTNRTFQNIDK

SEQ ID NO: 534043 - protein, 11 aa, Influenza virus
NTNRTFQNIDR

SEQ ID NO: 534044 - protein, 11 aa, Influenza virus
NTNTINRSFQP

SEQ ID NO: 534045 - protein, 11 aa, Influenza virus
NTNTLSSVTTN

SEQ ID NO: 534046 - protein, 11 aa, Influenza virus
NTPSIDPKGLF

SEQ ID NO: 534047 - protein, 11 aa, Influenza virus
NTPSIEPKGLF

SEQ ID NO: 534048 - protein, 11 aa, Influenza virus
NTPSIEPRGLF

SEQ ID NO: 534049 - protein, 11 aa, Influenza virus
NTPSVEPKGLF

SEQ ID NO: 534050 - protein, 11 aa, Influenza virus
NTPSVEPRGLF

SEQ ID NO: 534051 - protein, 11 aa, Influenza virus
NTQFEAIGREF

SEQ ID NO: 534052 - protein, 11 aa, Influenza virus
NTQFEAVGKEF

SEQ ID NO: 534053 - protein, 11 aa, Influenza virus
NTQFEAVGREF

SEQ ID NO: 534054 - protein, 11 aa, Influenza virus
NTQFELIDNEF

SEQ ID NO: 534055 - protein, 11 aa, Influenza virus
NTQFETVGKEF

SEQ ID NO: 534056 - protein, 11 aa, Influenza virus
NTQFTAVGKEF

SEQ ID NO: 534057 - protein, 11 aa, Influenza virus
NTQFTSVGKEF

SEQ ID NO: 534058 - protein, 11 aa, Influenza virus
NTQFTVVGKEF

SEQ ID NO: 534059 - protein, 11 aa, Influenza virus
NTQGEGTAADY

SEQ ID NO: 534060 - protein, 11 aa, Influenza virus
NTQIIVILVLG

SEQ ID NO: 534061 - protein, 11 aa, Influenza virus
NTRCQTSVGGI

SEQ ID NO: 534062 - protein, 11 aa, Influenza virus
NTRKEPALIVW

SEQ ID NO: 534063 - protein, 11 aa, Influenza virus
NTRLPFQNLSP

SEQ ID NO: 534064 - protein, 11 aa, Influenza virus
NTSGEQMLIIW

SEQ ID NO: 534065 - protein, 11 aa, Influenza virus
NTSGEQMLVIW

SEQ ID NO: 534066 - protein, 11 aa, Influenza virus
NTSGKQMLIIW

SEQ ID NO: 534067 - protein, 11 aa, Influenza virus
NTSKHYIGKCP

SEQ ID NO: 534068 - protein, 11 aa, Influenza virus
NTSKPFQNICK

SEQ ID NO: 534069 - protein, 11 aa, Influenza virus
NTSKPFQNTSK

SEQ ID NO: 534070 - protein, 11 aa, Influenza virus
NTSKPFQNTSR

SEQ ID NO: 534071 - protein, 11 aa, Influenza virus
NTSKPLQNTSK

SEQ ID NO: 534072 - protein, 11 aa, Influenza virus
NTSQRGILEDE

SEQ ID NO: 534073 - protein, 11 aa, Influenza virus
NTSQRGVLEDE

SEQ ID NO: 534074 - protein, 11 aa, Influenza virus
NTSRHYIGKCP

SEQ ID NO: 534075 - protein, 11 aa, Influenza virus
NTSRHYMGECP

SEQ ID NO: 534076 - protein, 11 aa, Influenza virus
NTSYKILSIYS

SEQ ID NO: 534077 - protein, 11 aa, Influenza virus
NTTGRDVLVIW

SEQ ID NO: 534078 - protein, 11 aa, Influenza virus
NTTGRDVLVLW

SEQ ID NO: 534079 - protein, 11 aa, Influenza virus
NTTGRDVLVMW

SEQ ID NO: 534080 - protein, 11 aa, Influenza virus
NTTLIENTYVN

SEQ ID NO: 534081 - protein, 11 aa, Influenza virus
NTTLPFHNIHP

SEQ ID NO: 534082 - protein, 11 aa, Influenza virus
NTTLPFHNVHP

SEQ ID NO: 534083 - protein, 11 aa, Influenza virus
NTTLSTIALFI

SEQ ID NO: 534084 - protein, 11 aa, Influenza virus
NTTLSTIALII

SEQ ID NO: 534085 - protein, 11 aa, Influenza virus
NTTLSTIALLI

SEQ ID NO: 534086 - protein, 11 aa, Influenza virus
NTTNYYNETFV

SEQ ID NO: 534087 - protein, 11 aa, Influenza virus
NTTVVENTYVN

SEQ ID NO: 534088 - protein, 11 aa, Influenza virus
NTTYKILSIYS

SEQ ID NO: 534089 - protein, 11 aa, Influenza virus
NTTYRILSIYS

SEQ ID NO: 534090 - protein, 11 aa, Influenza virus
NTVINNITTTI

SEQ ID NO: 534091 - protein, 11 aa, Influenza virus
NTVKDRSPYRA

SEQ ID NO: 534092 - protein, 11 aa, Influenza virus
NTVLSIIALLI

SEQ ID NO: 534093 - protein, 11 aa, Influenza virus
NTVVNNITTTI

SEQ ID NO: 534094 - protein, 11 aa, Influenza virus
NTWARNILRTQ

SEQ ID NO: 534095 - protein, 11 aa, Influenza virus
NTWLGGTISPR

SEQ ID NO: 534096 - protein, 11 aa, Influenza virus
NTWLGRTISIA

SEQ ID NO: 534097 - protein, 11 aa, Influenza virus
NTWLGRTISPH

SEQ ID NO: 534098 - protein, 11 aa, Influenza virus
NTWLGRTISPK

SEQ ID NO: 534099 - protein, 11 aa, Influenza virus
NTWLGRTISPR

SEQ ID NO: 534100 - protein, 11 aa, Influenza virus
NTWLGRTISTA

SEQ ID NO: 534101 - protein, 11 aa, Influenza virus
NTWLGRTISTR

SEQ ID NO: 534102 - protein, 11 aa, Influenza virus
NTWLGRTLNTA

SEQ ID NO: 534103 - protein, 11 aa, Influenza virus
NTWLGRTTSTA

SEQ ID NO: 534104 - protein, 11 aa, Influenza virus
NTYDHAQYREE

SEQ ID NO: 534105 - protein, 11 aa, Influenza virus
NTYDHSHYREE

SEQ ID NO: 534106 - protein, 11 aa, Influenza virus
NTYDHSQYREE

SEQ ID NO: 534107 - protein, 11 aa, Influenza virus
NTYDHTQYREE

SEQ ID NO: 534108 - protein, 11 aa, Influenza virus
NTYNHTEYRQE

SEQ ID NO: 534109 - protein, 11 aa, Influenza virus
NTYNHTQYREE

SEQ ID NO: 534110 - protein, 11 aa, Influenza virus
NTYQWIIKNWE

SEQ ID NO: 534111 - protein, 11 aa, Influenza virus
NTYQWIIRNWE

SEQ ID NO: 534112 - protein, 11 aa, Influenza virus
NTYQWVIRNWE

SEQ ID NO: 534113 - protein, 11 aa, Influenza virus
NVEGWVVIAKD

SEQ ID NO: 534114 - protein, 11 aa, Influenza virus
NVELLVLMENE

SEQ ID NO: 534115 - protein, 11 aa, Influenza virus
NVENLFDEVRR

SEQ ID NO: 534116 - protein, 11 aa, Influenza virus
NVESNGNLIAP

SEQ ID NO: 534117 - protein, 11 aa, Influenza virus
NVESNGNLVAP

SEQ ID NO: 534118 - protein, 11 aa, Influenza virus
NVGLNISLHLK

SEQ ID NO: 534119 - protein, 11 aa, Influenza virus
NVGLNVSLHLK

SEQ ID NO: 534120 - protein, 11 aa, Influenza virus
NVGLNVSLHLR

SEQ ID NO: 534121 - protein, 11 aa, Influenza virus
NVGYLCAGIPT

SEQ ID NO: 534122 - protein, 11 aa, Influenza virus
NVHPLAIGECP

SEQ ID NO: 534123 - protein, 11 aa, Influenza virus
NVHPLTIGECP

SEQ ID NO: 534124 - protein, 11 aa, Influenza virus
NVHRNAIGDCP

SEQ ID NO: 534125 - protein, 11 aa, Influenza virus
NVHRNTIGDCP

SEQ ID NO: 534126 - protein, 11 aa, Influenza virus
NVHRNTIGNCP

SEQ ID NO: 534127 - protein, 11 aa, Influenza virus
NVHRSTIGDCP

SEQ ID NO: 534128 - protein, 11 aa, Influenza virus
NVINDKIDDQI

SEQ ID NO: 534129 - protein, 11 aa, Influenza virus
NVINWTKDSIT

SEQ ID NO: 534130 - protein, 11 aa, Influenza virus
NVINWTQDAMT

SEQ ID NO: 534131 - protein, 11 aa, Influenza virus
NVINWTRDAMT

SEQ ID NO: 534132 - protein, 11 aa, Influenza virus
NVINWTRDSII

SEQ ID NO: 534133 - protein, 11 aa, Influenza virus
NVINWTRDSIT

SEQ ID NO: 534134 - protein, 11 aa, Influenza virus
NVINWTRDSLT

SEQ ID NO: 534135 - protein, 11 aa, Influenza virus
NVINWTRDSMT

SEQ ID NO: 534136 - protein, 11 aa, Influenza virus
NVINWTRDSVT

SEQ ID NO: 534137 - protein, 11 aa, Influenza virus
NVKELGNGCFE

SEQ ID NO: 534138 - protein, 11 aa, Influenza virus
NVKNLFDEVKR

SEQ ID NO: 534139 - protein, 11 aa, Influenza virus
NVKNLFDEVRR

SEQ ID NO: 534140 - protein, 11 aa, Influenza virus
NVKNLHDQIKR

SEQ ID NO: 534141 - protein, 11 aa, Influenza virus
NVKNLHEQVKR

SEQ ID NO: 534142 - protein, 11 aa, Influenza virus
NVKNLYDKVRL

SEQ ID NO: 534143 - protein, 11 aa, Influenza virus
NVKNLYDRVRL

SEQ ID NO: 534144 - protein, 11 aa, Influenza virus
NVKNLYEKVRL

SEQ ID NO: 534145 - protein, 11 aa, Influenza virus
NVKVTHRENLL

SEQ ID NO: 534146 - protein, 11 aa, Influenza virus
NVLDGVTASCL

SEQ ID NO: 534147 - protein, 11 aa, Influenza virus
NVLIGQGDIVL

SEQ ID NO: 534148 - protein, 11 aa, Influenza virus
NVLIGQGDVVL

SEQ ID NO: 534149 - protein, 11 aa, Influenza virus
NVLLKHRFEII

SEQ ID NO: 534150 - protein, 11 aa, Influenza virus
NVLLSPEEVSE

SEQ ID NO: 534151 - protein, 11 aa, Influenza virus
NVLSIAPIMFS

SEQ ID NO: 534152 - protein, 11 aa, Influenza virus
NVLSVAPIMFS

SEQ ID NO: 534153 - protein, 11 aa, Influenza virus
NVNKITYGACP

SEQ ID NO: 534154 - protein, 11 aa, Influenza virus
NVNRITYGACP

SEQ ID NO: 534155 - protein, 11 aa, Influenza virus
NVNRITYGPCP

SEQ ID NO: 534156 - protein, 11 aa, Influenza virus
NVNRITYGVCP

SEQ ID NO: 534157 - protein, 11 aa, Influenza virus
NVPEKIHTRGL

SEQ ID NO: 534158 - protein, 11 aa, Influenza virus
NVPEKIRTRGL

SEQ ID NO: 534159 - protein, 11 aa, Influenza virus
NVPEKIRVKRR

SEQ ID NO: 534160 - protein, 11 aa, Influenza virus
NVPEWSYIVEK

SEQ ID NO: 534161 - protein, 11 aa, Influenza virus
NVPQAQDRGLF

SEQ ID NO: 534162 - protein, 11 aa, Influenza virus
NVPQAQNRGLF

SEQ ID NO: 534163 - protein, 11 aa, Influenza virus
NVPQIEARGLF

SEQ ID NO: 534164 - protein, 11 aa, Influenza virus
NVPQIEPRGLF

SEQ ID NO: 534165 - protein, 11 aa, Influenza virus
NVPQIESRGLF

SEQ ID NO: 534166 - protein, 11 aa, Influenza virus
NVPQIQNRGLF

SEQ ID NO: 534167 - protein, 11 aa, Influenza virus
NVPQMESRGLF

SEQ ID NO: 534168 - protein, 11 aa, Influenza virus
NVPQVQDRGLF

SEQ ID NO: 534169 - protein, 11 aa, Influenza virus
NVPQVQNRGLF

SEQ ID NO: 534170 - protein, 11 aa, Influenza virus
NVPSIQSRGLF

SEQ ID NO: 534171 - protein, 11 aa, Influenza virus
NVPSVQSRGLF

SEQ ID NO: 534172 - protein, 11 aa, Influenza virus
NVPVTQAMELV

SEQ ID NO: 534173 - protein, 11 aa, Influenza virus
NVPVTQTMELV

SEQ ID NO: 534174 - protein, 11 aa, Influenza virus
NVPVTQVEELV

SEQ ID NO: 534175 - protein, 11 aa, Influenza virus
NVRCVCRDNWK

SEQ ID NO: 534176 - protein, 11 aa, Influenza virus
NVRNLHDQIKR

SEQ ID NO: 534177 - protein, 11 aa, Influenza virus
NVRNLHDQVKR

SEQ ID NO: 534178 - protein, 11 aa, Influenza virus
NVRNLHDRIRR

SEQ ID NO: 534179 - protein, 11 aa, Influenza virus
NVRNLHDRTRR

SEQ ID NO: 534180 - protein, 11 aa, Influenza virus
NVRNLHDRVKR

SEQ ID NO: 534181 - protein, 11 aa, Influenza virus
NVRNLHDRVRR

SEQ ID NO: 534182 - protein, 11 aa, Influenza virus
NVRNLHEQIKR

SEQ ID NO: 534183 - protein, 11 aa, Influenza virus
NVRNLHERIRR

SEQ ID NO: 534184 - protein, 11 aa, Influenza virus
NVRNLYDKVRL

SEQ ID NO: 534185 - protein, 11 aa, Influenza virus
NVSEWSYIVEK

SEQ ID NO: 534186 - protein, 11 aa, Influenza virus
NVSRIAIGNCP

SEQ ID NO: 534187 - protein, 11 aa, Influenza virus
NVSSSGTSKAC

SEQ ID NO: 534188 - protein, 11 aa, Influenza virus
NVSWTSNSIVT

SEQ ID NO: 534189 - protein, 11 aa, Influenza virus
NVTETLYLNHT

SEQ ID NO: 534190 - protein, 11 aa, Influenza virus
NVTHTGTSKAC

SEQ ID NO: 534191 - protein, 11 aa, Influenza virus
NVTHVQNNYTT

SEQ ID NO: 534192 - protein, 11 aa, Influenza virus
NVTKENTGSYV

SEQ ID NO: 534193 - protein, 11 aa, Influenza virus
NVTNVQNDYTT

SEQ ID NO: 534194 - protein, 11 aa, Influenza virus
NVTNVQNNYTT

SEQ ID NO: 534195 - protein, 11 aa, Influenza virus
NVTRSGTSKAC

SEQ ID NO: 534196 - protein, 11 aa, Influenza virus
NVTSSGTSKAC

SEQ ID NO: 534197 - protein, 11 aa, Influenza virus
NVTVTHAKDIL

SEQ ID NO: 534198 - protein, 11 aa, Influenza virus
NVTVTHAKNIL

SEQ ID NO: 534199 - protein, 11 aa, Influenza virus
NVTVTHAQDIL

SEQ ID NO: 534200 - protein, 11 aa, Influenza virus
NVTVTHAQNIL

SEQ ID NO: 534201 - protein, 11 aa, Influenza virus
NVTVTHSIELL

SEQ ID NO: 534202 - protein, 11 aa, Influenza virus
NVTVTHSINLL

SEQ ID NO: 534203 - protein, 11 aa, Influenza virus
NVTVTHSVDLL

SEQ ID NO: 534204 - protein, 11 aa, Influenza virus
NVTVTHSVELL

SEQ ID NO: 534205 - protein, 11 aa, Influenza virus
NVTVTHSVNIL

SEQ ID NO: 534206 - protein, 11 aa, Influenza virus
NVTVTHSVNLF

SEQ ID NO: 534207 - protein, 11 aa, Influenza virus
NVTVTHSVNLL

SEQ ID NO: 534208 - protein, 11 aa, Influenza virus
NVTVTSSIELV

SEQ ID NO: 534209 - protein, 11 aa, Influenza virus
NVTVTSSVELV

SEQ ID NO: 534210 - protein, 11 aa, Influenza virus
NVTYTGISKAC

SEQ ID NO: 534211 - protein, 11 aa, Influenza virus
NVTYTGTSKAC

SEQ ID NO: 534212 - protein, 11 aa, Influenza virus
NVTYTGTSRAC

SEQ ID NO: 534213 - protein, 11 aa, Influenza virus
NVVRKMMTNSH

SEQ ID NO: 534214 - protein, 11 aa, Influenza virus
NVVRKMMTNSQ

SEQ ID NO: 534215 - protein, 11 aa, Influenza virus
NVVRKMMTSSQ

SEQ ID NO: 534216 - protein, 11 aa, Influenza virus
NVWTYNAELLV

SEQ ID NO: 534217 - protein, 11 aa, Influenza virus
NVYKALSIYSC

SEQ ID NO: 534218 - protein, 11 aa, Influenza virus
NVYKILSIYSC

SEQ ID NO: 534219 - protein, 11 aa, Influenza virus
NVYKVLAIYSC

SEQ ID NO: 534220 - protein, 11 aa, Influenza virus
NVYKVLSIYSC

SEQ ID NO: 534221 - protein, 11 aa, Influenza virus
NVYRALSIYSC

SEQ ID NO: 534222 - protein, 11 aa, Influenza virus
NWFGYFGIFFV

SEQ ID NO: 534223 - protein, 11 aa, Influenza virus
NWHASNRPWIS

SEQ ID NO: 534224 - protein, 11 aa, Influenza virus
NWHASNRPWVS

SEQ ID NO: 534225 - protein, 11 aa, Influenza virus
NWHGANRPWVS

SEQ ID NO: 534226 - protein, 11 aa, Influenza virus
NWHGSNRPWIS

SEQ ID NO: 534227 - protein, 11 aa, Influenza virus
NWHGSNRPWLS

SEQ ID NO: 534228 - protein, 11 aa, Influenza virus
NWHGSNRPWVS

SEQ ID NO: 534229 - protein, 11 aa, Influenza virus
NWIGTNRPVLV

SEQ ID NO: 534230 - protein, 11 aa, Influenza virus
NWILWISFAIS

SEQ ID NO: 534231 - protein, 11 aa, Influenza virus
NWKGANRPIIT

SEQ ID NO: 534232 - protein, 11 aa, Influenza virus
NWKGANRPVII

SEQ ID NO: 534233 - protein, 11 aa, Influenza virus
NWKGANRPVIT

SEQ ID NO: 534234 - protein, 11 aa, Influenza virus
NWKGSNRPIID

SEQ ID NO: 534235 - protein, 11 aa, Influenza virus
NWKGSNRPIVD

SEQ ID NO: 534236 - protein, 11 aa, Influenza virus
NWKGSNRPVID

SEQ ID NO: 534237 - protein, 11 aa, Influenza virus
NWKGSNRPVVD

SEQ ID NO: 534238 - protein, 11 aa, Influenza virus
NWKGSNRPWIR

SEQ ID NO: 534239 - protein, 11 aa, Influenza virus
NWKGSNRPWMR

SEQ ID NO: 534240 - protein, 11 aa, Influenza virus
NWKGSNRPWVR

SEQ ID NO: 534241 - protein, 11 aa, Influenza virus
NWLTIGISGPD

SEQ ID NO: 534242 - protein, 11 aa, Influenza virus
NWLTKATNGNY

SEQ ID NO: 534243 - protein, 11 aa, Influenza virus
NWLTKETNGNY

SEQ ID NO: 534244 - protein, 11 aa, Influenza virus
NWLTKKEPDTY

SEQ ID NO: 534245 - protein, 11 aa, Influenza virus
NWLTKKKNPEA

SEQ ID NO: 534246 - protein, 11 aa, Influenza virus
NWLTKKKPDIY

SEQ ID NO: 534247 - protein, 11 aa, Influenza virus
NWLTKKKPDTY

SEQ ID NO: 534248 - protein, 11 aa, Influenza virus
NWPDGAEIEYF

SEQ ID NO: 534249 - protein, 11 aa, Influenza virus
NWPDGAKIETL

SEQ ID NO: 534250 - protein, 11 aa, Influenza virus
NWPDGAKIEYF

SEQ ID NO: 534251 - protein, 11 aa, Influenza virus
NWPDGSDIGFM

SEQ ID NO: 534252 - protein, 11 aa, Influenza virus
NWPDGSNIGFM

SEQ ID NO: 534253 - protein, 11 aa, Influenza virus
NWPSSSGGLEW

SEQ ID NO: 534254 - protein, 11 aa, Influenza virus
NWQGANRPIIE

SEQ ID NO: 534255 - protein, 11 aa, Influenza virus
NWQGANRPVIE

SEQ ID NO: 534256 - protein, 11 aa, Influenza virus
NWQGANRPVIK

SEQ ID NO: 534257 - protein, 11 aa, Influenza virus
NWQGSNRPVIQ

SEQ ID NO: 534258 - protein, 11 aa, Influenza virus
NWQGSNRPVIR

SEQ ID NO: 534259 - protein, 11 aa, Influenza virus
NWQGSNRPWIR

SEQ ID NO: 534260 - protein, 11 aa, Influenza virus
NWRGANRPVIT

SEQ ID NO: 534261 - protein, 11 aa, Influenza virus
NWRGSNRPIVD

SEQ ID NO: 534262 - protein, 11 aa, Influenza virus
NWRGSNRPWIR

SEQ ID NO: 534263 - protein, 11 aa, Influenza virus
NWSGYSGAFTI

SEQ ID NO: 534264 - protein, 11 aa, Influenza virus
NWSGYSGAFTV

SEQ ID NO: 534265 - protein, 11 aa, Influenza virus
NWSGYSGIFSI

SEQ ID NO: 534266 - protein, 11 aa, Influenza virus
NWSGYSGIFSV

SEQ ID NO: 534267 - protein, 11 aa, Influenza virus
NWSGYSGSFID

SEQ ID NO: 534268 - protein, 11 aa, Influenza virus
NWSGYSGSFSI

SEQ ID NO: 534269 - protein, 11 aa, Influenza virus
NWSGYSGSFTI

SEQ ID NO: 534270 - protein, 11 aa, Influenza virus
NWSGYSGSFTL

SEQ ID NO: 534271 - protein, 11 aa, Influenza virus
NWSGYSGVFSV

SEQ ID NO: 534272 - protein, 11 aa, Influenza virus
NWSWHDGAILP

SEQ ID NO: 534273 - protein, 11 aa, Influenza virus
NWTGTNRPILA

SEQ ID NO: 534274 - protein, 11 aa, Influenza virus
NWTGTNRPILV

SEQ ID NO: 534275 - protein, 11 aa, Influenza virus
NWTGTNRPVLI

SEQ ID NO: 534276 - protein, 11 aa, Influenza virus
NWTGTNRPVLV

SEQ ID NO: 534277 - protein, 11 aa, Influenza virus
NWTKDSITDIW

SEQ ID NO: 534278 - protein, 11 aa, Influenza virus
NWTQDAMTEVW

SEQ ID NO: 534279 - protein, 11 aa, Influenza virus
NWTRDAMTEIW

SEQ ID NO: 534280 - protein, 11 aa, Influenza virus
NWTRDAMTEVW

SEQ ID NO: 534281 - protein, 11 aa, Influenza virus
NWTRDSITEVW

SEQ ID NO: 534282 - protein, 11 aa, Influenza virus
NWTRDSLTEIW

SEQ ID NO: 534283 - protein, 11 aa, Influenza virus
NWTRDSMTEVW

SEQ ID NO: 534284 - protein, 11 aa, Influenza virus
NYARLYIWGVH

SEQ ID NO: 534285 - protein, 11 aa, Influenza virus
NYDSIRGEFNQ

SEQ ID NO: 534286 - protein, 11 aa, Influenza virus
NYDSIRGEFSQ

SEQ ID NO: 534287 - protein, 11 aa, Influenza virus
NYEELREHLSS

SEQ ID NO: 534288 - protein, 11 aa, Influenza virus
NYEELREQLSS

SEQ ID NO: 534289 - protein, 11 aa, Influenza virus
NYGPINVTKEN

SEQ ID NO: 534290 - protein, 11 aa, Influenza virus
NYGVKGFGFRQ

SEQ ID NO: 534291 - protein, 11 aa, Influenza virus
NYHQSFVPSPG

SEQ ID NO: 534292 - protein, 11 aa, Influenza virus
NYHYEECSCYP

SEQ ID NO: 534293 - protein, 11 aa, Influenza virus
NYKEICIAWSS

SEQ ID NO: 534294 - protein, 11 aa, Influenza virus
NYKEICVAWSS

SEQ ID NO: 534295 - protein, 11 aa, Influenza virus
NYKEIRIAWSS

SEQ ID NO: 534296 - protein, 11 aa, Influenza virus
NYKEMCAAWSS

SEQ ID NO: 534297 - protein, 11 aa, Influenza virus
NYLIRALTLNT

SEQ ID NO: 534298 - protein, 11 aa, Influenza virus
NYLLLNKSLCS

SEQ ID NO: 534299 - protein, 11 aa, Influenza virus
NYLMLNKSLCK

SEQ ID NO: 534300 - protein, 11 aa, Influenza virus
NYQQSFVPSPG

SEQ ID NO: 534301 - protein, 11 aa, Influenza virus
NYQSLRSILAN

SEQ ID NO: 534302 - protein, 11 aa, Influenza virus
NYREICIAWSS

SEQ ID NO: 534303 - protein, 11 aa, Influenza virus
NYVCSGLVGDT

SEQ ID NO: 534304 - protein, 11 aa, Influenza virus
NYVSMEFSLTD

SEQ ID NO: 534305 - protein, 11 aa, Influenza virus
NYYNETFVNMT

SEQ ID NO: 534306 - protein, 11 aa, Influenza virus
NYYNETFVNVT

SEQ ID NO: 534307 - protein, 11 aa, Influenza virus
NYYYEECSCYP

SEQ ID NO: 534308 - protein, 11 aa, Influenza virus
PAANNADHRIY

SEQ ID NO: 534309 - protein, 11 aa, Influenza virus
PAANNADHRVY

SEQ ID NO: 534310 - protein, 11 aa, Influenza virus
PAANSADHRIY

SEQ ID NO: 534311 - protein, 11 aa, Influenza virus
PAANSADHRVY

SEQ ID NO: 534312 - protein, 11 aa, Influenza virus
PAANSAHHRVY

SEQ ID NO: 534313 - protein, 11 aa, Influenza virus
PAAPHGLCYPG

SEQ ID NO: 534314 - protein, 11 aa, Influenza virus
PAATALANTIE

SEQ ID NO: 534315 - protein, 11 aa, Influenza virus
PAECRTFFLTQ

SEQ ID NO: 534316 - protein, 11 aa, Influenza virus
PAFSVQRNLPF

SEQ ID NO: 534317 - protein, 11 aa, Influenza virus
PAHKSQLIWMA

SEQ ID NO: 534318 - protein, 11 aa, Influenza virus
PAHKSQLVWMA

SEQ ID NO: 534319 - protein, 11 aa, Influenza virus
PAKLLKERGFF

SEQ ID NO: 534320 - protein, 11 aa, Influenza virus
PALIIWGIHHS

SEQ ID NO: 534321 - protein, 11 aa, Influenza virus
PALIIWGVHHS

SEQ ID NO: 534322 - protein, 11 aa, Influenza virus
PALIVWGIHHS

SEQ ID NO: 534323 - protein, 11 aa, Influenza virus
PALIVWGVHHS

SEQ ID NO: 534324 - protein, 11 aa, Influenza virus
PALRMKWMMAM

SEQ ID NO: 534325 - protein, 11 aa, Influenza virus
PANKQASYKIF

SEQ ID NO: 534326 - protein, 11 aa, Influenza virus
PANNQASYKIF

SEQ ID NO: 534327 - protein, 11 aa, Influenza virus
PANNQASYRIF

SEQ ID NO: 534328 - protein, 11 aa, Influenza virus
PANSQASYKIF

SEQ ID NO: 534329 - protein, 11 aa, Influenza virus
PAQNAISITFP

SEQ ID NO: 534330 - protein, 11 aa, Influenza virus
PAQNAISTTFP

SEQ ID NO: 534331 - protein, 11 aa, Influenza virus
PASNQASYKIF

SEQ ID NO: 534332 - protein, 11 aa, Influenza virus
PASRYLIDMTL

SEQ ID NO: 534333 - protein, 11 aa, Influenza virus
PASRYLTDMTL

SEQ ID NO: 534334 - protein, 11 aa, Influenza virus
PATAQMALQLF

SEQ ID NO: 534335 - protein, 11 aa, Influenza virus
PATIGECPKYV

SEQ ID NO: 534336 - protein, 11 aa, Influenza virus
PAYCNTDLGAP

SEQ ID NO: 534337 - protein, 11 aa, Influenza virus
PAYCNTDLGSP

SEQ ID NO: 534338 - protein, 11 aa, Influenza virus
PAYCNTDLGTP

SEQ ID NO: 534339 - protein, 11 aa, Influenza virus
PCFWIELIRGR

SEQ ID NO: 534340 - protein, 11 aa, Influenza virus
PCFWLEMIRGK

SEQ ID NO: 534341 - protein, 11 aa, Influenza virus
PCFWLEMIRGR

SEQ ID NO: 534342 - protein, 11 aa, Influenza virus
PCFWVELIRGQ

SEQ ID NO: 534343 - protein, 11 aa, Influenza virus
PCFWVELIRGR

SEQ ID NO: 534344 - protein, 11 aa, Influenza virus
PCFWVELVRGL

SEQ ID NO: 534345 - protein, 11 aa, Influenza virus
PCFWVELVRGR

SEQ ID NO: 534346 - protein, 11 aa, Influenza virus
PCFWVEMIRGE

SEQ ID NO: 534347 - protein, 11 aa, Influenza virus
PCFWVEMIRGK

SEQ ID NO: 534348 - protein, 11 aa, Influenza virus
PCFWVEMIRGQ

SEQ ID NO: 534349 - protein, 11 aa, Influenza virus
PCFWVEMIRGR

SEQ ID NO: 534350 - protein, 11 aa, Influenza virus
PCFYIELIRGK

SEQ ID NO: 534351 - protein, 11 aa, Influenza virus
PCFYIELIRGR

SEQ ID NO: 534352 - protein, 11 aa, Influenza virus
PCFYVELIRGM

SEQ ID NO: 534353 - protein, 11 aa, Influenza virus
PCFYVELIRGR

SEQ ID NO: 534354 - protein, 11 aa, Influenza virus
PCFYVELTRGV

SEQ ID NO: 534355 - protein, 11 aa, Influenza virus
PCLTDKGSIQS

SEQ ID NO: 534356 - protein, 11 aa, Influenza virus
PCMESIRNNTY

SEQ ID NO: 534357 - protein, 11 aa, Influenza virus
PDATAVAVLKY

SEQ ID NO: 534358 - protein, 11 aa, Influenza virus
PDATAVVVLKY

SEQ ID NO: 534359 - protein, 11 aa, Influenza virus
PDDGAVAVLKY

SEQ ID NO: 534360 - protein, 11 aa, Influenza virus
PDECRFYALSQ

SEQ ID NO: 534361 - protein, 11 aa, Influenza virus
PDGADINFMPI

SEQ ID NO: 534362 - protein, 11 aa, Influenza virus
PDGALLPFDID

SEQ ID NO: 534363 - protein, 11 aa, Influenza virus
PDGANIDFMPV

SEQ ID NO: 534364 - protein, 11 aa, Influenza virus
PDGANIGFMPK

SEQ ID NO: 534365 - protein, 11 aa, Influenza virus
PDGANINFMPI

SEQ ID NO: 534366 - protein, 11 aa, Influenza virus
PDGANINLMPI

SEQ ID NO: 534367 - protein, 11 aa, Influenza virus
PDGANTNFMPI

SEQ ID NO: 534368 - protein, 11 aa, Influenza virus
PDGCRFYALSQ

SEQ ID NO: 534369 - protein, 11 aa, Influenza virus
PDGSDIGFMPK

SEQ ID NO: 534370 - protein, 11 aa, Influenza virus
PDGSNIGFMPK

SEQ ID NO: 534371 - protein, 11 aa, Influenza virus
PDHEGEGIPLY

SEQ ID NO: 534372 - protein, 11 aa, Influenza virus
PDIYDFNEGSY

SEQ ID NO: 534373 - protein, 11 aa, Influenza virus
PDLYDYKEDRF

SEQ ID NO: 534374 - protein, 11 aa, Influenza virus
PDLYDYKENRF

SEQ ID NO: 534375 - protein, 11 aa, Influenza virus
PDLYDYKESRF

SEQ ID NO: 534376 - protein, 11 aa, Influenza virus
PDLYDYKKNRF

SEQ ID NO: 534377 - protein, 11 aa, Influenza virus
PDNEAVAVLKY

SEQ ID NO: 534378 - protein, 11 aa, Influenza virus
PDNGAVAVLKY

SEQ ID NO: 534379 - protein, 11 aa, Influenza virus
PDNGAVAVVKY

SEQ ID NO: 534380 - protein, 11 aa, Influenza virus
PDPFRLLQNSQ

SEQ ID NO: 534381 - protein, 11 aa, Influenza virus
PDPGVKGFAFL

SEQ ID NO: 534382 - protein, 11 aa, Influenza virus
PDRATFLRSNA

SEQ ID NO: 534383 - protein, 11 aa, Influenza virus
PDSGAVAVLKY

SEQ ID NO: 534384 - protein, 11 aa, Influenza virus
PDSTAVAVIKY

SEQ ID NO: 534385 - protein, 11 aa, Influenza virus
PDSVLVNTYQW

SEQ ID NO: 534386 - protein, 11 aa, Influenza virus
PDTTAVAVLKY

SEQ ID NO: 534387 - protein, 11 aa, Influenza virus
PDTYDFNEGAY

SEQ ID NO: 534388 - protein, 11 aa, Influenza virus
PDTYDFNEGSY

SEQ ID NO: 534389 - protein, 11 aa, Influenza virus
PDTYDFNEGTY

SEQ ID NO: 534390 - protein, 11 aa, Influenza virus
PDVRCICRDNW

SEQ ID NO: 534391 - protein, 11 aa, Influenza virus
PDVRCTCRDNW

SEQ ID NO: 534392 - protein, 11 aa, Influenza virus
PDVRCVCRDNW

SEQ ID NO: 534393 - protein, 11 aa, Influenza virus
PDYHYEECSCY

SEQ ID NO: 534394 - protein, 11 aa, Influenza virus
PDYQIGYVCSG

SEQ ID NO: 534395 - protein, 11 aa, Influenza virus
PDYQSIRSILA

SEQ ID NO: 534396 - protein, 11 aa, Influenza virus
PDYQSLRSILA

SEQ ID NO: 534397 - protein, 11 aa, Influenza virus
PEAGLKWELMD

SEQ ID NO: 534398 - protein, 11 aa, Influenza virus
PEAYNFNEGSY

SEQ ID NO: 534399 - protein, 11 aa, Influenza virus
PEEAKYVEWTS

SEQ ID NO: 534400 - protein, 11 aa, Influenza virus
PEEAKYVWWAS

SEQ ID NO: 534401 - protein, 11 aa, Influenza virus
PEEAKYVWWTS

SEQ ID NO: 534402 - protein, 11 aa, Influenza virus
PEEGTSIWTSS

SEQ ID NO: 534403 - protein, 11 aa, Influenza virus
PEEISETQGTE

SEQ ID NO: 534404 - protein, 11 aa, Influenza virus
PEEKTSIWTSS

SEQ ID NO: 534405 - protein, 11 aa, Influenza virus
PEERNSIWTSS

SEQ ID NO: 534406 - protein, 11 aa, Influenza virus
PEERTSIWTSS

SEQ ID NO: 534407 - protein, 11 aa, Influenza virus
PEEVKYVWWTS

SEQ ID NO: 534408 - protein, 11 aa, Influenza virus
PEEVSEAQGTE

SEQ ID NO: 534409 - protein, 11 aa, Influenza virus
PEEVSETQGIE

SEQ ID NO: 534410 - protein, 11 aa, Influenza virus
PEEVSETQGME

SEQ ID NO: 534411 - protein, 11 aa, Influenza virus
PEEVSETQGTE

SEQ ID NO: 534412 - protein, 11 aa, Influenza virus
PEFGYLLKGES

SEQ ID NO: 534413 - protein, 11 aa, Influenza virus
PEFGYLLRGES

SEQ ID NO: 534414 - protein, 11 aa, Influenza virus
PEGMCYPGFVE

SEQ ID NO: 534415 - protein, 11 aa, Influenza virus
PEGMCYPGSIE

SEQ ID NO: 534416 - protein, 11 aa, Influenza virus
PEGMCYPGSVE

SEQ ID NO: 534417 - protein, 11 aa, Influenza virus
PEKIHTRGLFG

SEQ ID NO: 534418 - protein, 11 aa, Influenza virus
PEKIRTRGLFG

SEQ ID NO: 534419 - protein, 11 aa, Influenza virus
PEKIRVKRRPV

SEQ ID NO: 534420 - protein, 11 aa, Influenza virus
PEKQTRGIFGA

SEQ ID NO: 534421 - protein, 11 aa, Influenza virus
PEKQTRGLFGA

SEQ ID NO: 534422 - protein, 11 aa, Influenza virus
PERQTRGIFGA

SEQ ID NO: 534423 - protein, 11 aa, Influenza virus
PERQTRGLFGA

SEQ ID NO: 534424 - protein, 11 aa, Influenza virus
PESVLINTYQW

SEQ ID NO: 534425 - protein, 11 aa, Influenza virus
PESVLVNTYQW

SEQ ID NO: 534426 - protein, 11 aa, Influenza virus
PETQTRGIFGA

SEQ ID NO: 534427 - protein, 11 aa, Influenza virus
PEVCLKWDLMD

SEQ ID NO: 534428 - protein, 11 aa, Influenza virus
PEVCLKWELMD

SEQ ID NO: 534429 - protein, 11 aa, Influenza virus
PEWSYIIEKEN

SEQ ID NO: 534430 - protein, 11 aa, Influenza virus
PEWSYIMEKEN

SEQ ID NO: 534431 - protein, 11 aa, Influenza virus
PEWSYIVEKAN

SEQ ID NO: 534432 - protein, 11 aa, Influenza virus
PEWSYIVEKDK

SEQ ID NO: 534433 - protein, 11 aa, Influenza virus
PEWSYIVEKDN

SEQ ID NO: 534434 - protein, 11 aa, Influenza virus
PEWSYIVEKDS

SEQ ID NO: 534435 - protein, 11 aa, Influenza virus
PEWSYIVEKEN

SEQ ID NO: 534436 - protein, 11 aa, Influenza virus
PEWSYIVEKNN

SEQ ID NO: 534437 - protein, 11 aa, Influenza virus
PEWSYIVEREN

SEQ ID NO: 534438 - protein, 11 aa, Influenza virus
PEWSYIVERET

SEQ ID NO: 534439 - protein, 11 aa, Influenza virus
PEYGFKISKRG

SEQ ID NO: 534440 - protein, 11 aa, Influenza virus
PEYGFRISKRG

SEQ ID NO: 534441 - protein, 11 aa, Influenza virus
PEYGHLITGKS

SEQ ID NO: 534442 - protein, 11 aa, Influenza virus
PEYGHLTTGKS

SEQ ID NO: 534443 - protein, 11 aa, Influenza virus
PEYGHLVTGKS

SEQ ID NO: 534444 - protein, 11 aa, Influenza virus
PEYGYLITGKS

SEQ ID NO: 534445 - protein, 11 aa, Influenza virus
PEYQSLRSILA

SEQ ID NO: 534446 - protein, 11 aa, Influenza virus
PFAKDNSIRLS

SEQ ID NO: 534447 - protein, 11 aa, Influenza virus
PFDVPDYQSLR

SEQ ID NO: 534448 - protein, 11 aa, Influenza virus
PFHKDNAIRLG

SEQ ID NO: 534449 - protein, 11 aa, Influenza virus
PFHKDNALRLA

SEQ ID NO: 534450 - protein, 11 aa, Influenza virus
PFHKDNAVRLG

SEQ ID NO: 534451 - protein, 11 aa, Influenza virus
PFHKGNSARLI

SEQ ID NO: 534452 - protein, 11 aa, Influenza virus
PFHLGTKQVCI

SEQ ID NO: 534453 - protein, 11 aa, Influenza virus
PFHLGTKQVCM

SEQ ID NO: 534454 - protein, 11 aa, Influenza virus
PFHLGTKQVCV

SEQ ID NO: 534455 - protein, 11 aa, Influenza virus
PFHLGTRQVCI

SEQ ID NO: 534456 - protein, 11 aa, Influenza virus
PFHLGTRQVCM

SEQ ID NO: 534457 - protein, 11 aa, Influenza virus
PFHNIHPLAIG

SEQ ID NO: 534458 - protein, 11 aa, Influenza virus
PFHNIHPLTIG

SEQ ID NO: 534459 - protein, 11 aa, Influenza virus
PFHNIHPLTMG

SEQ ID NO: 534460 - protein, 11 aa, Influenza virus
PFHNVHPFTIG

SEQ ID NO: 534461 - protein, 11 aa, Influenza virus
PFHNVHPLAIG

SEQ ID NO: 534462 - protein, 11 aa, Influenza virus
PFHNVHPLTIG

SEQ ID NO: 534463 - protein, 11 aa, Influenza virus
PFISCSHLECR

SEQ ID NO: 534464 - protein, 11 aa, Influenza virus
PFISCSHMECR

SEQ ID NO: 534465 - protein, 11 aa, Influenza virus
PFISCSHSECR

SEQ ID NO: 534466 - protein, 11 aa, Influenza virus
PFISCSYLECR

SEQ ID NO: 534467 - protein, 11 aa, Influenza virus
PFKGFFPFHKD

SEQ ID NO: 534468 - protein, 11 aa, Influenza virus
PFLDRLRRDQK

SEQ ID NO: 534469 - protein, 11 aa, Influenza virus
PFPVGSGSFPD

SEQ ID NO: 534470 - protein, 11 aa, Influenza virus
PFQGFFPFHKD

SEQ ID NO: 534471 - protein, 11 aa, Influenza virus
PFQNASRHHMG

SEQ ID NO: 534472 - protein, 11 aa, Influenza virus
PFQNASRHYMG

SEQ ID NO: 534473 - protein, 11 aa, Influenza virus
PFQNASRYYMG

SEQ ID NO: 534474 - protein, 11 aa, Influenza virus
PFQNICKPYIG

SEQ ID NO: 534475 - protein, 11 aa, Influenza virus
PFQNIDSRAVG

SEQ ID NO: 534476 - protein, 11 aa, Influenza virus
PFQNIDSWAVG

SEQ ID NO: 534477 - protein, 11 aa, Influenza virus
PFQNIHPATIG

SEQ ID NO: 534478 - protein, 11 aa, Influenza virus
PFQNIHPITIG

SEQ ID NO: 534479 - protein, 11 aa, Influenza virus
PFQNIHPVTIG

SEQ ID NO: 534480 - protein, 11 aa, Influenza virus
PFQNLSPRTVG

SEQ ID NO: 534481 - protein, 11 aa, Influenza virus
PFQNTSKHYIG

SEQ ID NO: 534482 - protein, 11 aa, Influenza virus
PFQNTSRHYIG

SEQ ID NO: 534483 - protein, 11 aa, Influenza virus
PFQNTSRHYMG

SEQ ID NO: 534484 - protein, 11 aa, Influenza virus
PFQNVHPITIG

SEQ ID NO: 534485 - protein, 11 aa, Influenza virus
PFQNVHPVTIG

SEQ ID NO: 534486 - protein, 11 aa, Influenza virus
PFQNVNKITYG

SEQ ID NO: 534487 - protein, 11 aa, Influenza virus
PFQNVNKVTYG

SEQ ID NO: 534488 - protein, 11 aa, Influenza virus
PFQNVNRITYG

SEQ ID NO: 534489 - protein, 11 aa, Influenza virus
PFQNVSRIAIG

SEQ ID NO: 534490 - protein, 11 aa, Influenza virus
PFRALISWEMG

SEQ ID NO: 534491 - protein, 11 aa, Influenza virus
PFRALISWGMG

SEQ ID NO: 534492 - protein, 11 aa, Influenza virus
PFRALVSWEMG

SEQ ID NO: 534493 - protein, 11 aa, Influenza virus
PFRGFFPFHKD

SEQ ID NO: 534494 - protein, 11 aa, Influenza virus
PFRTLMSCPIG

SEQ ID NO: 534495 - protein, 11 aa, Influenza virus
PFRTLMSCPMG

SEQ ID NO: 534496 - protein, 11 aa, Influenza virus
PFRTLMSCPVG

SEQ ID NO: 534497 - protein, 11 aa, Influenza virus
PFSKDNGIRIG

SEQ ID NO: 534498 - protein, 11 aa, Influenza virus
PFSKDNSIQLS

SEQ ID NO: 534499 - protein, 11 aa, Influenza virus
PFSKDNSIRLA

SEQ ID NO: 534500 - protein, 11 aa, Influenza virus
PFSKDNSIRLS

SEQ ID NO: 534501 - protein, 11 aa, Influenza virus
PFSKDNSIRVS

SEQ ID NO: 534502 - protein, 11 aa, Influenza virus
PFSKDNSVRLS

SEQ ID NO: 534503 - protein, 11 aa, Influenza virus
PFSVGSGSFPD

SEQ ID NO: 534504 - protein, 11 aa, Influenza virus
PFVACGPAECR

SEQ ID NO: 534505 - protein, 11 aa, Influenza virus
PFVACGPSECR

SEQ ID NO: 534506 - protein, 11 aa, Influenza virus
PFVACGPTECR

SEQ ID NO: 534507 - protein, 11 aa, Influenza virus
PFVACSPSECR

SEQ ID NO: 534508 - protein, 11 aa, Influenza virus
PFVRGQQGRMD

SEQ ID NO: 534509 - protein, 11 aa, Influenza virus
PFVSCGPSECR

SEQ ID NO: 534510 - protein, 11 aa, Influenza virus
PFVSCSHLECR

SEQ ID NO: 534511 - protein, 11 aa, Influenza virus
PGAPGVKGFGF

SEQ ID NO: 534512 - protein, 11 aa, Influenza virus
PGAPHGLCYPG

SEQ ID NO: 534513 - protein, 11 aa, Influenza virus
PGARPKVNGQA

SEQ ID NO: 534514 - protein, 11 aa, Influenza virus
PGATINEEALR

SEQ ID NO: 534515 - protein, 11 aa, Influenza virus
PGATVNEEALR

SEQ ID NO: 534516 - protein, 11 aa, Influenza virus
PGATVNEGALR

SEQ ID NO: 534517 - protein, 11 aa, Influenza virus
PGCDRLQDTTW

SEQ ID NO: 534518 - protein, 11 aa, Influenza virus
PGDHITFSHNG

SEQ ID NO: 534519 - protein, 11 aa, Influenza virus
PGDIIVFNTIG

SEQ ID NO: 534520 - protein, 11 aa, Influenza virus
PGDLILFNTIG

SEQ ID NO: 534521 - protein, 11 aa, Influenza virus
PGDLIVFNTIG

SEQ ID NO: 534522 - protein, 11 aa, Influenza virus
PGDNIIFSHNG

SEQ ID NO: 534523 - protein, 11 aa, Influenza virus
PGDNITFSDNG

SEQ ID NO: 534524 - protein, 11 aa, Influenza virus
PGDNITFSHNG

SEQ ID NO: 534525 - protein, 11 aa, Influenza virus
PGDRPKVNGQA

SEQ ID NO: 534526 - protein, 11 aa, Influenza virus
PGDSIIFNSIG

SEQ ID NO: 534527 - protein, 11 aa, Influenza virus
PGDSITFSHNG

SEQ ID NO: 534528 - protein, 11 aa, Influenza virus
PGDTVTFTFNG

SEQ ID NO: 534529 - protein, 11 aa, Influenza virus
PGDVIVFNTIG

SEQ ID NO: 534530 - protein, 11 aa, Influenza virus
PGELDNNGELR

SEQ ID NO: 534531 - protein, 11 aa, Influenza virus
PGELNNNGELR

SEQ ID NO: 534532 - protein, 11 aa, Influenza virus
PGERIMFESNG

SEQ ID NO: 534533 - protein, 11 aa, Influenza virus
PGERITFESNG

SEQ ID NO: 534534 - protein, 11 aa, Influenza virus
PGERITFESSG

SEQ ID NO: 534535 - protein, 11 aa, Influenza virus
PGERTTFESNG

SEQ ID NO: 534536 - protein, 11 aa, Influenza virus
PGETLKVESNG

SEQ ID NO: 534537 - protein, 11 aa, Influenza virus
PGETLNIESNG

SEQ ID NO: 534538 - protein, 11 aa, Influenza virus
PGETLNVESNG

SEQ ID NO: 534539 - protein, 11 aa, Influenza virus
PGEVDNNGELR

SEQ ID NO: 534540 - protein, 11 aa, Influenza virus
PGFHFEECSCY

SEQ ID NO: 534541 - protein, 11 aa, Influenza virus
PGFVENLEELR

SEQ ID NO: 534542 - protein, 11 aa, Influenza virus
PGHNITFSHNG

SEQ ID NO: 534543 - protein, 11 aa, Influenza virus
PGIKGFAFLDG

SEQ ID NO: 534544 - protein, 11 aa, Influenza virus
PGIKGFGFLNE

SEQ ID NO: 534545 - protein, 11 aa, Influenza virus
PGKFTNEEALR

SEQ ID NO: 534546 - protein, 11 aa, Influenza virus
PGKQAKGLFGA

SEQ ID NO: 534547 - protein, 11 aa, Influenza virus
PGLINGWYGFQ

SEQ ID NO: 534548 - protein, 11 aa, Influenza virus
PGLVAGWYGFQ

SEQ ID NO: 534549 - protein, 11 aa, Influenza virus
PGMMMGMFNML

SEQ ID NO: 534550 - protein, 11 aa, Influenza virus
PGMQIRGFVHF

SEQ ID NO: 534551 - protein, 11 aa, Influenza virus
PGMQIRGFVYF

SEQ ID NO: 534552 - protein, 11 aa, Influenza virus
PGNAEIEDLIF

SEQ ID NO: 534553 - protein, 11 aa, Influenza virus
PGNAEIEDLTF

SEQ ID NO: 534554 - protein, 11 aa, Influenza virus
PGNFNDYEELK

SEQ ID NO: 534555 - protein, 11 aa, Influenza virus
PGNLIVFNTIG

SEQ ID NO: 534556 - protein, 11 aa, Influenza virus
PGNNBNGVKGF

SEQ ID NO: 534557 - protein, 11 aa, Influenza virus
PGNNNGVKGFS

SEQ ID NO: 534558 - protein, 11 aa, Influenza virus
PGNNNNGVKGF

SEQ ID NO: 534559 - protein, 11 aa, Influenza virus
PGQTVKIKTNG

SEQ ID NO: 534560 - protein, 11 aa, Influenza virus
PGQTVKIQTNG

SEQ ID NO: 534561 - protein, 11 aa, Influenza virus
PGQTVKIQTSG

SEQ ID NO: 534562 - protein, 11 aa, Influenza virus
PGRFTNEEALR

SEQ ID NO: 534563 - protein, 11 aa, Influenza virus
PGSFNDYEELK

SEQ ID NO: 534564 - protein, 11 aa, Influenza virus
PGSFNNYEELK

SEQ ID NO: 534565 - protein, 11 aa, Influenza virus
PGSFPDGAQIQ

SEQ ID NO: 534566 - protein, 11 aa, Influenza virus
PGSGHWPDGSN

SEQ ID NO: 534567 - protein, 11 aa, Influenza virus
PGSGNWPDGSD

SEQ ID NO: 534568 - protein, 11 aa, Influenza virus
PGSGNWPDGSN

SEQ ID NO: 534569 - protein, 11 aa, Influenza virus
PGSIENLEELR

SEQ ID NO: 534570 - protein, 11 aa, Influenza virus
PGSIENQEELK

SEQ ID NO: 534571 - protein, 11 aa, Influenza virus
PGSIENQEELR

SEQ ID NO: 534572 - protein, 11 aa, Influenza virus
PGSIKNQEELR

SEQ ID NO: 534573 - protein, 11 aa, Influenza virus
PGSLNDYEELK

SEQ ID NO: 534574 - protein, 11 aa, Influenza virus
PGSNNNGVKGF

SEQ ID NO: 534575 - protein, 11 aa, Influenza virus
PGSTVNEEALR

SEQ ID NO: 534576 - protein, 11 aa, Influenza virus
PGSVENLEELR

SEQ ID NO: 534577 - protein, 11 aa, Influenza virus
PGSVENQEELR

SEQ ID NO: 534578 - protein, 11 aa, Influenza virus
PGTKGFGFLNE

SEQ ID NO: 534579 - protein, 11 aa, Influenza virus
PGTTVNEEALR

SEQ ID NO: 534580 - protein, 11 aa, Influenza virus
PGVKGFAFLDE

SEQ ID NO: 534581 - protein, 11 aa, Influenza virus
PGVKGFAFLDG

SEQ ID NO: 534582 - protein, 11 aa, Influenza virus
PGVKGFAFLDR

SEQ ID NO: 534583 - protein, 11 aa, Influenza virus
PGVKGFAFLNG

SEQ ID NO: 534584 - protein, 11 aa, Influenza virus
PGVKGFGFLDG

SEQ ID NO: 534585 - protein, 11 aa, Influenza virus
PGVKGFGFLDN

SEQ ID NO: 534586 - protein, 11 aa, Influenza virus
PGVKGFGFLDS

SEQ ID NO: 534587 - protein, 11 aa, Influenza virus
PGVKGFGFLNG

SEQ ID NO: 534588 - protein, 11 aa, Influenza virus
PGVKGFGFLSG

SEQ ID NO: 534589 - protein, 11 aa, Influenza virus
PGVKGWAFDDG

SEQ ID NO: 534590 - protein, 11 aa, Influenza virus
PGVKGWAFDNG

SEQ ID NO: 534591 - protein, 11 aa, Influenza virus
PGVKGWAFDSG

SEQ ID NO: 534592 - protein, 11 aa, Influenza virus
PGVKGWAFDYG

SEQ ID NO: 534593 - protein, 11 aa, Influenza virus
PGVRCICRDNW

SEQ ID NO: 534594 - protein, 11 aa, Influenza virus
PGWLTIGITGP

SEQ ID NO: 534595 - protein, 11 aa, Influenza virus
PGWLTLGITGP

SEQ ID NO: 534596 - protein, 11 aa, Influenza virus
PGWSWDDGAIL

SEQ ID NO: 534597 - protein, 11 aa, Influenza virus
PGWSWGDGAIL

SEQ ID NO: 534598 - protein, 11 aa, Influenza virus
PGYNGQKSWMK

SEQ ID NO: 534599 - protein, 11 aa, Influenza virus
PGYNGQKSWTK

SEQ ID NO: 534600 - protein, 11 aa, Influenza virus
PGYNGQRSWMK

SEQ ID NO: 534601 - protein, 11 aa, Influenza virus
PGYQSLRSILA

SEQ ID NO: 534602 - protein, 11 aa, Influenza virus
PHGLCYPGELD

SEQ ID NO: 534603 - protein, 11 aa, Influenza virus
PHGLCYPGELN

SEQ ID NO: 534604 - protein, 11 aa, Influenza virus
PHLTGTWDTLI

SEQ ID NO: 534605 - protein, 11 aa, Influenza virus
PHRLCYPGELD

SEQ ID NO: 534606 - protein, 11 aa, Influenza virus
PHRTLLMNEIG

SEQ ID NO: 534607 - protein, 11 aa, Influenza virus
PHRTLLMNELG

SEQ ID NO: 534608 - protein, 11 aa, Influenza virus
PHRTLLMSELG

SEQ ID NO: 534609 - protein, 11 aa, Influenza virus
PIAFLTSSIVC

SEQ ID NO: 534610 - protein, 11 aa, Influenza virus
PIGCKMYALHQ

SEQ ID NO: 534611 - protein, 11 aa, Influenza virus
PIGEAPSPYNS

SEQ ID NO: 534612 - protein, 11 aa, Influenza virus
PIGEVPSPYNS

SEQ ID NO: 534613 - protein, 11 aa, Influenza virus
PIGISSMVEAM

SEQ ID NO: 534614 - protein, 11 aa, Influenza virus
PIGSGFFPDGP

SEQ ID NO: 534615 - protein, 11 aa, Influenza virus
PIGTAPILGNY

SEQ ID NO: 534616 - protein, 11 aa, Influenza virus
PIGTAPVLGNY

SEQ ID NO: 534617 - protein, 11 aa, Influenza virus
PIGVAPSPSNS

SEQ ID NO: 534618 - protein, 11 aa, Influenza virus
PIGVAPVLGNY

SEQ ID NO: 534619 - protein, 11 aa, Influenza virus
PIHLGDCSFEG

SEQ ID NO: 534620 - protein, 11 aa, Influenza virus
PIICLGHHAVE

SEQ ID NO: 534621 - protein, 11 aa, Influenza virus
PIKGWAPLSKD

SEQ ID NO: 534622 - protein, 11 aa, Influenza virus
PILNTSQRGIL

SEQ ID NO: 534623 - protein, 11 aa, Influenza virus
PILSPLTKGIL

SEQ ID NO: 534624 - protein, 11 aa, Influenza virus
PILSPLTKGML

SEQ ID NO: 534625 - protein, 11 aa, Influenza virus
PIMFSNKMAKL

SEQ ID NO: 534626 - protein, 11 aa, Influenza virus
PIMFSNKMARL

SEQ ID NO: 534627 - protein, 11 aa, Influenza virus
PIMFSNKVARL

SEQ ID NO: 534628 - protein, 11 aa, Influenza virus
PINNGKGRYGV

SEQ ID NO: 534629 - protein, 11 aa, Influenza virus
PINVTKENTGS

SEQ ID NO: 534630 - protein, 11 aa, Influenza virus
PIRGWAPLSKD

SEQ ID NO: 534631 - protein, 11 aa, Influenza virus
PISLGDCSFAG

SEQ ID NO: 534632 - protein, 11 aa, Influenza virus
PISLGDCSFTG

SEQ ID NO: 534633 - protein, 11 aa, Influenza virus
PISVGSGSFPD

SEQ ID NO: 534634 - protein, 11 aa, Influenza virus
PITEINTWARN

SEQ ID NO: 534635 - protein, 11 aa, Influenza virus
PITGSPGAPGV

SEQ ID NO: 534636 - protein, 11 aa, Influenza virus
PITGSPSAPGV

SEQ ID NO: 534637 - protein, 11 aa, Influenza virus
PITIGECPKYV

SEQ ID NO: 534638 - protein, 11 aa, Influenza virus
PKCDLYLNGRE

SEQ ID NO: 534639 - protein, 11 aa, Influenza virus
PKCDLYLSGRE

SEQ ID NO: 534640 - protein, 11 aa, Influenza virus
PKCDPYLNGRE

SEQ ID NO: 534641 - protein, 11 aa, Influenza virus
PKEDEVWWTSN

SEQ ID NO: 534642 - protein, 11 aa, Influenza virus
PKEDKVWWTSN

SEQ ID NO: 534643 - protein, 11 aa, Influenza virus
PKEDRVWWTSN

SEQ ID NO: 534644 - protein, 11 aa, Influenza virus
PKEEKVWWTSN

SEQ ID NO: 534645 - protein, 11 aa, Influenza virus
PKEIEGICYPG

SEQ ID NO: 534646 - protein, 11 aa, Influenza virus
PKEKAIWTSGS

SEQ ID NO: 534647 - protein, 11 aa, Influenza virus
PKEKTIWTSGS

SEQ ID NO: 534648 - protein, 11 aa, Influenza virus
PKEMEGICYPG

SEQ ID NO: 534649 - protein, 11 aa, Influenza virus
PKEMEGVCYPG

SEQ ID NO: 534650 - protein, 11 aa, Influenza virus
PKENPAHKSQL

SEQ ID NO: 534651 - protein, 11 aa, Influenza virus
PKERTIWTSGS

SEQ ID NO: 534652 - protein, 11 aa, Influenza virus
PKERTSIWTSS

SEQ ID NO: 534653 - protein, 11 aa, Influenza virus
PKETRVWWTSN

SEQ ID NO: 534654 - protein, 11 aa, Influenza virus
PKFLPDLYDYK

SEQ ID NO: 534655 - protein, 11 aa, Influenza virus
PKGLFGAIAGF

SEQ ID NO: 534656 - protein, 11 aa, Influenza virus
PKGRGLFGAIA

SEQ ID NO: 534657 - protein, 11 aa, Influenza virus
PKKRGLFGAIA

SEQ ID NO: 534658 - protein, 11 aa, Influenza virus
PKKTGGPIYKK

SEQ ID NO: 534659 - protein, 11 aa, Influenza virus
PKKTGGPIYKR

SEQ ID NO: 534660 - protein, 11 aa, Influenza virus
PKKTGGPIYRR

SEQ ID NO: 534661 - protein, 11 aa, Influenza virus
PKLRSGFEMLK

SEQ ID NO: 534662 - protein, 11 aa, Influenza virus
PKPRGLFGAIA

SEQ ID NO: 534663 - protein, 11 aa, Influenza virus
PKRNRSILNTS

SEQ ID NO: 534664 - protein, 11 aa, Influenza virus
PKSKLFTLSGV

SEQ ID NO: 534665 - protein, 11 aa, Influenza virus
PKSLPDLYDYK

SEQ ID NO: 534666 - protein, 11 aa, Influenza virus
PKTRGLFGAIA

SEQ ID NO: 534667 - protein, 11 aa, Influenza virus
PKVNGQAGRID

SEQ ID NO: 534668 - protein, 11 aa, Influenza virus
PKYEEESKLKR

SEQ ID NO: 534669 - protein, 11 aa, Influenza virus
PKYEEESKLNK

SEQ ID NO: 534670 - protein, 11 aa, Influenza virus
PKYEEESKLNR

SEQ ID NO: 534671 - protein, 11 aa, Influenza virus
PKYEEESRLNR

SEQ ID NO: 534672 - protein, 11 aa, Influenza virus
PKYEKESKLNR

SEQ ID NO: 534673 - protein, 11 aa, Influenza virus
PKYGYIIEEYG

SEQ ID NO: 534674 - protein, 11 aa, Influenza virus
PKYIKQGSLKL

SEQ ID NO: 534675 - protein, 11 aa, Influenza virus
PKYIKSDQLKL

SEQ ID NO: 534676 - protein, 11 aa, Influenza virus
PKYIKSGQLKL

SEQ ID NO: 534677 - protein, 11 aa, Influenza virus
PKYIPSGSLKL

SEQ ID NO: 534678 - protein, 11 aa, Influenza virus
PKYIPSNSLKL

SEQ ID NO: 534679 - protein, 11 aa, Influenza virus
PKYIPSRSLKL

SEQ ID NO: 534680 - protein, 11 aa, Influenza virus
PKYISSGSLKL

SEQ ID NO: 534681 - protein, 11 aa, Influenza virus
PKYLPDLYDYK

SEQ ID NO: 534682 - protein, 11 aa, Influenza virus
PKYMNVKSLKL

SEQ ID NO: 534683 - protein, 11 aa, Influenza virus
PKYVKQGSLKL

SEQ ID NO: 534684 - protein, 11 aa, Influenza virus
PKYVKQGSLML

SEQ ID NO: 534685 - protein, 11 aa, Influenza virus
PKYVKQGSLRL

SEQ ID NO: 534686 - protein, 11 aa, Influenza virus
PKYVKSDRLVL

SEQ ID NO: 534687 - protein, 11 aa, Influenza virus
PKYVKSEKLVL

SEQ ID NO: 534688 - protein, 11 aa, Influenza virus
PKYVKSERLVL

SEQ ID NO: 534689 - protein, 11 aa, Influenza virus
PKYVNIKSLKL

SEQ ID NO: 534690 - protein, 11 aa, Influenza virus
PKYVNVKSLKL

SEQ ID NO: 534691 - protein, 11 aa, Influenza virus
PKYVNVRSLKL

SEQ ID NO: 534692 - protein, 11 aa, Influenza virus
PKYVRSEKLVL

SEQ ID NO: 534693 - protein, 11 aa, Influenza virus
PLAGSAQHVEE

SEQ ID NO: 534694 - protein, 11 aa, Influenza virus
PLAIGECPKYV

SEQ ID NO: 534695 - protein, 11 aa, Influenza virus
PLAITWWNRNG

SEQ ID NO: 534696 - protein, 11 aa, Influenza virus
PLALGMKNVPE

SEQ ID NO: 534697 - protein, 11 aa, Influenza virus
PLASLLEMCHG

SEQ ID NO: 534698 - protein, 11 aa, Influenza virus
PLASLLEMCHS

SEQ ID NO: 534699 - protein, 11 aa, Influenza virus
PLAVTWWNRKG

SEQ ID NO: 534700 - protein, 11 aa, Influenza virus
PLAVTWWNRNG

SEQ ID NO: 534701 - protein, 11 aa, Influenza virus
PLAVTWWNRSG

SEQ ID NO: 534702 - protein, 11 aa, Influenza virus
PLCAVNSWHIL

SEQ ID NO: 534703 - protein, 11 aa, Influenza virus
PLCEVNSWHIF

SEQ ID NO: 534704 - protein, 11 aa, Influenza virus
PLCEVNSWHIL

SEQ ID NO: 534705 - protein, 11 aa, Influenza virus
PLCEVSSWHIL

SEQ ID NO: 534706 - protein, 11 aa, Influenza virus
PLCPFKGFFPF

SEQ ID NO: 534707 - protein, 11 aa, Influenza virus
PLCPFQGFFPF

SEQ ID NO: 534708 - protein, 11 aa, Influenza virus
PLCPFRGFFPF

SEQ ID NO: 534709 - protein, 11 aa, Influenza virus
PLELGDCSIAG

SEQ ID NO: 534710 - protein, 11 aa, Influenza virus
PLELGNCSIAG

SEQ ID NO: 534711 - protein, 11 aa, Influenza virus
PLELRDCKIEA

SEQ ID NO: 534712 - protein, 11 aa, Influenza virus
PLELRDCKVEA

SEQ ID NO: 534713 - protein, 11 aa, Influenza virus
PLELRDCSIAG

SEQ ID NO: 534714 - protein, 11 aa, Influenza virus
PLGAINTTLPF

SEQ ID NO: 534715 - protein, 11 aa, Influenza virus
PLGALNTTLPF

SEQ ID NO: 534716 - protein, 11 aa, Influenza virus
PLGCKMYALHQ

SEQ ID NO: 534717 - protein, 11 aa, Influenza virus
PLGCRMYALHQ

SEQ ID NO: 534718 - protein, 11 aa, Influenza virus
PLGEAPSPYNS

SEQ ID NO: 534719 - protein, 11 aa, Influenza virus
PLGSPPIVSNS

SEQ ID NO: 534720 - protein, 11 aa, Influenza virus
PLGSPPMVSNS

SEQ ID NO: 534721 - protein, 11 aa, Influenza virus
PLGSPPVVSNS

SEQ ID NO: 534722 - protein, 11 aa, Influenza virus
PLGSSPNAYQA

SEQ ID NO: 534723 - protein, 11 aa, Influenza virus
PLGTPPTVSNS

SEQ ID NO: 534724 - protein, 11 aa, Influenza virus
PLHNIHPLTIG

SEQ ID NO: 534725 - protein, 11 aa, Influenza virus
PLIKHENRMVL

SEQ ID NO: 534726 - protein, 11 aa, Influenza virus
PLILKDCSIAG

SEQ ID NO: 534727 - protein, 11 aa, Influenza virus
PLILKDCSVAG

SEQ ID NO: 534728 - protein, 11 aa, Influenza virus
PLILRDCSVAG

SEQ ID NO: 534729 - protein, 11 aa, Influenza virus
PLIRGQQGRMD

SEQ ID NO: 534730 - protein, 11 aa, Influenza virus
PLIRHENRMVI

SEQ ID NO: 534731 - protein, 11 aa, Influenza virus
PLIRHENRMVL

SEQ ID NO: 534732 - protein, 11 aa, Influenza virus
PLKAEIAQKLE

SEQ ID NO: 534733 - protein, 11 aa, Influenza virus
PLKAEIAQRLE

SEQ ID NO: 534734 - protein, 11 aa, Influenza virus
PLKLVDGQDCD

SEQ ID NO: 534735 - protein, 11 aa, Influenza virus
PLLSLLEMCHS

SEQ ID NO: 534736 - protein, 11 aa, Influenza virus
PLMVAYMLERE

SEQ ID NO: 534737 - protein, 11 aa, Influenza virus
PLPFQNIDSRA

SEQ ID NO: 534738 - protein, 11 aa, Influenza virus
PLPFQNIDSWA

SEQ ID NO: 534739 - protein, 11 aa, Influenza virus
PLPLCPFKGFF

SEQ ID NO: 534740 - protein, 11 aa, Influenza virus
PLPLCPFRGFF

SEQ ID NO: 534741 - protein, 11 aa, Influenza virus
PLQNASRHYMG

SEQ ID NO: 534742 - protein, 11 aa, Influenza virus
PLQNTSKHYIG

SEQ ID NO: 534743 - protein, 11 aa, Influenza virus
PLSGSAQHIEE

SEQ ID NO: 534744 - protein, 11 aa, Influenza virus
PLSGSAQHVEE

SEQ ID NO: 534745 - protein, 11 aa, Influenza virus
PLSISVGSSTY

SEQ ID NO: 534746 - protein, 11 aa, Influenza virus
PLSKDNGIRIG

SEQ ID NO: 534747 - protein, 11 aa, Influenza virus
PLSSPPTVYNN

SEQ ID NO: 534748 - protein, 11 aa, Influenza virus
PLSSPPTVYNS

SEQ ID NO: 534749 - protein, 11 aa, Influenza virus
PLSSPPTVYNT

SEQ ID NO: 534750 - protein, 11 aa, Influenza virus
PLTIGECPKYI

SEQ ID NO: 534751 - protein, 11 aa, Influenza virus
PLTIGECPKYV

SEQ ID NO: 534752 - protein, 11 aa, Influenza virus
PLTIGECPRYV

SEQ ID NO: 534753 - protein, 11 aa, Influenza virus
PLTIGKCPKYV

SEQ ID NO: 534754 - protein, 11 aa, Influenza virus
PLTKGILGFVF

SEQ ID NO: 534755 - protein, 11 aa, Influenza virus
PLTKGMLGFVF

SEQ ID NO: 534756 - protein, 11 aa, Influenza virus
PLTTTPTKSYF

SEQ ID NO: 534757 - protein, 11 aa, Influenza virus
PLVLDDCSLEG

SEQ ID NO: 534758 - protein, 11 aa, Influenza virus
PLVLDDCSLKG

SEQ ID NO: 534759 - protein, 11 aa, Influenza virus
PLVLGDCSIAG

SEQ ID NO: 534760 - protein, 11 aa, Influenza virus
PLVMGQQGRMD

SEQ ID NO: 534761 - protein, 11 aa, Influenza virus
PLVPCEPIIIE

SEQ ID NO: 534762 - protein, 11 aa, Influenza virus
PLVREQQGRMD

SEQ ID NO: 534763 - protein, 11 aa, Influenza virus
PLVRGQQGRMD

SEQ ID NO: 534764 - protein, 11 aa, Influenza virus
PLVRGQQGTMD

SEQ ID NO: 534765 - protein, 11 aa, Influenza virus
PLVRGQQGWMD

SEQ ID NO: 534766 - protein, 11 aa, Influenza virus
PMGFRYSGIKT

SEQ ID NO: 534767 - protein, 11 aa, Influenza virus
PMGSSPNAYQA

SEQ ID NO: 534768 - protein, 11 aa, Influenza virus
PMGTAPVLGNY

SEQ ID NO: 534769 - protein, 11 aa, Influenza virus
PMGVAPSPSNS

SEQ ID NO: 534770 - protein, 11 aa, Influenza virus
PMHQLLRHFQK

SEQ ID NO: 534771 - protein, 11 aa, Influenza virus
PMISKCKTKEG

SEQ ID NO: 534772 - protein, 11 aa, Influenza virus
PMISKCRTKEG

SEQ ID NO: 534773 - protein, 11 aa, Influenza virus
PMISKCRTREG

SEQ ID NO: 534774 - protein, 11 aa, Influenza virus
PMISKSRTKEG

SEQ ID NO: 534775 - protein, 11 aa, Influenza virus
PMISNCRTKEG

SEQ ID NO: 534776 - protein, 11 aa, Influenza virus
PMMWEINGPES

SEQ ID NO: 534777 - protein, 11 aa, Influenza virus
PMRTPIAFLTS

SEQ ID NO: 534778 - protein, 11 aa, Influenza virus
PNAGKDPKKTG

SEQ ID NO: 534779 - protein, 11 aa, Influenza virus
PNALLKHRFEI

SEQ ID NO: 534780 - protein, 11 aa, Influenza virus
PNALTDDKSKP

SEQ ID NO: 534781 - protein, 11 aa, Influenza virus
PNALTDDRSKP

SEQ ID NO: 534782 - protein, 11 aa, Influenza virus
PNALTDERSKP

SEQ ID NO: 534783 - protein, 11 aa, Influenza virus
PNALTDNRSKP

SEQ ID NO: 534784 - protein, 11 aa, Influenza virus
PNALTNDRSKP

SEQ ID NO: 534785 - protein, 11 aa, Influenza virus
PNAPHKLCFPG

SEQ ID NO: 534786 - protein, 11 aa, Influenza virus
PNAPHKLCYPG

SEQ ID NO: 534787 - protein, 11 aa, Influenza virus
PNAPNKFCYPG

SEQ ID NO: 534788 - protein, 11 aa, Influenza virus
PNAPNKLCFPG

SEQ ID NO: 534789 - protein, 11 aa, Influenza virus
PNAPNKLCYPG

SEQ ID NO: 534790 - protein, 11 aa, Influenza virus
PNAYQAKFESV

SEQ ID NO: 534791 - protein, 11 aa, Influenza virus
PNAYQAQFESV

SEQ ID NO: 534792 - protein, 11 aa, Influenza virus
PNAYQARFESV

SEQ ID NO: 534793 - protein, 11 aa, Influenza virus
PNDERGNPGVK

SEQ ID NO: 534794 - protein, 11 aa, Influenza virus
PNDGKVECVCR

SEQ ID NO: 534795 - protein, 11 aa, Influenza virus
PNDGQVLYFLI

SEQ ID NO: 534796 - protein, 11 aa, Influenza virus
PNDNASAVVWY

SEQ ID NO: 534797 - protein, 11 aa, Influenza virus
PNECRFYALSQ

SEQ ID NO: 534798 - protein, 11 aa, Influenza virus
PNEERGNPGVK

SEQ ID NO: 534799 - protein, 11 aa, Influenza virus
PNEERGSPGVK

SEQ ID NO: 534800 - protein, 11 aa, Influenza virus
PNEGKVECICR

SEQ ID NO: 534801 - protein, 11 aa, Influenza virus
PNEGKVECVCR

SEQ ID NO: 534802 - protein, 11 aa, Influenza virus
PNENPAHKSQL

SEQ ID NO: 534803 - protein, 11 aa, Influenza virus
PNENPVHKSQL

SEQ ID NO: 534804 - protein, 11 aa, Influenza virus
PNEVGAKILTS

SEQ ID NO: 534805 - protein, 11 aa, Influenza virus
PNEVGARIITS

SEQ ID NO: 534806 - protein, 11 aa, Influenza virus
PNEVGARILTS

SEQ ID NO: 534807 - protein, 11 aa, Influenza virus
PNFHYEECSCY

SEQ ID NO: 534808 - protein, 11 aa, Influenza virus
PNFYYEECSCY

SEQ ID NO: 534809 - protein, 11 aa, Influenza virus
PNGCIEGKLSQ

SEQ ID NO: 534810 - protein, 11 aa, Influenza virus
PNGCIESKLSQ

SEQ ID NO: 534811 - protein, 11 aa, Influenza virus
PNGTKVNTLTE

SEQ ID NO: 534812 - protein, 11 aa, Influenza virus
PNGYIEGKLSQ

SEQ ID NO: 534813 - protein, 11 aa, Influenza virus
PNHEGEGIPLY

SEQ ID NO: 534814 - protein, 11 aa, Influenza virus
PNIGPRALVRG

SEQ ID NO: 534815 - protein, 11 aa, Influenza virus
PNIGPRPFVRG

SEQ ID NO: 534816 - protein, 11 aa, Influenza virus
PNIGPRPLIRG

SEQ ID NO: 534817 - protein, 11 aa, Influenza virus
PNIGPRPLVMG

SEQ ID NO: 534818 - protein, 11 aa, Influenza virus
PNIGPRPLVRE

SEQ ID NO: 534819 - protein, 11 aa, Influenza virus
PNIGPRPLVRG

SEQ ID NO: 534820 - protein, 11 aa, Influenza virus
PNIGSRPRVRN

SEQ ID NO: 534821 - protein, 11 aa, Influenza virus
PNKWGDILDGV

SEQ ID NO: 534822 - protein, 11 aa, Influenza virus
PNKWGNVLDGV

SEQ ID NO: 534823 - protein, 11 aa, Influenza virus
PNLGIVECVCR

SEQ ID NO: 534824 - protein, 11 aa, Influenza virus
PNLGKVECVCR

SEQ ID NO: 534825 - protein, 11 aa, Influenza virus
PNLGQVECVCR

SEQ ID NO: 534826 - protein, 11 aa, Influenza virus
PNLYNIRNLHI

SEQ ID NO: 534827 - protein, 11 aa, Influenza virus
PNMGKVECVCR

SEQ ID NO: 534828 - protein, 11 aa, Influenza virus
PNNEKGNPGVK

SEQ ID NO: 534829 - protein, 11 aa, Influenza virus
PNNEKGNQGVK

SEQ ID NO: 534830 - protein, 11 aa, Influenza virus
PNNERGNPGVK

SEQ ID NO: 534831 - protein, 11 aa, Influenza virus
PNNERGNQGVK

SEQ ID NO: 534832 - protein, 11 aa, Influenza virus
PNNERGTQGVK

SEQ ID NO: 534833 - protein, 11 aa, Influenza virus
PNNERGYPGVK

SEQ ID NO: 534834 - protein, 11 aa, Influenza virus
PNNGKVECICR

SEQ ID NO: 534835 - protein, 11 aa, Influenza virus
PNNIDRAVKLY

SEQ ID NO: 534836 - protein, 11 aa, Influenza virus
PNNMARAVKLY

SEQ ID NO: 534837 - protein, 11 aa, Influenza virus
PNNMDKAVKLY

SEQ ID NO: 534838 - protein, 11 aa, Influenza virus
PNNMDRAVKLY

SEQ ID NO: 534839 - protein, 11 aa, Influenza virus
PNNNASAIVWY

SEQ ID NO: 534840 - protein, 11 aa, Influenza virus
PNNNASAVIWY

SEQ ID NO: 534841 - protein, 11 aa, Influenza virus
PNNNASAVVWY

SEQ ID NO: 534842 - protein, 11 aa, Influenza virus
PNNNASPVIWY

SEQ ID NO: 534843 - protein, 11 aa, Influenza virus
PNQKIICISAA

SEQ ID NO: 534844 - protein, 11 aa, Influenza virus
PNQKIICISAT

SEQ ID NO: 534845 - protein, 11 aa, Influenza virus
PNQKIICISTT

SEQ ID NO: 534846 - protein, 11 aa, Influenza virus
PNQKIITIGSA

SEQ ID NO: 534847 - protein, 11 aa, Influenza virus
PNQKIITIGSI

SEQ ID NO: 534848 - protein, 11 aa, Influenza virus
PNQKIITIGSM

SEQ ID NO: 534849 - protein, 11 aa, Influenza virus
PNQKIITIGSV

SEQ ID NO: 534850 - protein, 11 aa, Influenza virus
PNQKILCASAT

SEQ ID NO: 534851 - protein, 11 aa, Influenza virus
PNQKILCTSAI

SEQ ID NO: 534852 - protein, 11 aa, Influenza virus
PNQKILCTSAT

SEQ ID NO: 534853 - protein, 11 aa, Influenza virus
PNQKILFASAT

SEQ ID NO: 534854 - protein, 11 aa, Influenza virus
PNQKIMCISAT

SEQ ID NO: 534855 - protein, 11 aa, Influenza virus
PNQKITCISAT

SEQ ID NO: 534856 - protein, 11 aa, Influenza virus
PNQKLFALSGV

SEQ ID NO: 534857 - protein, 11 aa, Influenza virus
PNQKLFASSGI

SEQ ID NO: 534858 - protein, 11 aa, Influenza virus
PNQKLFTLSGV

SEQ ID NO: 534859 - protein, 11 aa, Influenza virus
PNQMIITIGSA

SEQ ID NO: 534860 - protein, 11 aa, Influenza virus
PNQRILCTSAT

SEQ ID NO: 534861 - protein, 11 aa, Influenza virus
PNQSIITIGSA

SEQ ID NO: 534862 - protein, 11 aa, Influenza virus
PNSGKVECVCR

SEQ ID NO: 534863 - protein, 11 aa, Influenza virus
PNSHYEECSCY

SEQ ID NO: 534864 - protein, 11 aa, Influenza virus
PNTLLKHRFEI

SEQ ID NO: 534865 - protein, 11 aa, Influenza virus
PNVLLKHRFEI

SEQ ID NO: 534866 - protein, 11 aa, Influenza virus
PNVRCVCRDNW

SEQ ID NO: 534867 - protein, 11 aa, Influenza virus
PNWSGYSGSFT

SEQ ID NO: 534868 - protein, 11 aa, Influenza virus
PNYHYEECSCY

SEQ ID NO: 534869 - protein, 11 aa, Influenza virus
PNYQSLRSILA

SEQ ID NO: 534870 - protein, 11 aa, Influenza virus
PNYYYEECSCY

SEQ ID NO: 534871 - protein, 11 aa, Influenza virus
PPEQSKMQFSS

SEQ ID NO: 534872 - protein, 11 aa, Influenza virus
PPEQSRMQFSS

SEQ ID NO: 534873 - protein, 11 aa, Influenza virus
PPKQSRMQFSS

SEQ ID NO: 534874 - protein, 11 aa, Influenza virus
PPLELGDCSIA

SEQ ID NO: 534875 - protein, 11 aa, Influenza virus
PPLELGDCSIT

SEQ ID NO: 534876 - protein, 11 aa, Influenza virus
PPLELRDCSIA

SEQ ID NO: 534877 - protein, 11 aa, Influenza virus
PPLVLGDCSIA

SEQ ID NO: 534878 - protein, 11 aa, Influenza virus
PPQCDLHLEFK

SEQ ID NO: 534879 - protein, 11 aa, Influenza virus
PPQCDSHLKFK

SEQ ID NO: 534880 - protein, 11 aa, Influenza virus
PPVNGQSGRID

SEQ ID NO: 534881 - protein, 11 aa, Influenza virus
PPVQSKMQFSS

SEQ ID NO: 534882 - protein, 11 aa, Influenza virus
PPVQSRMQFSS

SEQ ID NO: 534883 - protein, 11 aa, Influenza virus
PPYSHGTGTGY

SEQ ID NO: 534884 - protein, 11 aa, Influenza virus
PQAQDRGLFGA

SEQ ID NO: 534885 - protein, 11 aa, Influenza virus
PQAQNRGLFGA

SEQ ID NO: 534886 - protein, 11 aa, Influenza virus
PQCDLHLEFKA

SEQ ID NO: 534887 - protein, 11 aa, Influenza virus
PQCDSHLKFKA

SEQ ID NO: 534888 - protein, 11 aa, Influenza virus
PQCEITGFAPF

SEQ ID NO: 534889 - protein, 11 aa, Influenza virus
PQCKITGFAPF

SEQ ID NO: 534890 - protein, 11 aa, Influenza virus
PQCQIAGFAPF

SEQ ID NO: 534891 - protein, 11 aa, Influenza virus
PQCQITGFAPF

SEQ ID NO: 534892 - protein, 11 aa, Influenza virus
PQCQVTGFAPF

SEQ ID NO: 534893 - protein, 11 aa, Influenza virus
PQENRVWWTSN

SEQ ID NO: 534894 - protein, 11 aa, Influenza virus
PQETKVWWTSN

SEQ ID NO: 534895 - protein, 11 aa, Influenza virus
PQETRVWWTSN

SEQ ID NO: 534896 - protein, 11 aa, Influenza virus
PQETRVWWTSS

SEQ ID NO: 534897 - protein, 11 aa, Influenza virus
PQIEARGLFGA

SEQ ID NO: 534898 - protein, 11 aa, Influenza virus
PQIEPRGLFGA

SEQ ID NO: 534899 - protein, 11 aa, Influenza virus
PQIESRGLFGA

SEQ ID NO: 534900 - protein, 11 aa, Influenza virus
PQINGQSGRID

SEQ ID NO: 534901 - protein, 11 aa, Influenza virus
PQIQNRGLFGA

SEQ ID NO: 534902 - protein, 11 aa, Influenza virus
PQLEGFSAESR

SEQ ID NO: 534903 - protein, 11 aa, Influenza virus
PQLNPIDGPLP

SEQ ID NO: 534904 - protein, 11 aa, Influenza virus
PQLNQTYRNNR

SEQ ID NO: 534905 - protein, 11 aa, Influenza virus
PQLNQTYRNTR

SEQ ID NO: 534906 - protein, 11 aa, Influenza virus
PQMESRGLFGA

SEQ ID NO: 534907 - protein, 11 aa, Influenza virus
PQMNGQSGRID

SEQ ID NO: 534908 - protein, 11 aa, Influenza virus
PQSGRIVVDYM

SEQ ID NO: 534909 - protein, 11 aa, Influenza virus
PQSSPPTVYNS

SEQ ID NO: 534910 - protein, 11 aa, Influenza virus
PQTANTYRNTD

SEQ ID NO: 534911 - protein, 11 aa, Influenza virus
PQTESRGLFGA

SEQ ID NO: 534912 - protein, 11 aa, Influenza virus
PQTTNTYRNTD

SEQ ID NO: 534913 - protein, 11 aa, Influenza virus
PQVNGQFGRID

SEQ ID NO: 534914 - protein, 11 aa, Influenza virus
PQVNGQSGRID

SEQ ID NO: 534915 - protein, 11 aa, Influenza virus
PQVNGQSGRIN

SEQ ID NO: 534916 - protein, 11 aa, Influenza virus
PQVQDRGLFGA

SEQ ID NO: 534917 - protein, 11 aa, Influenza virus
PQVQNRGLFGA

SEQ ID NO: 534918 - protein, 11 aa, Influenza virus
PQYPNVRCVCR

SEQ ID NO: 534919 - protein, 11 aa, Influenza virus
PRALVRGQQGR

SEQ ID NO: 534920 - protein, 11 aa, Influenza virus
PRFLPDLYDYK

SEQ ID NO: 534921 - protein, 11 aa, Influenza virus
PRGHYKISKST

SEQ ID NO: 534922 - protein, 11 aa, Influenza virus
PRGLFGAIAGF

SEQ ID NO: 534923 - protein, 11 aa, Influenza virus
PRGLLEVGTRW

SEQ ID NO: 534924 - protein, 11 aa, Influenza virus
PRIFLAMITYI

SEQ ID NO: 534925 - protein, 11 aa, Influenza virus
PRLLQNSQVFS

SEQ ID NO: 534926 - protein, 11 aa, Influenza virus
PRLRSGFEMLK

SEQ ID NO: 534927 - protein, 11 aa, Influenza virus
PRMCSLMQGST

SEQ ID NO: 534928 - protein, 11 aa, Influenza virus
PRMFLAMITYI

SEQ ID NO: 534929 - protein, 11 aa, Influenza virus
PRNDDSSSNSN

SEQ ID NO: 534930 - protein, 11 aa, Influenza virus
PRNDDSSSSSN

SEQ ID NO: 534931 - protein, 11 aa, Influenza virus
PRNEDGSSSSN

SEQ ID NO: 534932 - protein, 11 aa, Influenza virus
PRNEDSSSNSN

SEQ ID NO: 534933 - protein, 11 aa, Influenza virus
PRNEDSSSSSN

SEQ ID NO: 534934 - protein, 11 aa, Influenza virus
PRPFVRGQQGR

SEQ ID NO: 534935 - protein, 11 aa, Influenza virus
PRPLIRGQQGR

SEQ ID NO: 534936 - protein, 11 aa, Influenza virus
PRPLVMGQQGR

SEQ ID NO: 534937 - protein, 11 aa, Influenza virus
PRPLVREQQGR

SEQ ID NO: 534938 - protein, 11 aa, Influenza virus
PRPLVRGQQGR

SEQ ID NO: 534939 - protein, 11 aa, Influenza virus
PRPLVRGQQGT

SEQ ID NO: 534940 - protein, 11 aa, Influenza virus
PRPLVRGQQGW

SEQ ID NO: 534941 - protein, 11 aa, Influenza virus
PRPRRGLFGAI

SEQ ID NO: 534942 - protein, 11 aa, Influenza virus
PRRGLFGAIAG

SEQ ID NO: 534943 - protein, 11 aa, Influenza virus
PRRSGAAGAAI

SEQ ID NO: 534944 - protein, 11 aa, Influenza virus
PRRSGAAGAAV

SEQ ID NO: 534945 - protein, 11 aa, Influenza virus
PRSRNGFEMLK

SEQ ID NO: 534946 - protein, 11 aa, Influenza virus
PRSRSGFEMLK

SEQ ID NO: 534947 - protein, 11 aa, Influenza virus
PRSRSGFEMLR

SEQ ID NO: 534948 - protein, 11 aa, Influenza virus
PRTFLAMITYI

SEQ ID NO: 534949 - protein, 11 aa, Influenza virus
PRTREILTKTT

SEQ ID NO: 534950 - protein, 11 aa, Influenza virus
PRTTNTYRNTD

SEQ ID NO: 534951 - protein, 11 aa, Influenza virus
PRTVGQCPKYV

SEQ ID NO: 534952 - protein, 11 aa, Influenza virus
PRVFLAMITYI

SEQ ID NO: 534953 - protein, 11 aa, Influenza virus
PRVFLTMITYI

SEQ ID NO: 534954 - protein, 11 aa, Influenza virus
PRVRNQSGRIS

SEQ ID NO: 534955 - protein, 11 aa, Influenza virus
PRYGYIIEEYG

SEQ ID NO: 534956 - protein, 11 aa, Influenza virus
PRYGYIIEKYG

SEQ ID NO: 534957 - protein, 11 aa, Influenza virus
PRYIPSGSLKL

SEQ ID NO: 534958 - protein, 11 aa, Influenza virus
PRYLPDLYDYK

SEQ ID NO: 534959 - protein, 11 aa, Influenza virus
PRYNGQRSWMK

SEQ ID NO: 534960 - protein, 11 aa, Influenza virus
PRYPDVRCVCR

SEQ ID NO: 534961 - protein, 11 aa, Influenza virus
PRYPNVRCVCR

SEQ ID NO: 534962 - protein, 11 aa, Influenza virus
PRYVKQGSLKL

SEQ ID NO: 534963 - protein, 11 aa, Influenza virus
PRYVKQSSLPL

SEQ ID NO: 534964 - protein, 11 aa, Influenza virus
PRYVKSEKLVL

SEQ ID NO: 534965 - protein, 11 aa, Influenza virus
PSAGKDPKKTG

SEQ ID NO: 534966 - protein, 11 aa, Influenza virus
PSAGRDPKKTG

SEQ ID NO: 534967 - protein, 11 aa, Influenza virus
PSAIDQITGKL

SEQ ID NO: 534968 - protein, 11 aa, Influenza virus
PSAPEGMCYPG

SEQ ID NO: 534969 - protein, 11 aa, Influenza virus
PSAPGVKGFGF

SEQ ID NO: 534970 - protein, 11 aa, Influenza virus
PSAPHGLCYPG

SEQ ID NO: 534971 - protein, 11 aa, Influenza virus
PSAPHRLCYPG

SEQ ID NO: 534972 - protein, 11 aa, Influenza virus
PSCASNINIRE

SEQ ID NO: 534973 - protein, 11 aa, Influenza virus
PSCATNINIRE

SEQ ID NO: 534974 - protein, 11 aa, Influenza virus
PSDAQAFYKIL

SEQ ID NO: 534975 - protein, 11 aa, Influenza virus
PSDAQAFYKLL

SEQ ID NO: 534976 - protein, 11 aa, Influenza virus
PSDTPRGEDAQ

SEQ ID NO: 534977 - protein, 11 aa, Influenza virus
PSDTPRGEDGQ

SEQ ID NO: 534978 - protein, 11 aa, Influenza virus
PSDTPRGEDNQ

SEQ ID NO: 534979 - protein, 11 aa, Influenza virus
PSDTPRGEDSQ

SEQ ID NO: 534980 - protein, 11 aa, Influenza virus
PSECRTFFLTQ

SEQ ID NO: 534981 - protein, 11 aa, Influenza virus
PSERGLQRRRF

SEQ ID NO: 534982 - protein, 11 aa, Influenza virus
PSFFRNMIWLT

SEQ ID NO: 534983 - protein, 11 aa, Influenza virus
PSFFRNMVWLT

SEQ ID NO: 534984 - protein, 11 aa, Influenza virus
PSFGVSGINES

SEQ ID NO: 534985 - protein, 11 aa, Influenza virus
PSFGVSGVNES

SEQ ID NO: 534986 - protein, 11 aa, Influenza virus
PSFYAEMKWLL

SEQ ID NO: 534987 - protein, 11 aa, Influenza virus
PSGCKMYALHQ

SEQ ID NO: 534988 - protein, 11 aa, Influenza virus
PSGIEYNGKSL

SEQ ID NO: 534989 - protein, 11 aa, Influenza virus
PSGPLKAEIAQ

SEQ ID NO: 534990 - protein, 11 aa, Influenza virus
PSGSLKLAIGL

SEQ ID NO: 534991 - protein, 11 aa, Influenza virus
PSGSLKLAIGP

SEQ ID NO: 534992 - protein, 11 aa, Influenza virus
PSGVEYNGKSL

SEQ ID NO: 534993 - protein, 11 aa, Influenza virus
PSGYAQTDCVL

SEQ ID NO: 534994 - protein, 11 aa, Influenza virus
PSHEGEGIPLC

SEQ ID NO: 534995 - protein, 11 aa, Influenza virus
PSHEGEGIPLH

SEQ ID NO: 534996 - protein, 11 aa, Influenza virus
PSHEGEGIPLY

SEQ ID NO: 534997 - protein, 11 aa, Influenza virus
PSIDPKGLFGA

SEQ ID NO: 534998 - protein, 11 aa, Influenza virus
PSIEPKGLFGA

SEQ ID NO: 534999 - protein, 11 aa, Influenza virus
PSIEPRGLFGA

SEQ ID NO: 535000 - protein, 11 aa, Influenza virus
PSIMSCDSPSN

SEQ ID NO: 535001 - protein, 11 aa, Influenza virus
PSIQSRGLFGA

SEQ ID NO: 535002 - protein, 11 aa, Influenza virus
PSIWTSSSSTV

SEQ ID NO: 535003 - protein, 11 aa, Influenza virus
PSKWGDILEGT

SEQ ID NO: 535004 - protein, 11 aa, Influenza virus
PSKWGDVLDGV

SEQ ID NO: 535005 - protein, 11 aa, Influenza virus
PSKWGNVLDGV

SEQ ID NO: 535006 - protein, 11 aa, Influenza virus
PSLRMKWMMAM

SEQ ID NO: 535007 - protein, 11 aa, Influenza virus
PSNAQAFYKIL

SEQ ID NO: 535008 - protein, 11 aa, Influenza virus
PSNMDRAVKLY

SEQ ID NO: 535009 - protein, 11 aa, Influenza virus
PSNSLKLAIGL

SEQ ID NO: 535010 - protein, 11 aa, Influenza virus
PSNSRFESVAW

SEQ ID NO: 535011 - protein, 11 aa, Influenza virus
PSPGARPKVNG

SEQ ID NO: 535012 - protein, 11 aa, Influenza virus
PSPGDRPKVNG

SEQ ID NO: 535013 - protein, 11 aa, Influenza virus
PSPLKLVDGQD

SEQ ID NO: 535014 - protein, 11 aa, Influenza virus
PSPSNSRFESV

SEQ ID NO: 535015 - protein, 11 aa, Influenza virus
PSPYNSKFESV

SEQ ID NO: 535016 - protein, 11 aa, Influenza virus
PSPYNSRFESV

SEQ ID NO: 535017 - protein, 11 aa, Influenza virus
PSQKLFALSGV

SEQ ID NO: 535018 - protein, 11 aa, Influenza virus
PSRSLKLAIGL

SEQ ID NO: 535019 - protein, 11 aa, Influenza virus
PSSAQEKNDLY

SEQ ID NO: 535020 - protein, 11 aa, Influenza virus
PSSDNEQTDLY

SEQ ID NO: 535021 - protein, 11 aa, Influenza virus
PSSSYRRPIGI

SEQ ID NO: 535022 - protein, 11 aa, Influenza virus
PSSSYRRPVGI

SEQ ID NO: 535023 - protein, 11 aa, Influenza virus
PSSTKEKNDLY

SEQ ID NO: 535024 - protein, 11 aa, Influenza virus
PSSTKEKNELY

SEQ ID NO: 535025 - protein, 11 aa, Influenza virus
PSSTQEKNDLY

SEQ ID NO: 535026 - protein, 11 aa, Influenza virus
PSSTQERNDLY

SEQ ID NO: 535027 - protein, 11 aa, Influenza virus
PSTGKDPKKTG

SEQ ID NO: 535028 - protein, 11 aa, Influenza virus
PSTGNHGSLVL

SEQ ID NO: 535029 - protein, 11 aa, Influenza virus
PSTISCDSPSN

SEQ ID NO: 535030 - protein, 11 aa, Influenza virus
PSTMSCDSPSN

SEQ ID NO: 535031 - protein, 11 aa, Influenza virus
PSTVSCDSPSN

SEQ ID NO: 535032 - protein, 11 aa, Influenza virus
PSVEPKGLFGA

SEQ ID NO: 535033 - protein, 11 aa, Influenza virus
PSVEPRGLFGA

SEQ ID NO: 535034 - protein, 11 aa, Influenza virus
PSVKLPMGAIN

SEQ ID NO: 535035 - protein, 11 aa, Influenza virus
PSVQSRGLFGA

SEQ ID NO: 535036 - protein, 11 aa, Influenza virus
PSVVSCDSPSN

SEQ ID NO: 535037 - protein, 11 aa, Influenza virus
PSWAGNILRTQ

SEQ ID NO: 535038 - protein, 11 aa, Influenza virus
PSWAGNVLRTQ

SEQ ID NO: 535039 - protein, 11 aa, Influenza virus
PSWEGNILRTQ

SEQ ID NO: 535040 - protein, 11 aa, Influenza virus
PTAPHGLCYPG

SEQ ID NO: 535041 - protein, 11 aa, Influenza virus
PTAVDTCYPFD

SEQ ID NO: 535042 - protein, 11 aa, Influenza virus
PTDTPRGEDSQ

SEQ ID NO: 535043 - protein, 11 aa, Influenza virus
PTDVIRSWRKQ

SEQ ID NO: 535044 - protein, 11 aa, Influenza virus
PTDVVRSWKKQ

SEQ ID NO: 535045 - protein, 11 aa, Influenza virus
PTDVVRSWRKK

SEQ ID NO: 535046 - protein, 11 aa, Influenza virus
PTDVVRSWRKQ

SEQ ID NO: 535047 - protein, 11 aa, Influenza virus
PTDVVRSWRRQ

SEQ ID NO: 535048 - protein, 11 aa, Influenza virus
PTECRTFFLTQ

SEQ ID NO: 535049 - protein, 11 aa, Influenza virus
PTEEQAVDICK

SEQ ID NO: 535050 - protein, 11 aa, Influenza virus
PTEEQAVEICK

SEQ ID NO: 535051 - protein, 11 aa, Influenza virus
PTEEQAVGICK

SEQ ID NO: 535052 - protein, 11 aa, Influenza virus
PTEEQAVNICK

SEQ ID NO: 535053 - protein, 11 aa, Influenza virus
PTFDSLNITAA

SEQ ID NO: 535054 - protein, 11 aa, Influenza virus
PTFSVQRNLPF

SEQ ID NO: 535055 - protein, 11 aa, Influenza virus
PTFSVQRSLPF

SEQ ID NO: 535056 - protein, 11 aa, Influenza virus
PTGCKMYALHQ

SEQ ID NO: 535057 - protein, 11 aa, Influenza virus
PTGYAQTDCVL

SEQ ID NO: 535058 - protein, 11 aa, Influenza virus
PTKSYFANLKG

SEQ ID NO: 535059 - protein, 11 aa, Influenza virus
PTTEINTWARN

SEQ ID NO: 535060 - protein, 11 aa, Influenza virus
PTWAGNILRTQ

SEQ ID NO: 535061 - protein, 11 aa, Influenza virus
PVAEINTWARN

SEQ ID NO: 535062 - protein, 11 aa, Influenza virus
PVAKAGFIENG

SEQ ID NO: 535063 - protein, 11 aa, Influenza virus
PVGEAPSPYNS

SEQ ID NO: 535064 - protein, 11 aa, Influenza virus
PVGGNEKKAKL

SEQ ID NO: 535065 - protein, 11 aa, Influenza virus
PVGISSMGEAM

SEQ ID NO: 535066 - protein, 11 aa, Influenza virus
PVGISSMMEAM

SEQ ID NO: 535067 - protein, 11 aa, Influenza virus
PVGISSMVEAM

SEQ ID NO: 535068 - protein, 11 aa, Influenza virus
PVGPGSFPDGA

SEQ ID NO: 535069 - protein, 11 aa, Influenza virus
PVGSGSFPDGA

SEQ ID NO: 535070 - protein, 11 aa, Influenza virus
PVGTAPVLGNY

SEQ ID NO: 535071 - protein, 11 aa, Influenza virus
PVGVAPSPSNS

SEQ ID NO: 535072 - protein, 11 aa, Influenza virus
PVHFQNQVKIR

SEQ ID NO: 535073 - protein, 11 aa, Influenza virus
PVHFRNQIKIR

SEQ ID NO: 535074 - protein, 11 aa, Influenza virus
PVHFRNQVKIR

SEQ ID NO: 535075 - protein, 11 aa, Influenza virus
PVHFRSQVKIR

SEQ ID NO: 535076 - protein, 11 aa, Influenza virus
PVHKSQLIWMA

SEQ ID NO: 535077 - protein, 11 aa, Influenza virus
PVHKSQLVWMA

SEQ ID NO: 535078 - protein, 11 aa, Influenza virus
PVHLGDCNFEG

SEQ ID NO: 535079 - protein, 11 aa, Influenza virus
PVHLGDCRFEG

SEQ ID NO: 535080 - protein, 11 aa, Influenza virus
PVHLGDCSFEG

SEQ ID NO: 535081 - protein, 11 aa, Influenza virus
PVIGARPQVNG

SEQ ID NO: 535082 - protein, 11 aa, Influenza virus
PVKGWAPLSKD

SEQ ID NO: 535083 - protein, 11 aa, Influenza virus
PVKLSGGYKDI

SEQ ID NO: 535084 - protein, 11 aa, Influenza virus
PVKLSGGYKDV

SEQ ID NO: 535085 - protein, 11 aa, Influenza virus
PVKLSSGYKDI

SEQ ID NO: 535086 - protein, 11 aa, Influenza virus
PVKLSSGYKDV

SEQ ID NO: 535087 - protein, 11 aa, Influenza virus
PVLTDNPRPND

SEQ ID NO: 535088 - protein, 11 aa, Influenza virus
PVMGARPQVNG

SEQ ID NO: 535089 - protein, 11 aa, Influenza virus
PVNGQSGRIDF

SEQ ID NO: 535090 - protein, 11 aa, Influenza virus
PVNNGKGRYGV

SEQ ID NO: 535091 - protein, 11 aa, Influenza virus
PVPVGSGSFPD

SEQ ID NO: 535092 - protein, 11 aa, Influenza virus
PVQGFFPFHKD

SEQ ID NO: 535093 - protein, 11 aa, Influenza virus
PVQNAISTTFP

SEQ ID NO: 535094 - protein, 11 aa, Influenza virus
PVQTDEYKNTG

SEQ ID NO: 535095 - protein, 11 aa, Influenza virus
PVQTDEYKNTR

SEQ ID NO: 535096 - protein, 11 aa, Influenza virus
PVSVGSGSFPD

SEQ ID NO: 535097 - protein, 11 aa, Influenza virus
PVTEINTWARN

SEQ ID NO: 535098 - protein, 11 aa, Influenza virus
PVTIGECPKYV

SEQ ID NO: 535099 - protein, 11 aa, Influenza virus
PVTIGKCPKYV

SEQ ID NO: 535100 - protein, 11 aa, Influenza virus
PVTLTMGYKDI

SEQ ID NO: 535101 - protein, 11 aa, Influenza virus
PVTQAMELVEA

SEQ ID NO: 535102 - protein, 11 aa, Influenza virus
PVTQTMELVEA

SEQ ID NO: 535103 - protein, 11 aa, Influenza virus
PVTQTMELVET

SEQ ID NO: 535104 - protein, 11 aa, Influenza virus
PVTQVEELVHG

SEQ ID NO: 535105 - protein, 11 aa, Influenza virus
PVTQVEELVHR

SEQ ID NO: 535106 - protein, 11 aa, Influenza virus
PVTSSIDLIET

SEQ ID NO: 535107 - protein, 11 aa, Influenza virus
PVTSSIDLVET

SEQ ID NO: 535108 - protein, 11 aa, Influenza virus
PVTSSVDLIET

SEQ ID NO: 535109 - protein, 11 aa, Influenza virus
PVTSSVDLVET

SEQ ID NO: 535110 - protein, 11 aa, Influenza virus
PVTSTIDLIET

SEQ ID NO: 535111 - protein, 11 aa, Influenza virus
PVVFTDGSATG

SEQ ID NO: 535112 - protein, 11 aa, Influenza virus
PVVGARPKVNG

SEQ ID NO: 535113 - protein, 11 aa, Influenza virus
PVVGARPQVNG

SEQ ID NO: 535114 - protein, 11 aa, Influenza virus
PVVRARPQVNG

SEQ ID NO: 535115 - protein, 11 aa, Influenza virus
PWARNILRTQE

SEQ ID NO: 535116 - protein, 11 aa, Influenza virus
PWIRFNSDLDY

SEQ ID NO: 535117 - protein, 11 aa, Influenza virus
PWIRFNSDPDY

SEQ ID NO: 535118 - protein, 11 aa, Influenza virus
PWIRFNSNLDY

SEQ ID NO: 535119 - protein, 11 aa, Influenza virus
PWIRINNETIL

SEQ ID NO: 535120 - protein, 11 aa, Influenza virus
PWMRINNETIL

SEQ ID NO: 535121 - protein, 11 aa, Influenza virus
PWMRINNETIV

SEQ ID NO: 535122 - protein, 11 aa, Influenza virus
PWMRISNETIL

SEQ ID NO: 535123 - protein, 11 aa, Influenza virus
PWVLLNASWFN

SEQ ID NO: 535124 - protein, 11 aa, Influenza virus
PWVRFNSDLDY

SEQ ID NO: 535125 - protein, 11 aa, Influenza virus
PWVRINNETIL

SEQ ID NO: 535126 - protein, 11 aa, Influenza virus
PYIGKCPKYIP

SEQ ID NO: 535127 - protein, 11 aa, Influenza virus
PYLNGREWSYI

SEQ ID NO: 535128 - protein, 11 aa, Influenza virus
PYNSKFESVAW

SEQ ID NO: 535129 - protein, 11 aa, Influenza virus
PYNSRFESVAW

SEQ ID NO: 535130 - protein, 11 aa, Influenza virus
PYPGNNBNGVK

SEQ ID NO: 535131 - protein, 11 aa, Influenza virus
PYPGNNNKGVK

SEQ ID NO: 535132 - protein, 11 aa, Influenza virus
PYPGNNNNGVK

SEQ ID NO: 535133 - protein, 11 aa, Influenza virus
PYPGSNNNGVK

SEQ ID NO: 535134 - protein, 11 aa, Influenza virus
PYRALISWEMG

SEQ ID NO: 535135 - protein, 11 aa, Influenza virus
PYRALMSVPLG

SEQ ID NO: 535136 - protein, 11 aa, Influenza virus
PYRALMSVPMG

SEQ ID NO: 535137 - protein, 11 aa, Influenza virus
PYRSLIQFPIG

SEQ ID NO: 535138 - protein, 11 aa, Influenza virus
PYRSLIQFPMG

SEQ ID NO: 535139 - protein, 11 aa, Influenza virus
PYRSLIRFPIG

SEQ ID NO: 535140 - protein, 11 aa, Influenza virus
PYRSLIRFPVG

SEQ ID NO: 535141 - protein, 11 aa, Influenza virus
PYRTLLMNELG

SEQ ID NO: 535142 - protein, 11 aa, Influenza virus
PYRTLLMSELG

SEQ ID NO: 535143 - protein, 11 aa, Influenza virus
PYSHGTGTGYT

SEQ ID NO: 535144 - protein, 11 aa, Influenza virus
PYTGDPPYSHG

SEQ ID NO: 535145 - protein, 11 aa, Influenza virus
PYTLVSTGSWS

SEQ ID NO: 535146 - protein, 11 aa, Influenza virus
PYTLVSTKEWS

SEQ ID NO: 535147 - protein, 11 aa, Influenza virus
PYTLVSTKSWS

SEQ ID NO: 535148 - protein, 11 aa, Influenza virus
PYTLVSTRSWS

SEQ ID NO: 535149 - protein, 11 aa, Influenza virus
PYTLVSTSSWS

SEQ ID NO: 535150 - protein, 11 aa, Influenza virus
PYTLVTTSSWS

SEQ ID NO: 535151 - protein, 11 aa, Influenza virus
PYVSCDPDECR

SEQ ID NO: 535152 - protein, 11 aa, Influenza virus
PYVSCDPDGCR

SEQ ID NO: 535153 - protein, 11 aa, Influenza virus
PYVSCDPLGCK

SEQ ID NO: 535154 - protein, 11 aa, Influenza virus
PYVSCDPLGCR

SEQ ID NO: 535155 - protein, 11 aa, Influenza virus
PYVSCDPNECR

SEQ ID NO: 535156 - protein, 11 aa, Influenza virus
PYVSCDPSGCK

SEQ ID NO: 535157 - protein, 11 aa, Influenza virus
PYVSCDPTGCK

SEQ ID NO: 535158 - protein, 11 aa, Influenza virus
PYVSCEPDECR

SEQ ID NO: 535159 - protein, 11 aa, Influenza virus
QAADLKSTQAA

SEQ ID NO: 535160 - protein, 11 aa, Influenza virus
QAADLKSTQTA

SEQ ID NO: 535161 - protein, 11 aa, Influenza virus
QAADYESTQAA

SEQ ID NO: 535162 - protein, 11 aa, Influenza virus
QAADYKSTQAA

SEQ ID NO: 535163 - protein, 11 aa, Influenza virus
QAADYKSTQAT

SEQ ID NO: 535164 - protein, 11 aa, Influenza virus
QAADYKSTQKT

SEQ ID NO: 535165 - protein, 11 aa, Influenza virus
QAADYKSTQTA

SEQ ID NO: 535166 - protein, 11 aa, Influenza virus
QAAIDQINGKL

SEQ ID NO: 535167 - protein, 11 aa, Influenza virus
QAAIDQISGKL

SEQ ID NO: 535168 - protein, 11 aa, Influenza virus
QAAIDQITGKL

SEQ ID NO: 535169 - protein, 11 aa, Influenza virus
QAAIDQVNGKL

SEQ ID NO: 535170 - protein, 11 aa, Influenza virus
QAAVDQITGKL

SEQ ID NO: 535171 - protein, 11 aa, Influenza virus
QADEICIGYLS

SEQ ID NO: 535172 - protein, 11 aa, Influenza virus
QADEICIGYMS

SEQ ID NO: 535173 - protein, 11 aa, Influenza virus
QAELLVAMENQ

SEQ ID NO: 535174 - protein, 11 aa, Influenza virus
QAFRDNLEPGT

SEQ ID NO: 535175 - protein, 11 aa, Influenza virus
QAFYKILKIKK

SEQ ID NO: 535176 - protein, 11 aa, Influenza virus
QAFYKILKIRK

SEQ ID NO: 535177 - protein, 11 aa, Influenza virus
QAFYRSINWLT

SEQ ID NO: 535178 - protein, 11 aa, Influenza virus
QAGRIDFHWML

SEQ ID NO: 535179 - protein, 11 aa, Influenza virus
QAGRMTFYWAI

SEQ ID NO: 535180 - protein, 11 aa, Influenza virus
QAGRMTFYWII

SEQ ID NO: 535181 - protein, 11 aa, Influenza virus
QAGRMTFYWKI

SEQ ID NO: 535182 - protein, 11 aa, Influenza virus
QAGRMTFYWTI

SEQ ID NO: 535183 - protein, 11 aa, Influenza virus
QAGRMTFYWTM

SEQ ID NO: 535184 - protein, 11 aa, Influenza virus
QAGVDRFYRIC

SEQ ID NO: 535185 - protein, 11 aa, Influenza virus
QAGVDRFYRTC

SEQ ID NO: 535186 - protein, 11 aa, Influenza virus
QAGVNRFYRTC

SEQ ID NO: 535187 - protein, 11 aa, Influenza virus
QAHTKILYFHK

SEQ ID NO: 535188 - protein, 11 aa, Influenza virus
QAHTKVLYFHK

SEQ ID NO: 535189 - protein, 11 aa, Influenza virus
QAKFEAVAWSA

SEQ ID NO: 535190 - protein, 11 aa, Influenza virus
QAKFESVAWSA

SEQ ID NO: 535191 - protein, 11 aa, Influenza virus
QAKGLFGAIAG

SEQ ID NO: 535192 - protein, 11 aa, Influenza virus
QALKDNLEPGT

SEQ ID NO: 535193 - protein, 11 aa, Influenza virus
QALQLLFEVEQ

SEQ ID NO: 535194 - protein, 11 aa, Influenza virus
QALQLLLEVEN

SEQ ID NO: 535195 - protein, 11 aa, Influenza virus
QALQLLLEVEQ

SEQ ID NO: 535196 - protein, 11 aa, Influenza virus
QALQLLLEVES

SEQ ID NO: 535197 - protein, 11 aa, Influenza virus
QALRDNLEPGT

SEQ ID NO: 535198 - protein, 11 aa, Influenza virus
QALRDSLEPGT

SEQ ID NO: 535199 - protein, 11 aa, Influenza virus
QAMELVEAEKH

SEQ ID NO: 535200 - protein, 11 aa, Influenza virus
QANLCRFLETR

SEQ ID NO: 535201 - protein, 11 aa, Influenza virus
QARFEAVAWSA

SEQ ID NO: 535202 - protein, 11 aa, Influenza virus
QARFESVAWSA

SEQ ID NO: 535203 - protein, 11 aa, Influenza virus
QASPSCLVVRK

SEQ ID NO: 535204 - protein, 11 aa, Influenza virus
QATIDQITGKL

SEQ ID NO: 535205 - protein, 11 aa, Influenza virus
QAVDICKAAIG

SEQ ID NO: 535206 - protein, 11 aa, Influenza virus
QAVDICKAALG

SEQ ID NO: 535207 - protein, 11 aa, Influenza virus
QAVDICKAAMG

SEQ ID NO: 535208 - protein, 11 aa, Influenza virus
QAVGICKAAMG

SEQ ID NO: 535209 - protein, 11 aa, Influenza virus
QAVNICKAAMG

SEQ ID NO: 535210 - protein, 11 aa, Influenza virus
QAWSYIVERPS

SEQ ID NO: 535211 - protein, 11 aa, Influenza virus
QAYQKRMGLQM

SEQ ID NO: 535212 - protein, 11 aa, Influenza virus
QAYQKRMGVQI

SEQ ID NO: 535213 - protein, 11 aa, Influenza virus
QAYQKRMGVQL

SEQ ID NO: 535214 - protein, 11 aa, Influenza virus
QAYQKRMGVQM

SEQ ID NO: 535215 - protein, 11 aa, Influenza virus
QAYTKIMYFHK

SEQ ID NO: 535216 - protein, 11 aa, Influenza virus
QAYTKVLYFHK

SEQ ID NO: 535217 - protein, 11 aa, Influenza virus
QAYTKVMYFHK

SEQ ID NO: 535218 - protein, 11 aa, Influenza virus
QCDLHLEFKAD

SEQ ID NO: 535219 - protein, 11 aa, Influenza virus
QCDNNCIESIR

SEQ ID NO: 535220 - protein, 11 aa, Influenza virus
QCDSHLKFKAD

SEQ ID NO: 535221 - protein, 11 aa, Influenza virus
QCFNPMIAELA

SEQ ID NO: 535222 - protein, 11 aa, Influenza virus
QCFNPMIIELA

SEQ ID NO: 535223 - protein, 11 aa, Influenza virus
QCFNPMIVELA

SEQ ID NO: 535224 - protein, 11 aa, Influenza virus
QCFNPMTVELA

SEQ ID NO: 535225 - protein, 11 aa, Influenza virus
QCFNPMVVELA

SEQ ID NO: 535226 - protein, 11 aa, Influenza virus
QCHITGFAPFS

SEQ ID NO: 535227 - protein, 11 aa, Influenza virus
QCKITGFAPFS

SEQ ID NO: 535228 - protein, 11 aa, Influenza virus
QCMESIRNNTY

SEQ ID NO: 535229 - protein, 11 aa, Influenza virus
QCQITGFAPFS

SEQ ID NO: 535230 - protein, 11 aa, Influenza virus
QCQTPLGAINT

SEQ ID NO: 535231 - protein, 11 aa, Influenza virus
QCRICIDFRDM

SEQ ID NO: 535232 - protein, 11 aa, Influenza virus
QCRICILDQNF

SEQ ID NO: 535233 - protein, 11 aa, Influenza virus
QDAMTEVWSYN

SEQ ID NO: 535234 - protein, 11 aa, Influenza virus
QDCDLINGALG

SEQ ID NO: 535235 - protein, 11 aa, Influenza virus
QDEFCYTLITD

SEQ ID NO: 535236 - protein, 11 aa, Influenza virus
QDEFCYTLMTD

SEQ ID NO: 535237 - protein, 11 aa, Influenza virus
QDEFCYTLVTD

SEQ ID NO: 535238 - protein, 11 aa, Influenza virus
QDGKSSACKRA

SEQ ID NO: 535239 - protein, 11 aa, Influenza virus
QDIIDNDNWSG

SEQ ID NO: 535240 - protein, 11 aa, Influenza virus
QDIIDNNNWSG

SEQ ID NO: 535241 - protein, 11 aa, Influenza virus
QDIWAYNAELL

SEQ ID NO: 535242 - protein, 11 aa, Influenza virus
QDLEEYVEDTK

SEQ ID NO: 535243 - protein, 11 aa, Influenza virus
QDLEKYIEDTK

SEQ ID NO: 535244 - protein, 11 aa, Influenza virus
QDLEKYVEDTK

SEQ ID NO: 535245 - protein, 11 aa, Influenza virus
QDLENYVEDTK

SEQ ID NO: 535246 - protein, 11 aa, Influenza virus
QDLERYVEDTK

SEQ ID NO: 535247 - protein, 11 aa, Influenza virus
QDLWAYNAELL

SEQ ID NO: 535248 - protein, 11 aa, Influenza virus
QDNAIRFGESE

SEQ ID NO: 535249 - protein, 11 aa, Influenza virus
QDNAKDEGNGC

SEQ ID NO: 535250 - protein, 11 aa, Influenza virus
QDRGLFGAIAG

SEQ ID NO: 535251 - protein, 11 aa, Influenza virus
QDRGLFGAKAG

SEQ ID NO: 535252 - protein, 11 aa, Influenza virus
QDSECVSHNGT

SEQ ID NO: 535253 - protein, 11 aa, Influenza virus
QDSFYRSMKWL

SEQ ID NO: 535254 - protein, 11 aa, Influenza virus
QDTEISFTITG

SEQ ID NO: 535255 - protein, 11 aa, Influenza virus
QDTELSFTITG

SEQ ID NO: 535256 - protein, 11 aa, Influenza virus
QDTELSFTVTG

SEQ ID NO: 535257 - protein, 11 aa, Influenza virus
QDTEVSFTITG

SEQ ID NO: 535258 - protein, 11 aa, Influenza virus
QDTTWDVFIER

SEQ ID NO: 535259 - protein, 11 aa, Influenza virus
QDVIMEIVFPN

SEQ ID NO: 535260 - protein, 11 aa, Influenza virus
QDVIMEVVFPN

SEQ ID NO: 535261 - protein, 11 aa, Influenza virus
QDVWAYNAELL

SEQ ID NO: 535262 - protein, 11 aa, Influenza virus
QDWSYIVERPS

SEQ ID NO: 535263 - protein, 11 aa, Influenza virus
QEAIDKITNKI

SEQ ID NO: 535264 - protein, 11 aa, Influenza virus
QEAIDKITNKV

SEQ ID NO: 535265 - protein, 11 aa, Influenza virus
QEAIEKITNKV

SEQ ID NO: 535266 - protein, 11 aa, Influenza virus
QEAIGKITNKV

SEQ ID NO: 535267 - protein, 11 aa, Influenza virus
QEAINKITNKV

SEQ ID NO: 535268 - protein, 11 aa, Influenza virus
QEALQNRIMIN

SEQ ID NO: 535269 - protein, 11 aa, Influenza virus
QEARVWWTSNS

SEQ ID NO: 535270 - protein, 11 aa, Influenza virus
QEELKSLFSSI

SEQ ID NO: 535271 - protein, 11 aa, Influenza virus
QEELRFLFSSI

SEQ ID NO: 535272 - protein, 11 aa, Influenza virus
QEELRSLFSSI

SEQ ID NO: 535273 - protein, 11 aa, Influenza virus
QEEVTNATETV

SEQ ID NO: 535274 - protein, 11 aa, Influenza virus
QEFKMNPNKKI

SEQ ID NO: 535275 - protein, 11 aa, Influenza virus
QEFKMNPNQKI

SEQ ID NO: 535276 - protein, 11 aa, Influenza virus
QEIEGIKLKSE

SEQ ID NO: 535277 - protein, 11 aa, Influenza virus
QEIEGIKLKTE

SEQ ID NO: 535278 - protein, 11 aa, Influenza virus
QEIKMNPNQKI

SEQ ID NO: 535279 - protein, 11 aa, Influenza virus
QEIVDNKNWSG

SEQ ID NO: 535280 - protein, 11 aa, Influenza virus
QEIVDNNNWSG

SEQ ID NO: 535281 - protein, 11 aa, Influenza virus
QEIVDNSNWSG

SEQ ID NO: 535282 - protein, 11 aa, Influenza virus
QEIVGNDNWSG

SEQ ID NO: 535283 - protein, 11 aa, Influenza virus
QEIVSNDNWSG

SEQ ID NO: 535284 - protein, 11 aa, Influenza virus
QEKNPALRMKW

SEQ ID NO: 535285 - protein, 11 aa, Influenza virus
QEKNPSLRMKW

SEQ ID NO: 535286 - protein, 11 aa, Influenza virus
QELGDAPFLDR

SEQ ID NO: 535287 - protein, 11 aa, Influenza virus
QENRVWWTSNS

SEQ ID NO: 535288 - protein, 11 aa, Influenza virus
QERGLFGAIAG

SEQ ID NO: 535289 - protein, 11 aa, Influenza virus
QESECACINGS

SEQ ID NO: 535290 - protein, 11 aa, Influenza virus
QESECACVNGS

SEQ ID NO: 535291 - protein, 11 aa, Influenza virus
QESECICINGT

SEQ ID NO: 535292 - protein, 11 aa, Influenza virus
QESECVCHDGV

SEQ ID NO: 535293 - protein, 11 aa, Influenza virus
QESECVCHKGI

SEQ ID NO: 535294 - protein, 11 aa, Influenza virus
QESECVCHKGV

SEQ ID NO: 535295 - protein, 11 aa, Influenza virus
QESECVCHNGI

SEQ ID NO: 535296 - protein, 11 aa, Influenza virus
QESECVCHNGT

SEQ ID NO: 535297 - protein, 11 aa, Influenza virus
QESECVCHNGV

SEQ ID NO: 535298 - protein, 11 aa, Influenza virus
QESECVCHNST

SEQ ID NO: 535299 - protein, 11 aa, Influenza virus
QESECVCHSGI

SEQ ID NO: 535300 - protein, 11 aa, Influenza virus
QESECVCINGI

SEQ ID NO: 535301 - protein, 11 aa, Influenza virus
QESECVCINGS

SEQ ID NO: 535302 - protein, 11 aa, Influenza virus
QESECVCINGT

SEQ ID NO: 535303 - protein, 11 aa, Influenza virus
QESECVCISGT

SEQ ID NO: 535304 - protein, 11 aa, Influenza virus
QESECVCMNGS

SEQ ID NO: 535305 - protein, 11 aa, Influenza virus
QESECVCQDEF

SEQ ID NO: 535306 - protein, 11 aa, Influenza virus
QESECVCQNGV

SEQ ID NO: 535307 - protein, 11 aa, Influenza virus
QESECVCVNGS

SEQ ID NO: 535308 - protein, 11 aa, Influenza virus
QESECVRHNGT

SEQ ID NO: 535309 - protein, 11 aa, Influenza virus
QESLLLATGMK

SEQ ID NO: 535310 - protein, 11 aa, Influenza virus
QESLMLATGMK

SEQ ID NO: 535311 - protein, 11 aa, Influenza virus
QETRVWWTSNS

SEQ ID NO: 535312 - protein, 11 aa, Influenza virus
QETRVWWTSSS

SEQ ID NO: 535313 - protein, 11 aa, Influenza virus
QFALGQGTTLD

SEQ ID NO: 535314 - protein, 11 aa, Influenza virus
QFALGQGTTLE

SEQ ID NO: 535315 - protein, 11 aa, Influenza virus
QFALGQGTTLK

SEQ ID NO: 535316 - protein, 11 aa, Influenza virus
QFALGQGTTLN

SEQ ID NO: 535317 - protein, 11 aa, Influenza virus
QFALGQGTTLS

SEQ ID NO: 535318 - protein, 11 aa, Influenza virus
QFALGQGTTLY

SEQ ID NO: 535319 - protein, 11 aa, Influenza virus
QFELIDNEFNE

SEQ ID NO: 535320 - protein, 11 aa, Influenza virus
QFELIDNEFSE

SEQ ID NO: 535321 - protein, 11 aa, Influenza virus
QFELIDNEFTE

SEQ ID NO: 535322 - protein, 11 aa, Influenza virus
QFEMIDNEFNE

SEQ ID NO: 535323 - protein, 11 aa, Influenza virus
QFGRIDFHWLM

SEQ ID NO: 535324 - protein, 11 aa, Influenza virus
QFKLIDNEFTE

SEQ ID NO: 535325 - protein, 11 aa, Influenza virus
QFPLGQGTTLD

SEQ ID NO: 535326 - protein, 11 aa, Influenza virus
QFPVQTDEYKN

SEQ ID NO: 535327 - protein, 11 aa, Influenza virus
QFRALISWEMG

SEQ ID NO: 535328 - protein, 11 aa, Influenza virus
QFSSLAVNVRG

SEQ ID NO: 535329 - protein, 11 aa, Influenza virus
QFSSLTVNVRG

SEQ ID NO: 535330 - protein, 11 aa, Influenza virus
QFSSLTVSVRG

SEQ ID NO: 535331 - protein, 11 aa, Influenza virus
QFTWNGVKVDG

SEQ ID NO: 535332 - protein, 11 aa, Influenza virus
QGACWEQLYTP

SEQ ID NO: 535333 - protein, 11 aa, Influenza virus
QGAGYAADKES

SEQ ID NO: 535334 - protein, 11 aa, Influenza virus
QGALLGTKHSN

SEQ ID NO: 535335 - protein, 11 aa, Influenza virus
QGALLGTNHSN

SEQ ID NO: 535336 - protein, 11 aa, Influenza virus
QGALLGTRHSN

SEQ ID NO: 535337 - protein, 11 aa, Influenza virus
QGALLNDKHSN

SEQ ID NO: 535338 - protein, 11 aa, Influenza virus
QGALLNDRHSN

SEQ ID NO: 535339 - protein, 11 aa, Influenza virus
QGALVGTKHSN

SEQ ID NO: 535340 - protein, 11 aa, Influenza virus
QGANRPAIEID

SEQ ID NO: 535341 - protein, 11 aa, Influenza virus
QGANRPIIEID

SEQ ID NO: 535342 - protein, 11 aa, Influenza virus
QGANRPVIEID

SEQ ID NO: 535343 - protein, 11 aa, Influenza virus
QGANRPVIEIN

SEQ ID NO: 535344 - protein, 11 aa, Influenza virus
QGANRPVIKID

SEQ ID NO: 535345 - protein, 11 aa, Influenza virus
QGDIVLVMKRK

SEQ ID NO: 535346 - protein, 11 aa, Influenza virus
QGDNENATATV

SEQ ID NO: 535347 - protein, 11 aa, Influenza virus
QGDVVLVMKRK

SEQ ID NO: 535348 - protein, 11 aa, Influenza virus
QGEGIAADYKS

SEQ ID NO: 535349 - protein, 11 aa, Influenza virus
QGEGTAADYKS

SEQ ID NO: 535350 - protein, 11 aa, Influenza virus
QGFAPFSKDNG

SEQ ID NO: 535351 - protein, 11 aa, Influenza virus
QGFFPFHKDNA

SEQ ID NO: 535352 - protein, 11 aa, Influenza virus
QGGHIEECSCY

SEQ ID NO: 535353 - protein, 11 aa, Influenza virus
QGIGQAADYKS

SEQ ID NO: 535354 - protein, 11 aa, Influenza virus
QGIKLTQGYKD

SEQ ID NO: 535355 - protein, 11 aa, Influenza virus
QGKTKATKMEA

SEQ ID NO: 535356 - protein, 11 aa, Influenza virus
QGKTKATKMKA

SEQ ID NO: 535357 - protein, 11 aa, Influenza virus
QGLIDGWYGFR

SEQ ID NO: 535358 - protein, 11 aa, Influenza virus
QGLVDGWYGYH

SEQ ID NO: 535359 - protein, 11 aa, Influenza virus
QGMGMAADKES

SEQ ID NO: 535360 - protein, 11 aa, Influenza virus
QGMIDGWYGYH

SEQ ID NO: 535361 - protein, 11 aa, Influenza virus
QGMVDGWYGFH

SEQ ID NO: 535362 - protein, 11 aa, Influenza virus
QGMVDGWYGYH

SEQ ID NO: 535363 - protein, 11 aa, Influenza virus
QGNGCFEIFHQ

SEQ ID NO: 535364 - protein, 11 aa, Influenza virus
QGNNDNATATV

SEQ ID NO: 535365 - protein, 11 aa, Influenza virus
QGNNENATATV

SEQ ID NO: 535366 - protein, 11 aa, Influenza virus
QGNNKNATATV

SEQ ID NO: 535367 - protein, 11 aa, Influenza virus
QGNNNNATATV

SEQ ID NO: 535368 - protein, 11 aa, Influenza virus
QGNNVWAGRTV

SEQ ID NO: 535369 - protein, 11 aa, Influenza virus
QGNSVWAGRTI

SEQ ID NO: 535370 - protein, 11 aa, Influenza virus
QGNSVWAGRTM

SEQ ID NO: 535371 - protein, 11 aa, Influenza virus
QGNSVWAGRTV

SEQ ID NO: 535372 - protein, 11 aa, Influenza virus
QGQGTAADYKS

SEQ ID NO: 535373 - protein, 11 aa, Influenza virus
QGQIIVLNTDW

SEQ ID NO: 535374 - protein, 11 aa, Influenza virus
QGQTIVLNTDW

SEQ ID NO: 535375 - protein, 11 aa, Influenza virus
QGQTIVLTTDW

SEQ ID NO: 535376 - protein, 11 aa, Influenza virus
QGQTVVLNTDW

SEQ ID NO: 535377 - protein, 11 aa, Influenza virus
QGRGLFGAIAG

SEQ ID NO: 535378 - protein, 11 aa, Influenza virus
QGRGLFGAKAG

SEQ ID NO: 535379 - protein, 11 aa, Influenza virus
QGRGVFEFSDE

SEQ ID NO: 535380 - protein, 11 aa, Influenza virus
QGRGVFELSDE

SEQ ID NO: 535381 - protein, 11 aa, Influenza virus
QGRLCNPLNPF

SEQ ID NO: 535382 - protein, 11 aa, Influenza virus
QGRLCNPMNPF

SEQ ID NO: 535383 - protein, 11 aa, Influenza virus
QGRMDYYWAIL

SEQ ID NO: 535384 - protein, 11 aa, Influenza virus
QGRMDYYWAVL

SEQ ID NO: 535385 - protein, 11 aa, Influenza virus
QGRMDYYWGIL

SEQ ID NO: 535386 - protein, 11 aa, Influenza virus
QGRQTFDWTLN

SEQ ID NO: 535387 - protein, 11 aa, Influenza virus
QGRQTYDWTLN

SEQ ID NO: 535388 - protein, 11 aa, Influenza virus
QGSARHIEECS

SEQ ID NO: 535389 - protein, 11 aa, Influenza virus
QGSFYRNMRWL

SEQ ID NO: 535390 - protein, 11 aa, Influenza virus
QGSFYRSIRWL

SEQ ID NO: 535391 - protein, 11 aa, Influenza virus
QGSFYRSMRWL

SEQ ID NO: 535392 - protein, 11 aa, Influenza virus
QGSGYAADKAS

SEQ ID NO: 535393 - protein, 11 aa, Influenza virus
QGSGYAADKES

SEQ ID NO: 535394 - protein, 11 aa, Influenza virus
QGSGYAADKKS

SEQ ID NO: 535395 - protein, 11 aa, Influenza virus
QGSGYAADLKS

SEQ ID NO: 535396 - protein, 11 aa, Influenza virus
QGSGYAADQES

SEQ ID NO: 535397 - protein, 11 aa, Influenza virus
QGSGYAADQKS

SEQ ID NO: 535398 - protein, 11 aa, Influenza virus
QGSGYAADRES

SEQ ID NO: 535399 - protein, 11 aa, Influenza virus
QGSGYAADRKS

SEQ ID NO: 535400 - protein, 11 aa, Influenza virus
QGSLKLATGMR

SEQ ID NO: 535401 - protein, 11 aa, Influenza virus
QGSLLNDKHFN

SEQ ID NO: 535402 - protein, 11 aa, Influenza virus
QGSLLNDKHSN

SEQ ID NO: 535403 - protein, 11 aa, Influenza virus
QGSLLNDRHSN

SEQ ID NO: 535404 - protein, 11 aa, Influenza virus
QGSLMLATGMR

SEQ ID NO: 535405 - protein, 11 aa, Influenza virus
QGSLPNDKHSN

SEQ ID NO: 535406 - protein, 11 aa, Influenza virus
QGSLRLATGMR

SEQ ID NO: 535407 - protein, 11 aa, Influenza virus
QGSNRPVIQID

SEQ ID NO: 535408 - protein, 11 aa, Influenza virus
QGSNRPVIQIN

SEQ ID NO: 535409 - protein, 11 aa, Influenza virus
QGSNRPVIRID

SEQ ID NO: 535410 - protein, 11 aa, Influenza virus
QGSNRPWIRFN

SEQ ID NO: 535411 - protein, 11 aa, Influenza virus
QGSTLPRRSGA

SEQ ID NO: 535412 - protein, 11 aa, Influenza virus
QGSYNNTSGEQ

SEQ ID NO: 535413 - protein, 11 aa, Influenza virus
QGTAADYKSTQ

SEQ ID NO: 535414 - protein, 11 aa, Influenza virus
QGTCWEQLYTP

SEQ ID NO: 535415 - protein, 11 aa, Influenza virus
QGTCWEQMYTP

SEQ ID NO: 535416 - protein, 11 aa, Influenza virus
QGTGIAADKAS

SEQ ID NO: 535417 - protein, 11 aa, Influenza virus
QGTGIAADKES

SEQ ID NO: 535418 - protein, 11 aa, Influenza virus
QGTGIAADKTS

SEQ ID NO: 535419 - protein, 11 aa, Influenza virus
QGTGIAADKVS

SEQ ID NO: 535420 - protein, 11 aa, Influenza virus
QGTGIAAEKES

SEQ ID NO: 535421 - protein, 11 aa, Influenza virus
QGTGQAADYES

SEQ ID NO: 535422 - protein, 11 aa, Influenza virus
QGTGQAADYKS

SEQ ID NO: 535423 - protein, 11 aa, Influenza virus
QGTKRSHEQME

SEQ ID NO: 535424 - protein, 11 aa, Influenza virus
QGTKRSYEQME

SEQ ID NO: 535425 - protein, 11 aa, Influenza virus
QGTMDYYWGIL

SEQ ID NO: 535426 - protein, 11 aa, Influenza virus
QGTSVWAGRTI

SEQ ID NO: 535427 - protein, 11 aa, Influenza virus
QGTTIRGKHSN

SEQ ID NO: 535428 - protein, 11 aa, Influenza virus
QGTTIRGRHSN

SEQ ID NO: 535429 - protein, 11 aa, Influenza virus
QGTTIRNKHSN

SEQ ID NO: 535430 - protein, 11 aa, Influenza virus
QGTTIRNRHSN

SEQ ID NO: 535431 - protein, 11 aa, Influenza virus
QGTTLDNEHSN

SEQ ID NO: 535432 - protein, 11 aa, Influenza virus
QGTTLDNKHSN

SEQ ID NO: 535433 - protein, 11 aa, Influenza virus
QGTTLENKHSN

SEQ ID NO: 535434 - protein, 11 aa, Influenza virus
QGTTLKGRHAN

SEQ ID NO: 535435 - protein, 11 aa, Influenza virus
QGTTLNNKHSN

SEQ ID NO: 535436 - protein, 11 aa, Influenza virus
QGTTLRGQHAN

SEQ ID NO: 535437 - protein, 11 aa, Influenza virus
QGTTLRGRHAN

SEQ ID NO: 535438 - protein, 11 aa, Influenza virus
QGTTLYNKHSN

SEQ ID NO: 535439 - protein, 11 aa, Influenza virus
QGVGIAADKES

SEQ ID NO: 535440 - protein, 11 aa, Influenza virus
QGVGMAADKES

SEQ ID NO: 535441 - protein, 11 aa, Influenza virus
QGVKGWAFDNG

SEQ ID NO: 535442 - protein, 11 aa, Influenza virus
QGVKLAQGYKD

SEQ ID NO: 535443 - protein, 11 aa, Influenza virus
QGVKLIQGYKD

SEQ ID NO: 535444 - protein, 11 aa, Influenza virus
QGVKLTQGYKD

SEQ ID NO: 535445 - protein, 11 aa, Influenza virus
QGVLLGTKHSN

SEQ ID NO: 535446 - protein, 11 aa, Influenza virus
QGVRLTQGYKD

SEQ ID NO: 535447 - protein, 11 aa, Influenza virus
QGWMDYYWGIL

SEQ ID NO: 535448 - protein, 11 aa, Influenza virus
QGWSYIVERPS

SEQ ID NO: 535449 - protein, 11 aa, Influenza virus
QGYGVKGFGFR

SEQ ID NO: 535450 - protein, 11 aa, Influenza virus
QGYKDIILWFS

SEQ ID NO: 535451 - protein, 11 aa, Influenza virus
QGYKDIILWIS

SEQ ID NO: 535452 - protein, 11 aa, Influenza virus
QGYKDIILWVS

SEQ ID NO: 535453 - protein, 11 aa, Influenza virus
QHANGTIHDRS

SEQ ID NO: 535454 - protein, 11 aa, Influenza virus
QHIEECSCYGA

SEQ ID NO: 535455 - protein, 11 aa, Influenza virus
QHIEECSCYGS

SEQ ID NO: 535456 - protein, 11 aa, Influenza virus
QHIEECSCYPQ

SEQ ID NO: 535457 - protein, 11 aa, Influenza virus
QHIEECSCYPR

SEQ ID NO: 535458 - protein, 11 aa, Influenza virus
QHIEEGSVYPR

SEQ ID NO: 535459 - protein, 11 aa, Influenza virus
QHIIDLADSEM

SEQ ID NO: 535460 - protein, 11 aa, Influenza virus
QHLEECSCYMD

SEQ ID NO: 535461 - protein, 11 aa, Influenza virus
QHLEECSCYTD

SEQ ID NO: 535462 - protein, 11 aa, Influenza virus
QHLEECSCYVD

SEQ ID NO: 535463 - protein, 11 aa, Influenza virus
QHPELTGLDCI

SEQ ID NO: 535464 - protein, 11 aa, Influenza virus
QHPELTGLDCM

SEQ ID NO: 535465 - protein, 11 aa, Influenza virus
QHPELTGLNCI

SEQ ID NO: 535466 - protein, 11 aa, Influenza virus
QHPELTGMDCI

SEQ ID NO: 535467 - protein, 11 aa, Influenza virus
QHPELTGMNCI

SEQ ID NO: 535468 - protein, 11 aa, Influenza virus
QHQNAEGIGIA

SEQ ID NO: 535469 - protein, 11 aa, Influenza virus
QHQNAEGTGIA

SEQ ID NO: 535470 - protein, 11 aa, Influenza virus
QHQNAEGTGMA

SEQ ID NO: 535471 - protein, 11 aa, Influenza virus
QHQNEQGMGMA

SEQ ID NO: 535472 - protein, 11 aa, Influenza virus
QHQNEQGTGIA

SEQ ID NO: 535473 - protein, 11 aa, Influenza virus
QHQNEQGVGIA

SEQ ID NO: 535474 - protein, 11 aa, Influenza virus
QHQNEQGVGMA

SEQ ID NO: 535475 - protein, 11 aa, Influenza virus
QHQNSEGTGIA

SEQ ID NO: 535476 - protein, 11 aa, Influenza virus
QHQNSEGTGIV

SEQ ID NO: 535477 - protein, 11 aa, Influenza virus
QHRNDEGTGIA

SEQ ID NO: 535478 - protein, 11 aa, Influenza virus
QHRNEEGTGIA

SEQ ID NO: 535479 - protein, 11 aa, Influenza virus
QHRNEEGTGVA

SEQ ID NO: 535480 - protein, 11 aa, Influenza virus
QHTIDLADSEM

SEQ ID NO: 535481 - protein, 11 aa, Influenza virus
QHTIDLAESEM

SEQ ID NO: 535482 - protein, 11 aa, Influenza virus
QHTIDLTDAEM

SEQ ID NO: 535483 - protein, 11 aa, Influenza virus
QHTIDLTDSEM

SEQ ID NO: 535484 - protein, 11 aa, Influenza virus
QHTIDMADSEM

SEQ ID NO: 535485 - protein, 11 aa, Influenza virus
QHTIDMGDSEM

SEQ ID NO: 535486 - protein, 11 aa, Influenza virus
QHTIDMTDSEM

SEQ ID NO: 535487 - protein, 11 aa, Influenza virus
QHTIDQADSEM

SEQ ID NO: 535488 - protein, 11 aa, Influenza virus
QHTIDSTDSEM

SEQ ID NO: 535489 - protein, 11 aa, Influenza virus
QHTIDVADSEM

SEQ ID NO: 535490 - protein, 11 aa, Influenza virus
QHTIDVTDSEM

SEQ ID NO: 535491 - protein, 11 aa, Influenza virus
QHTIHLTDSEM

SEQ ID NO: 535492 - protein, 11 aa, Influenza virus
QHVEECSCYPQ

SEQ ID NO: 535493 - protein, 11 aa, Influenza virus
QHVEECSCYPR

SEQ ID NO: 535494 - protein, 11 aa, Influenza virus
QHVEECSCYPS

SEQ ID NO: 535495 - protein, 11 aa, Influenza virus
QIADAQHRSHR

SEQ ID NO: 535496 - protein, 11 aa, Influenza virus
QIADSHHRSHR

SEQ ID NO: 535497 - protein, 11 aa, Influenza virus
QIADSQHKSHR

SEQ ID NO: 535498 - protein, 11 aa, Influenza virus
QIADSQHRSHR

SEQ ID NO: 535499 - protein, 11 aa, Influenza virus
QIAGSSEQAAE

SEQ ID NO: 535500 - protein, 11 aa, Influenza virus
QIAILAATVTL

SEQ ID NO: 535501 - protein, 11 aa, Influenza virus
QIAILATTITL

SEQ ID NO: 535502 - protein, 11 aa, Influenza virus
QIAILATTVTL

SEQ ID NO: 535503 - protein, 11 aa, Influenza virus
QIAILVTTVTL

SEQ ID NO: 535504 - protein, 11 aa, Influenza virus
QICIGHHANNS

SEQ ID NO: 535505 - protein, 11 aa, Influenza virus
QICIGYHANNS

SEQ ID NO: 535506 - protein, 11 aa, Influenza virus
QICIGYHSNNS

SEQ ID NO: 535507 - protein, 11 aa, Influenza virus
QICVGYHANNS

SEQ ID NO: 535508 - protein, 11 aa, Influenza virus
QICVGYHSNNS

SEQ ID NO: 535509 - protein, 11 aa, Influenza virus
QIDESCEGECF

SEQ ID NO: 535510 - protein, 11 aa, Influenza virus
QIDPVKLSGGY

SEQ ID NO: 535511 - protein, 11 aa, Influenza virus
QIDPVKLSSGY

SEQ ID NO: 535512 - protein, 11 aa, Influenza virus
QIDQVKLSSGY

SEQ ID NO: 535513 - protein, 11 aa, Influenza virus
QIDSVKLSSGY

SEQ ID NO: 535514 - protein, 11 aa, Influenza virus
QIEARGLFGAI

SEQ ID NO: 535515 - protein, 11 aa, Influenza virus
QIEDLWAYNAE

SEQ ID NO: 535516 - protein, 11 aa, Influenza virus
QIEELWAYNAE

SEQ ID NO: 535517 - protein, 11 aa, Influenza virus
QIEGLWAYNAE

SEQ ID NO: 535518 - protein, 11 aa, Influenza virus
QIEKEFEQVEG

SEQ ID NO: 535519 - protein, 11 aa, Influenza virus
QIEKEFGQVEG

SEQ ID NO: 535520 - protein, 11 aa, Influenza virus
QIEKEFSEIEG

SEQ ID NO: 535521 - protein, 11 aa, Influenza virus
QIEKEFSEVEG

SEQ ID NO: 535522 - protein, 11 aa, Influenza virus
QIEKEFTEVEG

SEQ ID NO: 535523 - protein, 11 aa, Influenza virus
QIENLWAYNAE

SEQ ID NO: 535524 - protein, 11 aa, Influenza virus
QIEPRGLFGAI

SEQ ID NO: 535525 - protein, 11 aa, Influenza virus
QIESIIEAESS

SEQ ID NO: 535526 - protein, 11 aa, Influenza virus
QIESMIEAESS

SEQ ID NO: 535527 - protein, 11 aa, Influenza virus
QIESMVEAESS

SEQ ID NO: 535528 - protein, 11 aa, Influenza virus
QIESRGLFGAI

SEQ ID NO: 535529 - protein, 11 aa, Influenza virus
QIEVTNATELV

SEQ ID NO: 535530 - protein, 11 aa, Influenza virus
QIGNVINWTKD

SEQ ID NO: 535531 - protein, 11 aa, Influenza virus
QIGNVINWTQD

SEQ ID NO: 535532 - protein, 11 aa, Influenza virus
QIGNVINWTRD

SEQ ID NO: 535533 - protein, 11 aa, Influenza virus
QIGYICSGVFG

SEQ ID NO: 535534 - protein, 11 aa, Influenza virus
QIGYVCSGIFG

SEQ ID NO: 535535 - protein, 11 aa, Influenza virus
QIGYVCSGVFG

SEQ ID NO: 535536 - protein, 11 aa, Influenza virus
QIIDIWAYNAE

SEQ ID NO: 535537 - protein, 11 aa, Influenza virus
QIIKLLPFAAA

SEQ ID NO: 535538 - protein, 11 aa, Influenza virus
QIIKLLPFASA

SEQ ID NO: 535539 - protein, 11 aa, Influenza virus
QIIKMLPFAAA

SEQ ID NO: 535540 - protein, 11 aa, Influenza virus
QIIRESGGIDK

SEQ ID NO: 535541 - protein, 11 aa, Influenza virus
QIISLCSIWFS

SEQ ID NO: 535542 - protein, 11 aa, Influenza virus
QIIVILVLGLS

SEQ ID NO: 535543 - protein, 11 aa, Influenza virus
QIIVTREPYVS

SEQ ID NO: 535544 - protein, 11 aa, Influenza virus
QIKIRRRVDIN

SEQ ID NO: 535545 - protein, 11 aa, Influenza virus
QILAIYATVAG

SEQ ID NO: 535546 - protein, 11 aa, Influenza virus
QILAIYSTAAS

SEQ ID NO: 535547 - protein, 11 aa, Influenza virus
QILAIYSTVAS

SEQ ID NO: 535548 - protein, 11 aa, Influenza virus
QILAIYSTVSS

SEQ ID NO: 535549 - protein, 11 aa, Influenza virus
QILRTQESSCV

SEQ ID NO: 535550 - protein, 11 aa, Influenza virus
QILSIYSTAAS

SEQ ID NO: 535551 - protein, 11 aa, Influenza virus
QILSIYSTVAS

SEQ ID NO: 535552 - protein, 11 aa, Influenza virus
QILSIYSTVSS

SEQ ID NO: 535553 - protein, 11 aa, Influenza virus
QILSIYSTVTS

SEQ ID NO: 535554 - protein, 11 aa, Influenza virus
QILSIYSTVVS

SEQ ID NO: 535555 - protein, 11 aa, Influenza virus
QINGKLNRLIE

SEQ ID NO: 535556 - protein, 11 aa, Influenza virus
QINGQSGRIDF

SEQ ID NO: 535557 - protein, 11 aa, Influenza virus
QIQDIWAYNAE

SEQ ID NO: 535558 - protein, 11 aa, Influenza virus
QIQDLWAYNAE

SEQ ID NO: 535559 - protein, 11 aa, Influenza virus
QIQDVWAYNAE

SEQ ID NO: 535560 - protein, 11 aa, Influenza virus
QIQGIKLTQGY

SEQ ID NO: 535561 - protein, 11 aa, Influenza virus
QIQGVKLAQGY

SEQ ID NO: 535562 - protein, 11 aa, Influenza virus
QIQGVKLIQGY

SEQ ID NO: 535563 - protein, 11 aa, Influenza virus
QIQGVKLTQGY

SEQ ID NO: 535564 - protein, 11 aa, Influenza virus
QIQGVRLTQGY

SEQ ID NO: 535565 - protein, 11 aa, Influenza virus
QIQNIWAYNAE

SEQ ID NO: 535566 - protein, 11 aa, Influenza virus
QIRGFVHFVEA

SEQ ID NO: 535567 - protein, 11 aa, Influenza virus
QIRGFVYFVEA

SEQ ID NO: 535568 - protein, 11 aa, Influenza virus
QIRGFVYFVEI

SEQ ID NO: 535569 - protein, 11 aa, Influenza virus
QIRGFVYFVET

SEQ ID NO: 535570 - protein, 11 aa, Influenza virus
QIRGVVYFVET

SEQ ID NO: 535571 - protein, 11 aa, Influenza virus
QISGKLNRLIE

SEQ ID NO: 535572 - protein, 11 aa, Influenza virus
QISIVPNIGSR

SEQ ID NO: 535573 - protein, 11 aa, Influenza virus
QITDIWAYNAE

SEQ ID NO: 535574 - protein, 11 aa, Influenza virus
QITFIQALQLL

SEQ ID NO: 535575 - protein, 11 aa, Influenza virus
QITFLQALQLL

SEQ ID NO: 535576 - protein, 11 aa, Influenza virus
QITFMQALQLL

SEQ ID NO: 535577 - protein, 11 aa, Influenza virus
QITGFAPFSKD

SEQ ID NO: 535578 - protein, 11 aa, Influenza virus
QITGKLNRFIE

SEQ ID NO: 535579 - protein, 11 aa, Influenza virus
QITGKLNRIIE

SEQ ID NO: 535580 - protein, 11 aa, Influenza virus
QITGKLNRLID

SEQ ID NO: 535581 - protein, 11 aa, Influenza virus
QITGKLNRLIE

SEQ ID NO: 535582 - protein, 11 aa, Influenza virus
QITGKLNRLIG

SEQ ID NO: 535583 - protein, 11 aa, Influenza virus
QITGKLNRLIS

SEQ ID NO: 535584 - protein, 11 aa, Influenza virus
QITGTLNRLID

SEQ ID NO: 535585 - protein, 11 aa, Influenza virus
QITNGTTGNPI

SEQ ID NO: 535586 - protein, 11 aa, Influenza virus
QITSLCSIWFS

SEQ ID NO: 535587 - protein, 11 aa, Influenza virus
QITTKINNIID

SEQ ID NO: 535588 - protein, 11 aa, Influenza virus
QITTKINNIIE

SEQ ID NO: 535589 - protein, 11 aa, Influenza virus
QIVVTREPYVS

SEQ ID NO: 535590 - protein, 11 aa, Influenza virus
QKAIDEITTKI

SEQ ID NO: 535591 - protein, 11 aa, Influenza virus
QKAIDIMQNKL

SEQ ID NO: 535592 - protein, 11 aa, Influenza virus
QKAIDNMQNKL

SEQ ID NO: 535593 - protein, 11 aa, Influenza virus
QKAIDNMQNRL

SEQ ID NO: 535594 - protein, 11 aa, Influenza virus
QKAIDQITTKI

SEQ ID NO: 535595 - protein, 11 aa, Influenza virus
QKAIDRITTKI

SEQ ID NO: 535596 - protein, 11 aa, Influenza virus
QKAINEITTKI

SEQ ID NO: 535597 - protein, 11 aa, Influenza virus
QKALNEITTKI

SEQ ID NO: 535598 - protein, 11 aa, Influenza virus
QKAMMDQVRES

SEQ ID NO: 535599 - protein, 11 aa, Influenza virus
QKATCVCRDNW

SEQ ID NO: 535600 - protein, 11 aa, Influenza virus
QKCCNLFEKFF

SEQ ID NO: 535601 - protein, 11 aa, Influenza virus
QKCCSLFEKFF

SEQ ID NO: 535602 - protein, 11 aa, Influenza virus
QKCCTLFEKFF

SEQ ID NO: 535603 - protein, 11 aa, Influenza virus
QKGILEDEQMY

SEQ ID NO: 535604 - protein, 11 aa, Influenza virus
QKGNIKCNICI

SEQ ID NO: 535605 - protein, 11 aa, Influenza virus
QKGNIRCDICI

SEQ ID NO: 535606 - protein, 11 aa, Influenza virus
QKGNIRCNICI

SEQ ID NO: 535607 - protein, 11 aa, Influenza virus
QKGNIRCNICV

SEQ ID NO: 535608 - protein, 11 aa, Influenza virus
QKIITIDSVSL

SEQ ID NO: 535609 - protein, 11 aa, Influenza virus
QKIITIGSASL

SEQ ID NO: 535610 - protein, 11 aa, Influenza virus
QKIITIGSISL

SEQ ID NO: 535611 - protein, 11 aa, Influenza virus
QKIITIGSVSL

SEQ ID NO: 535612 - protein, 11 aa, Influenza virus
QKIITMGSVSL

SEQ ID NO: 535613 - protein, 11 aa, Influenza virus
QKILCASATAI

SEQ ID NO: 535614 - protein, 11 aa, Influenza virus
QKILCTSAIAI

SEQ ID NO: 535615 - protein, 11 aa, Influenza virus
QKILCTSATAI

SEQ ID NO: 535616 - protein, 11 aa, Influenza virus
QKILCTSATAL

SEQ ID NO: 535617 - protein, 11 aa, Influenza virus
QKILDEHDSNV

SEQ ID NO: 535618 - protein, 11 aa, Influenza virus
QKILFASATAI

SEQ ID NO: 535619 - protein, 11 aa, Influenza virus
QKIMESGGIDK

SEQ ID NO: 535620 - protein, 11 aa, Influenza virus
QKIMESGGISK

SEQ ID NO: 535621 - protein, 11 aa, Influenza virus
QKIMTIGSVSL

SEQ ID NO: 535622 - protein, 11 aa, Influenza virus
QKINGVKLEEN

SEQ ID NO: 535623 - protein, 11 aa, Influenza virus
QKISGVKLEEN

SEQ ID NO: 535624 - protein, 11 aa, Influenza virus
QKITCVCRDNW

SEQ ID NO: 535625 - protein, 11 aa, Influenza virus
QKKDKRYGPAL

SEQ ID NO: 535626 - protein, 11 aa, Influenza virus
QKLFALSEVAI

SEQ ID NO: 535627 - protein, 11 aa, Influenza virus
QKLFALSGVAI

SEQ ID NO: 535628 - protein, 11 aa, Influenza virus
QKLFALSGVAV

SEQ ID NO: 535629 - protein, 11 aa, Influenza virus
QKLFASSGIAI

SEQ ID NO: 535630 - protein, 11 aa, Influenza virus
QKLFTLSGVAI

SEQ ID NO: 535631 - protein, 11 aa, Influenza virus
QKQEFKMNPNK

SEQ ID NO: 535632 - protein, 11 aa, Influenza virus
QKQEFKMNPNQ

SEQ ID NO: 535633 - protein, 11 aa, Influenza virus
QKQEIKMNPNQ

SEQ ID NO: 535634 - protein, 11 aa, Influenza virus
QKQMTRGLFGA

SEQ ID NO: 535635 - protein, 11 aa, Influenza virus
QKRGLFGAIAG

SEQ ID NO: 535636 - protein, 11 aa, Influenza virus
QKRMTRGLFGA

SEQ ID NO: 535637 - protein, 11 aa, Influenza virus
QKSLIWLWLVL

SEQ ID NO: 535638 - protein, 11 aa, Influenza virus
QKSLLLATGMR

SEQ ID NO: 535639 - protein, 11 aa, Influenza virus
QKSLRGRGSTL

SEQ ID NO: 535640 - protein, 11 aa, Influenza virus
QKSTQEAIDKI

SEQ ID NO: 535641 - protein, 11 aa, Influenza virus
QKSTQEAIEKI

SEQ ID NO: 535642 - protein, 11 aa, Influenza virus
QKSTQEAIGKI

SEQ ID NO: 535643 - protein, 11 aa, Influenza virus
QKSTQEAINKI

SEQ ID NO: 535644 - protein, 11 aa, Influenza virus
QKTIDQVTGKL

SEQ ID NO: 535645 - protein, 11 aa, Influenza virus
QKTITIGSVSL

SEQ ID NO: 535646 - protein, 11 aa, Influenza virus
QKTLDEHDANV

SEQ ID NO: 535647 - protein, 11 aa, Influenza virus
QKTLDEHDSNV

SEQ ID NO: 535648 - protein, 11 aa, Influenza virus
QKTLDKHDSNV

SEQ ID NO: 535649 - protein, 11 aa, Influenza virus
QKTLKLATGMR

SEQ ID NO: 535650 - protein, 11 aa, Influenza virus
QKVNGVKLEEN

SEQ ID NO: 535651 - protein, 11 aa, Influenza virus
QKVPVTQTMEL

SEQ ID NO: 535652 - protein, 11 aa, Influenza virus
QKVTCVCRDNW

SEQ ID NO: 535653 - protein, 11 aa, Influenza virus
QKWWVWLWLVL

SEQ ID NO: 535654 - protein, 11 aa, Influenza virus
QLEGFSAESRK

SEQ ID NO: 535655 - protein, 11 aa, Influenza virus
QLFIKDYRYTY

SEQ ID NO: 535656 - protein, 11 aa, Influenza virus
QLFLVCVSLLQ

SEQ ID NO: 535657 - protein, 11 aa, Influenza virus
QLGNVINWTRD

SEQ ID NO: 535658 - protein, 11 aa, Influenza virus
QLGSWSWHDGA

SEQ ID NO: 535659 - protein, 11 aa, Influenza virus
QLIPMISKCKT

SEQ ID NO: 535660 - protein, 11 aa, Influenza virus
QLIPMISKCRT

SEQ ID NO: 535661 - protein, 11 aa, Influenza virus
QLIPMISKSRT

SEQ ID NO: 535662 - protein, 11 aa, Influenza virus
QLIWMACHSAA

SEQ ID NO: 535663 - protein, 11 aa, Influenza virus
QLKDNAKEIGN

SEQ ID NO: 535664 - protein, 11 aa, Influenza virus
QLKDNAKELGN

SEQ ID NO: 535665 - protein, 11 aa, Influenza virus
QLKDNARELGN

SEQ ID NO: 535666 - protein, 11 aa, Influenza virus
QLKKQEIEGIK

SEQ ID NO: 535667 - protein, 11 aa, Influenza virus
QLKLATGLKNV

SEQ ID NO: 535668 - protein, 11 aa, Influenza virus
QLKLATGLRNI

SEQ ID NO: 535669 - protein, 11 aa, Influenza virus
QLKLATGLRNV

SEQ ID NO: 535670 - protein, 11 aa, Influenza virus
QLKRQEIEGIK

SEQ ID NO: 535671 - protein, 11 aa, Influenza virus
QLLRHFQKDAK

SEQ ID NO: 535672 - protein, 11 aa, Influenza virus
QLLRHFQKDAR

SEQ ID NO: 535673 - protein, 11 aa, Influenza virus
QLLRHFQKNAK

SEQ ID NO: 535674 - protein, 11 aa, Influenza virus
QLLVLLENEKT

SEQ ID NO: 535675 - protein, 11 aa, Influenza virus
QLLVWLENEKT

SEQ ID NO: 535676 - protein, 11 aa, Influenza virus
QLNEGIMNTSK

SEQ ID NO: 535677 - protein, 11 aa, Influenza virus
QLNEGVINTSK

SEQ ID NO: 535678 - protein, 11 aa, Influenza virus
QLNEGVMNTSK

SEQ ID NO: 535679 - protein, 11 aa, Influenza virus
QLNPIDGPLPD

SEQ ID NO: 535680 - protein, 11 aa, Influenza virus
QLNPIDGPLPE

SEQ ID NO: 535681 - protein, 11 aa, Influenza virus
QLNPIDGPLPK

SEQ ID NO: 535682 - protein, 11 aa, Influenza virus
QLNPIDGPLPV

SEQ ID NO: 535683 - protein, 11 aa, Influenza virus
QLNQTYRNNRK

SEQ ID NO: 535684 - protein, 11 aa, Influenza virus
QLNQTYRNTRK

SEQ ID NO: 535685 - protein, 11 aa, Influenza virus
QLRDNAKEIGN

SEQ ID NO: 535686 - protein, 11 aa, Influenza virus
QLRDNAKELGN

SEQ ID NO: 535687 - protein, 11 aa, Influenza virus
QLRDNARELGN

SEQ ID NO: 535688 - protein, 11 aa, Influenza virus
QLRDNVKELGN

SEQ ID NO: 535689 - protein, 11 aa, Influenza virus
QLRENAEDIGN

SEQ ID NO: 535690 - protein, 11 aa, Influenza virus
QLRENAEDKGN

SEQ ID NO: 535691 - protein, 11 aa, Influenza virus
QLRENAEDLGN

SEQ ID NO: 535692 - protein, 11 aa, Influenza virus
QLRENAEDMGD

SEQ ID NO: 535693 - protein, 11 aa, Influenza virus
QLRENAEDMGG

SEQ ID NO: 535694 - protein, 11 aa, Influenza virus
QLRENAEDMGN

SEQ ID NO: 535695 - protein, 11 aa, Influenza virus
QLRENAEDQGN

SEQ ID NO: 535696 - protein, 11 aa, Influenza virus
QLRENAEDRGN

SEQ ID NO: 535697 - protein, 11 aa, Influenza virus
QLRENAEEDCT

SEQ ID NO: 535698 - protein, 11 aa, Influenza virus
QLRENAEEDGN

SEQ ID NO: 535699 - protein, 11 aa, Influenza virus
QLRENAEEDGT

SEQ ID NO: 535700 - protein, 11 aa, Influenza virus
QLRENAEEMGN

SEQ ID NO: 535701 - protein, 11 aa, Influenza virus
QLRQNAEEDGK

SEQ ID NO: 535702 - protein, 11 aa, Influenza virus
QLRQNAEEDGR

SEQ ID NO: 535703 - protein, 11 aa, Influenza virus
QLSQKFEEIRW

SEQ ID NO: 535704 - protein, 11 aa, Influenza virus
QLSSVSSFEKF

SEQ ID NO: 535705 - protein, 11 aa, Influenza virus
QLSSVSSFERF

SEQ ID NO: 535706 - protein, 11 aa, Influenza virus
QLSSVSSFKRF

SEQ ID NO: 535707 - protein, 11 aa, Influenza virus
QLSTVSSFERF

SEQ ID NO: 535708 - protein, 11 aa, Influenza virus
QLTEVETYVLS

SEQ ID NO: 535709 - protein, 11 aa, Influenza virus
QLTHHMRKKRG

SEQ ID NO: 535710 - protein, 11 aa, Influenza virus
QLVWMACHSAA

SEQ ID NO: 535711 - protein, 11 aa, Influenza virus
QLVWMACNSAA

SEQ ID NO: 535712 - protein, 11 aa, Influenza virus
QMAGSNEQAAE

SEQ ID NO: 535713 - protein, 11 aa, Influenza virus
QMAGSSEQAAE

SEQ ID NO: 535714 - protein, 11 aa, Influenza virus
QMAIDNMQNKL

SEQ ID NO: 535715 - protein, 11 aa, Influenza virus
QMALQLFIKDY

SEQ ID NO: 535716 - protein, 11 aa, Influenza virus
QMEKIVLLFAI

SEQ ID NO: 535717 - protein, 11 aa, Influenza virus
QMESRGLFGAI

SEQ ID NO: 535718 - protein, 11 aa, Influenza virus
QMNGQSGRIDF

SEQ ID NO: 535719 - protein, 11 aa, Influenza virus
QMQRFRRPDSS

SEQ ID NO: 535720 - protein, 11 aa, Influenza virus
QMRDILGTFDT

SEQ ID NO: 535721 - protein, 11 aa, Influenza virus
QMRDVIGTFDT

SEQ ID NO: 535722 - protein, 11 aa, Influenza virus
QMRDVLGTFDT

SEQ ID NO: 535723 - protein, 11 aa, Influenza virus
QMTRGLFGAIA

SEQ ID NO: 535724 - protein, 11 aa, Influenza virus
QNAEEDGKGCF

SEQ ID NO: 535725 - protein, 11 aa, Influenza virus
QNAEEDGRGCF

SEQ ID NO: 535726 - protein, 11 aa, Influenza virus
QNAEGIGIAAD

SEQ ID NO: 535727 - protein, 11 aa, Influenza virus
QNAEGTGIAAD

SEQ ID NO: 535728 - protein, 11 aa, Influenza virus
QNAEGTGMAAD

SEQ ID NO: 535729 - protein, 11 aa, Influenza virus
QNAEGTGTAAD

SEQ ID NO: 535730 - protein, 11 aa, Influenza virus
QNAISTTFPYT

SEQ ID NO: 535731 - protein, 11 aa, Influenza virus
QNALLKHRFEI

SEQ ID NO: 535732 - protein, 11 aa, Influenza virus
QNALNGNGDPN

SEQ ID NO: 535733 - protein, 11 aa, Influenza virus
QNALSGNGDPN

SEQ ID NO: 535734 - protein, 11 aa, Influenza virus
QNAQGEGIAAD

SEQ ID NO: 535735 - protein, 11 aa, Influenza virus
QNAQGEGTAAD

SEQ ID NO: 535736 - protein, 11 aa, Influenza virus
QNAQGIGQAAD

SEQ ID NO: 535737 - protein, 11 aa, Influenza virus
QNAQGQGTAAD

SEQ ID NO: 535738 - protein, 11 aa, Influenza virus
QNAQGSGYAAD

SEQ ID NO: 535739 - protein, 11 aa, Influenza virus
QNAQGTGLAAD

SEQ ID NO: 535740 - protein, 11 aa, Influenza virus
QNAQGTGQAAD

SEQ ID NO: 535741 - protein, 11 aa, Influenza virus
QNASRHHMGEC

SEQ ID NO: 535742 - protein, 11 aa, Influenza virus
QNASRHYMGEC

SEQ ID NO: 535743 - protein, 11 aa, Influenza virus
QNASRYYMGEC

SEQ ID NO: 535744 - protein, 11 aa, Influenza virus
QNEFNKACELT

SEQ ID NO: 535745 - protein, 11 aa, Influenza virus
QNEQGMGMAAD

SEQ ID NO: 535746 - protein, 11 aa, Influenza virus
QNEQGSGYAAD

SEQ ID NO: 535747 - protein, 11 aa, Influenza virus
QNEQGTGIAAD

SEQ ID NO: 535748 - protein, 11 aa, Influenza virus
QNEQGTGIAAE

SEQ ID NO: 535749 - protein, 11 aa, Influenza virus
QNEQGVGIAAD

SEQ ID NO: 535750 - protein, 11 aa, Influenza virus
QNEQGVGMAAD

SEQ ID NO: 535751 - protein, 11 aa, Influenza virus
QNFPQTANTYR

SEQ ID NO: 535752 - protein, 11 aa, Influenza virus
QNFPQTTNTYR

SEQ ID NO: 535753 - protein, 11 aa, Influenza virus
QNFPRTTNTYR

SEQ ID NO: 535754 - protein, 11 aa, Influenza virus
QNGKSGACKRA

SEQ ID NO: 535755 - protein, 11 aa, Influenza virus
QNGKSSACKRA

SEQ ID NO: 535756 - protein, 11 aa, Influenza virus
QNGNIRCQICI

SEQ ID NO: 535757 - protein, 11 aa, Influenza virus
QNGNIRCTFCI

SEQ ID NO: 535758 - protein, 11 aa, Influenza virus
QNGNLRCQICI

SEQ ID NO: 535759 - protein, 11 aa, Influenza virus
QNGNVRCQICI

SEQ ID NO: 535760 - protein, 11 aa, Influenza virus
QNGNVRCTFCI

SEQ ID NO: 535761 - protein, 11 aa, Influenza virus
QNGQGSGYAAD

SEQ ID NO: 535762 - protein, 11 aa, Influenza virus
QNGSCRCMFCI

SEQ ID NO: 535763 - protein, 11 aa, Influenza virus
QNGSYRCMFCI

SEQ ID NO: 535764 - protein, 11 aa, Influenza virus
QNHGICAVATT

SEQ ID NO: 535765 - protein, 11 aa, Influenza virus
QNICKPYIGKC

SEQ ID NO: 535766 - protein, 11 aa, Influenza virus
QNIDKNALGDC

SEQ ID NO: 535767 - protein, 11 aa, Influenza virus
QNIDKNALGEC

SEQ ID NO: 535768 - protein, 11 aa, Influenza virus
QNIDRNAIGDC

SEQ ID NO: 535769 - protein, 11 aa, Influenza virus
QNIDRNALGDC

SEQ ID NO: 535770 - protein, 11 aa, Influenza virus
QNIDSRAVGKC

SEQ ID NO: 535771 - protein, 11 aa, Influenza virus
QNIDSWAVGRC

SEQ ID NO: 535772 - protein, 11 aa, Influenza virus
QNIEKNALGDC

SEQ ID NO: 535773 - protein, 11 aa, Influenza virus
QNIERNALGDC

SEQ ID NO: 535774 - protein, 11 aa, Influenza virus
QNIERNALGNC

SEQ ID NO: 535775 - protein, 11 aa, Influenza virus
QNILRTQESEC

SEQ ID NO: 535776 - protein, 11 aa, Influenza virus
QNINRITYGAC

SEQ ID NO: 535777 - protein, 11 aa, Influenza virus
QNIPVTQTMEL

SEQ ID NO: 535778 - protein, 11 aa, Influenza virus
QNIPVTQVEEL

SEQ ID NO: 535779 - protein, 11 aa, Influenza virus
QNIWAYNAELL

SEQ ID NO: 535780 - protein, 11 aa, Influenza virus
QNKLNNVIDKM

SEQ ID NO: 535781 - protein, 11 aa, Influenza virus
QNKLYGAGNKL

SEQ ID NO: 535782 - protein, 11 aa, Influenza virus
QNKLYGTGNKL

SEQ ID NO: 535783 - protein, 11 aa, Influenza virus
QNLFTLSGVAI

SEQ ID NO: 535784 - protein, 11 aa, Influenza virus
QNLSPRTVGQC

SEQ ID NO: 535785 - protein, 11 aa, Influenza virus
QNLTKINNGDY

SEQ ID NO: 535786 - protein, 11 aa, Influenza virus
QNLTKTNNGDY

SEQ ID NO: 535787 - protein, 11 aa, Influenza virus
QNLTKVNNGDY

SEQ ID NO: 535788 - protein, 11 aa, Influenza virus
QNLTKVNNGNY

SEQ ID NO: 535789 - protein, 11 aa, Influenza virus
QNLTKVNSGDY

SEQ ID NO: 535790 - protein, 11 aa, Influenza virus
QNNAIDEGDGC

SEQ ID NO: 535791 - protein, 11 aa, Influenza virus
QNNFVPVIGAR

SEQ ID NO: 535792 - protein, 11 aa, Influenza virus
QNNFVPVVGAR

SEQ ID NO: 535793 - protein, 11 aa, Influenza virus
QNNTTLIENTY

SEQ ID NO: 535794 - protein, 11 aa, Influenza virus
QNNTTVVENTY

SEQ ID NO: 535795 - protein, 11 aa, Influenza virus
QNPRIFLAMIT

SEQ ID NO: 535796 - protein, 11 aa, Influenza virus
QNPRMFLAMIT

SEQ ID NO: 535797 - protein, 11 aa, Influenza virus
QNPRVFLAMIT

SEQ ID NO: 535798 - protein, 11 aa, Influenza virus
QNPRVFLTMIT

SEQ ID NO: 535799 - protein, 11 aa, Influenza virus
QNPTEEQAVDI

SEQ ID NO: 535800 - protein, 11 aa, Influenza virus
QNPTEEQAVEI

SEQ ID NO: 535801 - protein, 11 aa, Influenza virus
QNPTEEQAVGI

SEQ ID NO: 535802 - protein, 11 aa, Influenza virus
QNPTEEQAVNI

SEQ ID NO: 535803 - protein, 11 aa, Influenza virus
QNQNPRMFLAM

SEQ ID NO: 535804 - protein, 11 aa, Influenza virus
QNQVKIRRRVD

SEQ ID NO: 535805 - protein, 11 aa, Influenza virus
QNRGLFGAIAG

SEQ ID NO: 535806 - protein, 11 aa, Influenza virus
QNRGLFGAKAG

SEQ ID NO: 535807 - protein, 11 aa, Influenza virus
QNRIMINPVKL

SEQ ID NO: 535808 - protein, 11 aa, Influenza virus
QNRIQIDPVKL

SEQ ID NO: 535809 - protein, 11 aa, Influenza virus
QNRIQIDQVKL

SEQ ID NO: 535810 - protein, 11 aa, Influenza virus
QNRIQIDSVKL

SEQ ID NO: 535811 - protein, 11 aa, Influenza virus
QNRIQINPVKL

SEQ ID NO: 535812 - protein, 11 aa, Influenza virus
QNRIRIDPVKL

SEQ ID NO: 535813 - protein, 11 aa, Influenza virus
QNRLNNVIDKM

SEQ ID NO: 535814 - protein, 11 aa, Influenza virus
QNRMQFSSLTV

SEQ ID NO: 535815 - protein, 11 aa, Influenza virus
QNRMQINPVKL

SEQ ID NO: 535816 - protein, 11 aa, Influenza virus
QNRVKIDPVKL

SEQ ID NO: 535817 - protein, 11 aa, Influenza virus
QNSEGTGIAAD

SEQ ID NO: 535818 - protein, 11 aa, Influenza virus
QNSEGTGIVAD

SEQ ID NO: 535819 - protein, 11 aa, Influenza virus
QNSEGTGTAAD

SEQ ID NO: 535820 - protein, 11 aa, Influenza virus
QNSFVPVVGAR

SEQ ID NO: 535821 - protein, 11 aa, Influenza virus
QNSQGEGTAAD

SEQ ID NO: 535822 - protein, 11 aa, Influenza virus
QNTIDLTDSEM

SEQ ID NO: 535823 - protein, 11 aa, Influenza virus
QNTLKLATGMR

SEQ ID NO: 535824 - protein, 11 aa, Influenza virus
QNTQGEGTAAD

SEQ ID NO: 535825 - protein, 11 aa, Influenza virus
QNTSKHYIGKC

SEQ ID NO: 535826 - protein, 11 aa, Influenza virus
QNTSRHYIGKC

SEQ ID NO: 535827 - protein, 11 aa, Influenza virus
QNTSRHYMGEC

SEQ ID NO: 535828 - protein, 11 aa, Influenza virus
QNVNKITYGAC

SEQ ID NO: 535829 - protein, 11 aa, Influenza virus
QNVNRITYGAC

SEQ ID NO: 535830 - protein, 11 aa, Influenza virus
QNVNRITYGPC

SEQ ID NO: 535831 - protein, 11 aa, Influenza virus
QNVNRITYGVC

SEQ ID NO: 535832 - protein, 11 aa, Influenza virus
QNVPVTQAMEL

SEQ ID NO: 535833 - protein, 11 aa, Influenza virus
QNVPVTQTMEL

SEQ ID NO: 535834 - protein, 11 aa, Influenza virus
QNVPVTQVEEL

SEQ ID NO: 535835 - protein, 11 aa, Influenza virus
QNVSRIAIGNC

SEQ ID NO: 535836 - protein, 11 aa, Influenza virus
QPAATALANTI

SEQ ID NO: 535837 - protein, 11 aa, Influenza virus
QPAFSVQRNLP

SEQ ID NO: 535838 - protein, 11 aa, Influenza virus
QPCFYIELIRG

SEQ ID NO: 535839 - protein, 11 aa, Influenza virus
QPCFYVELIRG

SEQ ID NO: 535840 - protein, 11 aa, Influenza virus
QPCFYVELTRG

SEQ ID NO: 535841 - protein, 11 aa, Influenza virus
QPGDNITFLHN

SEQ ID NO: 535842 - protein, 11 aa, Influenza virus
QPGDNITFSDN

SEQ ID NO: 535843 - protein, 11 aa, Influenza virus
QPGDNITFSHN

SEQ ID NO: 535844 - protein, 11 aa, Influenza virus
QPISLGDCSFA

SEQ ID NO: 535845 - protein, 11 aa, Influenza virus
QPKEKAIWTSG

SEQ ID NO: 535846 - protein, 11 aa, Influenza virus
QPKEKTIWTSG

SEQ ID NO: 535847 - protein, 11 aa, Influenza virus
QPLSISVGSST

SEQ ID NO: 535848 - protein, 11 aa, Influenza virus
QPNDGQVLYFL

SEQ ID NO: 535849 - protein, 11 aa, Influenza virus
QPNERTIWTSG

SEQ ID NO: 535850 - protein, 11 aa, Influenza virus
QPNIGPRALVR

SEQ ID NO: 535851 - protein, 11 aa, Influenza virus
QPNIGPRPLVR

SEQ ID NO: 535852 - protein, 11 aa, Influenza virus
QPTFSVQRNLP

SEQ ID NO: 535853 - protein, 11 aa, Influenza virus
QPTFSVQRSLP

SEQ ID NO: 535854 - protein, 11 aa, Influenza virus
QQFELIDNEFN

SEQ ID NO: 535855 - protein, 11 aa, Influenza virus
QQFELIDNEFS

SEQ ID NO: 535856 - protein, 11 aa, Influenza virus
QQFELIDNEFT

SEQ ID NO: 535857 - protein, 11 aa, Influenza virus
QQFEMIDNEFN

SEQ ID NO: 535858 - protein, 11 aa, Influenza virus
QQFKLIDNEFT

SEQ ID NO: 535859 - protein, 11 aa, Influenza virus
QQGRMDYYWAI

SEQ ID NO: 535860 - protein, 11 aa, Influenza virus
QQGRMDYYWAV

SEQ ID NO: 535861 - protein, 11 aa, Influenza virus
QQGRMDYYWGI

SEQ ID NO: 535862 - protein, 11 aa, Influenza virus
QQGTMDYYWGI

SEQ ID NO: 535863 - protein, 11 aa, Influenza virus
QQGWMDYYWGI

SEQ ID NO: 535864 - protein, 11 aa, Influenza virus
QQIESIIEAES

SEQ ID NO: 535865 - protein, 11 aa, Influenza virus
QQIESMIEAES

SEQ ID NO: 535866 - protein, 11 aa, Influenza virus
QQIESMVEAES

SEQ ID NO: 535867 - protein, 11 aa, Influenza virus
QQIGNVINWTQ

SEQ ID NO: 535868 - protein, 11 aa, Influenza virus
QQIGNVINWTR

SEQ ID NO: 535869 - protein, 11 aa, Influenza virus
QQMRDILGTFD

SEQ ID NO: 535870 - protein, 11 aa, Influenza virus
QQMRDVIGTFD

SEQ ID NO: 535871 - protein, 11 aa, Influenza virus
QQMRDVLGTFD

SEQ ID NO: 535872 - protein, 11 aa, Influenza virus
QQSFSPSPGAR

SEQ ID NO: 535873 - protein, 11 aa, Influenza virus
QQSFSPSPGDR

SEQ ID NO: 535874 - protein, 11 aa, Influenza virus
QQTRVDKLTQG

SEQ ID NO: 535875 - protein, 11 aa, Influenza virus
QQTRVDRLTQG

SEQ ID NO: 535876 - protein, 11 aa, Influenza virus
QQVESMIEAES

SEQ ID NO: 535877 - protein, 11 aa, Influenza virus
QRAIDNMQNKL

SEQ ID NO: 535878 - protein, 11 aa, Influenza virus
QRAMMDQVREG

SEQ ID NO: 535879 - protein, 11 aa, Influenza virus
QRAMMDQVRES

SEQ ID NO: 535880 - protein, 11 aa, Influenza virus
QRAMVDQVRES

SEQ ID NO: 535881 - protein, 11 aa, Influenza virus
QRCCNLFEKFF

SEQ ID NO: 535882 - protein, 11 aa, Influenza virus
QRFRRPDSSWL

SEQ ID NO: 535883 - protein, 11 aa, Influenza virus
QRGILEDEQMY

SEQ ID NO: 535884 - protein, 11 aa, Influenza virus
QRGNIRCNICI

SEQ ID NO: 535885 - protein, 11 aa, Influenza virus
QRGVLEDEQMY

SEQ ID NO: 535886 - protein, 11 aa, Influenza virus
QRINGVKLEEN

SEQ ID NO: 535887 - protein, 11 aa, Influenza virus
QRINMLADRID

SEQ ID NO: 535888 - protein, 11 aa, Influenza virus
QRLNPMHQLLR

SEQ ID NO: 535889 - protein, 11 aa, Influenza virus
QRLNTMHQLLR

SEQ ID NO: 535890 - protein, 11 aa, Influenza virus
QRRRFIQNALN

SEQ ID NO: 535891 - protein, 11 aa, Influenza virus
QRRRFVQNALN

SEQ ID NO: 535892 - protein, 11 aa, Influenza virus
QRRRFVQNALS

SEQ ID NO: 535893 - protein, 11 aa, Influenza virus
QRSKFLLMDAL

SEQ ID NO: 535894 - protein, 11 aa, Influenza virus
QRSKFLLMDSL

SEQ ID NO: 535895 - protein, 11 aa, Influenza virus
QRSWMKIYWHL

SEQ ID NO: 535896 - protein, 11 aa, Influenza virus
QRSWMKLYWHL

SEQ ID NO: 535897 - protein, 11 aa, Influenza virus
QRTRALVRSGM

SEQ ID NO: 535898 - protein, 11 aa, Influenza virus
QRTRALVRTGM

SEQ ID NO: 535899 - protein, 11 aa, Influenza virus
QSAIDQITGKL

SEQ ID NO: 535900 - protein, 11 aa, Influenza virus
QSAIDQITRKL

SEQ ID NO: 535901 - protein, 11 aa, Influenza virus
QSAIDQVTGKL

SEQ ID NO: 535902 - protein, 11 aa, Influenza virus
QSAINQITGKL

SEQ ID NO: 535903 - protein, 11 aa, Influenza virus
QSAVDQITGKL

SEQ ID NO: 535904 - protein, 11 aa, Influenza virus
QSAVNQITGKL

SEQ ID NO: 535905 - protein, 11 aa, Influenza virus
QSDAQIDESCE

SEQ ID NO: 535906 - protein, 11 aa, Influenza virus
QSDKPFQNVSR

SEQ ID NO: 535907 - protein, 11 aa, Influenza virus
QSEFNKACELT

SEQ ID NO: 535908 - protein, 11 aa, Influenza virus
QSERGEDTIEE

SEQ ID NO: 535909 - protein, 11 aa, Influenza virus
QSERGEETIEE

SEQ ID NO: 535910 - protein, 11 aa, Influenza virus
QSERGEETVEE

SEQ ID NO: 535911 - protein, 11 aa, Influenza virus
QSFPQTTNTYR

SEQ ID NO: 535912 - protein, 11 aa, Influenza virus
QSFSPSPGARP

SEQ ID NO: 535913 - protein, 11 aa, Influenza virus
QSFSPSPGDRP

SEQ ID NO: 535914 - protein, 11 aa, Influenza virus
QSFYRSINWLT

SEQ ID NO: 535915 - protein, 11 aa, Influenza virus
QSGHIEECSCY

SEQ ID NO: 535916 - protein, 11 aa, Influenza virus
QSGLPVGGNEK

SEQ ID NO: 535917 - protein, 11 aa, Influenza virus
QSGRIDFHWLI

SEQ ID NO: 535918 - protein, 11 aa, Influenza virus
QSGRIDFHWLL

SEQ ID NO: 535919 - protein, 11 aa, Influenza virus
QSGRIDFHWLM

SEQ ID NO: 535920 - protein, 11 aa, Influenza virus
QSGRIDFHWLV

SEQ ID NO: 535921 - protein, 11 aa, Influenza virus
QSGRISFYWTI

SEQ ID NO: 535922 - protein, 11 aa, Influenza virus
QSGRISIYWTL

SEQ ID NO: 535923 - protein, 11 aa, Influenza virus
QSGRVSFYWTI

SEQ ID NO: 535924 - protein, 11 aa, Influenza virus
QSKGLFGAIAG

SEQ ID NO: 535925 - protein, 11 aa, Influenza virus
QSKMQFSSLTV

SEQ ID NO: 535926 - protein, 11 aa, Influenza virus
QSLIIAARNIV

SEQ ID NO: 535927 - protein, 11 aa, Influenza virus
QSLIIAARSIV

SEQ ID NO: 535928 - protein, 11 aa, Influenza virus
QSLQQIESIIE

SEQ ID NO: 535929 - protein, 11 aa, Influenza virus
QSLQQIESMIE

SEQ ID NO: 535930 - protein, 11 aa, Influenza virus
QSLQQIESMVE

SEQ ID NO: 535931 - protein, 11 aa, Influenza virus
QSLRSILANNG

SEQ ID NO: 535932 - protein, 11 aa, Influenza virus
QSLRSILASSG

SEQ ID NO: 535933 - protein, 11 aa, Influenza virus
QSLSISIGSST

SEQ ID NO: 535934 - protein, 11 aa, Influenza virus
QSLSISVESST

SEQ ID NO: 535935 - protein, 11 aa, Influenza virus
QSLSISVGSST

SEQ ID NO: 535936 - protein, 11 aa, Influenza virus
QSLVIAARNIV

SEQ ID NO: 535937 - protein, 11 aa, Influenza virus
QSNNSTDTVDT

SEQ ID NO: 535938 - protein, 11 aa, Influenza virus
QSNNSTDTVNT

SEQ ID NO: 535939 - protein, 11 aa, Influenza virus
QSNNSTNTVNT

SEQ ID NO: 535940 - protein, 11 aa, Influenza virus
QSPLGAINTTL

SEQ ID NO: 535941 - protein, 11 aa, Influenza virus
QSPNVYQAKFE

SEQ ID NO: 535942 - protein, 11 aa, Influenza virus
QSPNVYQARFE

SEQ ID NO: 535943 - protein, 11 aa, Influenza virus
QSPNVYQSRFE

SEQ ID NO: 535944 - protein, 11 aa, Influenza virus
QSPRMFLAMIT

SEQ ID NO: 535945 - protein, 11 aa, Influenza virus
QSRFEAVAWSA

SEQ ID NO: 535946 - protein, 11 aa, Influenza virus
QSRGLFGAIAG

SEQ ID NO: 535947 - protein, 11 aa, Influenza virus
QSRMQFSSFTV

SEQ ID NO: 535948 - protein, 11 aa, Influenza virus
QSRMQFSSLAV

SEQ ID NO: 535949 - protein, 11 aa, Influenza virus
QSRMQFSSLTV

SEQ ID NO: 535950 - protein, 11 aa, Influenza virus
QSSDDFALILN

SEQ ID NO: 535951 - protein, 11 aa, Influenza virus
QSSDDFALIVN

SEQ ID NO: 535952 - protein, 11 aa, Influenza virus
QSSLPLALGMK

SEQ ID NO: 535953 - protein, 11 aa, Influenza virus
QSTLKLATGMR

SEQ ID NO: 535954 - protein, 11 aa, Influenza virus
QSWSYIVERPS

SEQ ID NO: 535955 - protein, 11 aa, Influenza virus
QSYFQLFLVCV

SEQ ID NO: 535956 - protein, 11 aa, Influenza virus
QTAAQKAMMDQ

SEQ ID NO: 535957 - protein, 11 aa, Influenza virus
QTAAQRAMMDQ

SEQ ID NO: 535958 - protein, 11 aa, Influenza virus
QTAAQRAMVDQ

SEQ ID NO: 535959 - protein, 11 aa, Influenza virus
QTAIDQINGKL

SEQ ID NO: 535960 - protein, 11 aa, Influenza virus
QTAIDQITGKL

SEQ ID NO: 535961 - protein, 11 aa, Influenza virus
QTALYKNANTL

SEQ ID NO: 535962 - protein, 11 aa, Influenza virus
QTANTYRNTDS

SEQ ID NO: 535963 - protein, 11 aa, Influenza virus
QTATKRIRLAI

SEQ ID NO: 535964 - protein, 11 aa, Influenza virus
QTATKRIRMAI

SEQ ID NO: 535965 - protein, 11 aa, Influenza virus
QTATKRIRMAT

SEQ ID NO: 535966 - protein, 11 aa, Influenza virus
QTATKRLRMAI

SEQ ID NO: 535967 - protein, 11 aa, Influenza virus
QTDCVLEAMAF

SEQ ID NO: 535968 - protein, 11 aa, Influenza virus
QTDCVLEAMAL

SEQ ID NO: 535969 - protein, 11 aa, Influenza virus
QTDEYKNTGDS

SEQ ID NO: 535970 - protein, 11 aa, Influenza virus
QTDEYKNTRDS

SEQ ID NO: 535971 - protein, 11 aa, Influenza virus
QTDLYKVATGR

SEQ ID NO: 535972 - protein, 11 aa, Influenza virus
QTESRGLFGAI

SEQ ID NO: 535973 - protein, 11 aa, Influenza virus
QTFDWTLNRNQ

SEQ ID NO: 535974 - protein, 11 aa, Influenza virus
QTIVLDTDWSG

SEQ ID NO: 535975 - protein, 11 aa, Influenza virus
QTIVLNTDWSG

SEQ ID NO: 535976 - protein, 11 aa, Influenza virus
QTIVLTTDWSG

SEQ ID NO: 535977 - protein, 11 aa, Influenza virus
QTKKMTITFLI

SEQ ID NO: 535978 - protein, 11 aa, Influenza virus
QTKLYGNGNKL

SEQ ID NO: 535979 - protein, 11 aa, Influenza virus
QTKLYGSGNKL

SEQ ID NO: 535980 - protein, 11 aa, Influenza virus
QTKLYGSGSKL

SEQ ID NO: 535981 - protein, 11 aa, Influenza virus
QTKLYKNTNTL

SEQ ID NO: 535982 - protein, 11 aa, Influenza virus
QTKTMTITFLI

SEQ ID NO: 535983 - protein, 11 aa, Influenza virus
QTLVANNDWSG

SEQ ID NO: 535984 - protein, 11 aa, Influenza virus
QTLVSNDDWSG

SEQ ID NO: 535985 - protein, 11 aa, Influenza virus
QTLVSNNDWSG

SEQ ID NO: 535986 - protein, 11 aa, Influenza virus
QTLVSNSDWSG

SEQ ID NO: 535987 - protein, 11 aa, Influenza virus
QTMELVEAEKH

SEQ ID NO: 535988 - protein, 11 aa, Influenza virus
QTMELVETEKH

SEQ ID NO: 535989 - protein, 11 aa, Influenza virus
QTMELVETEKN

SEQ ID NO: 535990 - protein, 11 aa, Influenza virus
QTMELVETKKH

SEQ ID NO: 535991 - protein, 11 aa, Influenza virus
QTNGNLIAPEY

SEQ ID NO: 535992 - protein, 11 aa, Influenza virus
QTNNSTDTVNT

SEQ ID NO: 535993 - protein, 11 aa, Influenza virus
QTNNSTETVNT

SEQ ID NO: 535994 - protein, 11 aa, Influenza virus
QTNTTLIENTY

SEQ ID NO: 535995 - protein, 11 aa, Influenza virus
QTPLGAINTTL

SEQ ID NO: 535996 - protein, 11 aa, Influenza virus
QTPLGALNTTL

SEQ ID NO: 535997 - protein, 11 aa, Influenza virus
QTRGIFGAIAG

SEQ ID NO: 535998 - protein, 11 aa, Influenza virus
QTRGLFGAIAG

SEQ ID NO: 535999 - protein, 11 aa, Influenza virus
QTRVDKLTQGR

SEQ ID NO: 536000 - protein, 11 aa, Influenza virus
QTRVDRLTQGR

SEQ ID NO: 536001 - protein, 11 aa, Influenza virus
QTSGNLIAPEY

SEQ ID NO: 536002 - protein, 11 aa, Influenza virus
QTSLLLATGMR

SEQ ID NO: 536003 - protein, 11 aa, Influenza virus
QTSVGGIDTNK

SEQ ID NO: 536004 - protein, 11 aa, Influenza virus
QTSVGGINTNK

SEQ ID NO: 536005 - protein, 11 aa, Influenza virus
QTSVGGINTNR

SEQ ID NO: 536006 - protein, 11 aa, Influenza virus
QTTLYKNANTL

SEQ ID NO: 536007 - protein, 11 aa, Influenza virus
QTTNTYRNTDP

SEQ ID NO: 536008 - protein, 11 aa, Influenza virus
QTTNTYRNTDS

SEQ ID NO: 536009 - protein, 11 aa, Influenza virus
QTTNTYRNTDT

SEQ ID NO: 536010 - protein, 11 aa, Influenza virus
QTVKIKTNGNL

SEQ ID NO: 536011 - protein, 11 aa, Influenza virus
QTVKIQTNGNL

SEQ ID NO: 536012 - protein, 11 aa, Influenza virus
QTVKIQTSGNL

SEQ ID NO: 536013 - protein, 11 aa, Influenza virus
QTVVLNTDWSG

SEQ ID NO: 536014 - protein, 11 aa, Influenza virus
QTYAGAINSSK

SEQ ID NO: 536015 - protein, 11 aa, Influenza virus
QTYAGAINSSR

SEQ ID NO: 536016 - protein, 11 aa, Influenza virus
QTYAGAVNSSK

SEQ ID NO: 536017 - protein, 11 aa, Influenza virus
QTYDWTLNRNQ

SEQ ID NO: 536018 - protein, 11 aa, Influenza virus
QTYQKRMGVQM

SEQ ID NO: 536019 - protein, 11 aa, Influenza virus
QTYRNNRKEPA

SEQ ID NO: 536020 - protein, 11 aa, Influenza virus
QTYRNTRKEPA

SEQ ID NO: 536021 - protein, 11 aa, Influenza virus
QTYTGAINSSK

SEQ ID NO: 536022 - protein, 11 aa, Influenza virus
QTYTGAINSSR

SEQ ID NO: 536023 - protein, 11 aa, Influenza virus
QVAGSSEQAAE

SEQ ID NO: 536024 - protein, 11 aa, Influenza virus
QVCAAWSSSSC

SEQ ID NO: 536025 - protein, 11 aa, Influenza virus
QVCIAWSSASC

SEQ ID NO: 536026 - protein, 11 aa, Influenza virus
QVCIAWSSSSC

SEQ ID NO: 536027 - protein, 11 aa, Influenza virus
QVCMAWSSSSC

SEQ ID NO: 536028 - protein, 11 aa, Influenza virus
QVCVAWSSSSC

SEQ ID NO: 536029 - protein, 11 aa, Influenza virus
QVDCFLWHVRK

SEQ ID NO: 536030 - protein, 11 aa, Influenza virus
QVDTIMEKNIT

SEQ ID NO: 536031 - protein, 11 aa, Influenza virus
QVDTIMEKNVT

SEQ ID NO: 536032 - protein, 11 aa, Influenza virus
QVDTIMERNVT

SEQ ID NO: 536033 - protein, 11 aa, Influenza virus
QVECVCRDNWN

SEQ ID NO: 536034 - protein, 11 aa, Influenza virus
QVEELVHGGID

SEQ ID NO: 536035 - protein, 11 aa, Influenza virus
QVEELVHGGIN

SEQ ID NO: 536036 - protein, 11 aa, Influenza virus
QVEELVHGGVD

SEQ ID NO: 536037 - protein, 11 aa, Influenza virus
QVEELVHGQVN

SEQ ID NO: 536038 - protein, 11 aa, Influenza virus
QVEELVHRGID

SEQ ID NO: 536039 - protein, 11 aa, Influenza virus
QVEGRIQDLEK

SEQ ID NO: 536040 - protein, 11 aa, Influenza virus
QVEKRINMIAD

SEQ ID NO: 536041 - protein, 11 aa, Influenza virus
QVEKRINMLAD

SEQ ID NO: 536042 - protein, 11 aa, Influenza virus
QVENRINMLAD

SEQ ID NO: 536043 - protein, 11 aa, Influenza virus
QVEQRINMLAD

SEQ ID NO: 536044 - protein, 11 aa, Influenza virus
QVERRINMLAD

SEQ ID NO: 536045 - protein, 11 aa, Influenza virus
QVESMIEAESS

SEQ ID NO: 536046 - protein, 11 aa, Influenza virus
QVEVTNATELV

SEQ ID NO: 536047 - protein, 11 aa, Influenza virus
QVFPQLNQTYR

SEQ ID NO: 536048 - protein, 11 aa, Influenza virus
QVIKLLPFAAA

SEQ ID NO: 536049 - protein, 11 aa, Influenza virus
QVIVTREPYVS

SEQ ID NO: 536050 - protein, 11 aa, Influenza virus
QVKIRRRVDIN

SEQ ID NO: 536051 - protein, 11 aa, Influenza virus
QVKIRRRVDMN

SEQ ID NO: 536052 - protein, 11 aa, Influenza virus
QVKIRRRVDTN

SEQ ID NO: 536053 - protein, 11 aa, Influenza virus
QVKIRRRVDVN

SEQ ID NO: 536054 - protein, 11 aa, Influenza virus
QVKLSSGYKDI

SEQ ID NO: 536055 - protein, 11 aa, Influenza virus
QVLAIYATVAG

SEQ ID NO: 536056 - protein, 11 aa, Influenza virus
QVNGQFGRIDF

SEQ ID NO: 536057 - protein, 11 aa, Influenza virus
QVNGQSGRIDF

SEQ ID NO: 536058 - protein, 11 aa, Influenza virus
QVNGQSGRINF

SEQ ID NO: 536059 - protein, 11 aa, Influenza virus
QVREGRNPGNA

SEQ ID NO: 536060 - protein, 11 aa, Influenza virus
QVRESRNPGNA

SEQ ID NO: 536061 - protein, 11 aa, Influenza virus
QVTDIWAYNAE

SEQ ID NO: 536062 - protein, 11 aa, Influenza virus
QVTGKLNRLIE

SEQ ID NO: 536063 - protein, 11 aa, Influenza virus
QWDWPDGAKIE

SEQ ID NO: 536064 - protein, 11 aa, Influenza virus
QWNWPDGAEIE

SEQ ID NO: 536065 - protein, 11 aa, Influenza virus
QWNWPDGAKIE

SEQ ID NO: 536066 - protein, 11 aa, Influenza virus
QYICSPVLTDN

SEQ ID NO: 536067 - protein, 11 aa, Influenza virus
QYLCTGILTDT

SEQ ID NO: 536068 - protein, 11 aa, Influenza virus
QYLCTGVLTDT

SEQ ID NO: 536069 - protein, 11 aa, Influenza virus
QYLLFQDILMR

SEQ ID NO: 536070 - protein, 11 aa, Influenza virus
QYPNVRCVCRD

SEQ ID NO: 536071 - protein, 11 aa, Influenza virus
QYRALISWPLS

SEQ ID NO: 536072 - protein, 11 aa, Influenza virus
QYRALISWPQS

SEQ ID NO: 536073 - protein, 11 aa, Influenza virus
QYRALVSWPLS

SEQ ID NO: 536074 - protein, 11 aa, Influenza virus
QYREEALLNRI

SEQ ID NO: 536075 - protein, 11 aa, Influenza virus
QYREEALLNRL

SEQ ID NO: 536076 - protein, 11 aa, Influenza virus
QYREESLLNRL

SEQ ID NO: 536077 - protein, 11 aa, Influenza virus
QYRSLISWPLS

SEQ ID NO: 536078 - protein, 11 aa, Influenza virus
QYRTESLQNRI

SEQ ID NO: 536079 - protein, 11 aa, Influenza virus
QYSGFVRTLFQ

SEQ ID NO: 536080 - protein, 11 aa, Influenza virus
RAAVSADPLAS

SEQ ID NO: 536081 - protein, 11 aa, Influenza virus
RACFYVELIRG

SEQ ID NO: 536082 - protein, 11 aa, Influenza virus
RADEICIGYLS

SEQ ID NO: 536083 - protein, 11 aa, Influenza virus
RADKICIGYLS

SEQ ID NO: 536084 - protein, 11 aa, Influenza virus
RAGYEMLKVPN

SEQ ID NO: 536085 - protein, 11 aa, Influenza virus
RAIATPGMQIR

SEQ ID NO: 536086 - protein, 11 aa, Influenza virus
RAIDNMQNKLN

SEQ ID NO: 536087 - protein, 11 aa, Influenza virus
RAIVSADPLAS

SEQ ID NO: 536088 - protein, 11 aa, Influenza virus
RALISWEMGLA

SEQ ID NO: 536089 - protein, 11 aa, Influenza virus
RALISWEMGQA

SEQ ID NO: 536090 - protein, 11 aa, Influenza virus
RALISWGMGQA

SEQ ID NO: 536091 - protein, 11 aa, Influenza virus
RALISWPLSSP

SEQ ID NO: 536092 - protein, 11 aa, Influenza virus
RALISWPQSSP

SEQ ID NO: 536093 - protein, 11 aa, Influenza virus
RALLAKSVFNS

SEQ ID NO: 536094 - protein, 11 aa, Influenza virus
RALMSVLLGSS

SEQ ID NO: 536095 - protein, 11 aa, Influenza virus
RALMSVPLGSS

SEQ ID NO: 536096 - protein, 11 aa, Influenza virus
RALSIYSCIAS

SEQ ID NO: 536097 - protein, 11 aa, Influenza virus
RALTLNTMTKD

SEQ ID NO: 536098 - protein, 11 aa, Influenza virus
RALVRGQQGRM

SEQ ID NO: 536099 - protein, 11 aa, Influenza virus
RALVRSGMDPR

SEQ ID NO: 536100 - protein, 11 aa, Influenza virus
RALVRTGMDPR

SEQ ID NO: 536101 - protein, 11 aa, Influenza virus
RALVSWEMGQA

SEQ ID NO: 536102 - protein, 11 aa, Influenza virus
RALVSWPLSSP

SEQ ID NO: 536103 - protein, 11 aa, Influenza virus
RAMMDQVREGR

SEQ ID NO: 536104 - protein, 11 aa, Influenza virus
RAMMDQVRESR

SEQ ID NO: 536105 - protein, 11 aa, Influenza virus
RAMVDQVRESR

SEQ ID NO: 536106 - protein, 11 aa, Influenza virus
RANQRLNPMHQ

SEQ ID NO: 536107 - protein, 11 aa, Influenza virus
RANQRLNTMHQ

SEQ ID NO: 536108 - protein, 11 aa, Influenza virus
RAPYRSLIRFP

SEQ ID NO: 536109 - protein, 11 aa, Influenza virus
RARIDARIDFE

SEQ ID NO: 536110 - protein, 11 aa, Influenza virus
RARIDARVDFE

SEQ ID NO: 536111 - protein, 11 aa, Influenza virus
RARIDARVDSE

SEQ ID NO: 536112 - protein, 11 aa, Influenza virus
RARIKTRLFTI

SEQ ID NO: 536113 - protein, 11 aa, Influenza virus
RARPQVNGQSG

SEQ ID NO: 536114 - protein, 11 aa, Influenza virus
RATEYIIKGVY

SEQ ID NO: 536115 - protein, 11 aa, Influenza virus
RATEYIMKGVY

SEQ ID NO: 536116 - protein, 11 aa, Influenza virus
RATEYMMKGVY

SEQ ID NO: 536117 - protein, 11 aa, Influenza virus
RATFLRSNAPS

SEQ ID NO: 536118 - protein, 11 aa, Influenza virus
RATVSADPLAS

SEQ ID NO: 536119 - protein, 11 aa, Influenza virus
RATVSADPLLS

SEQ ID NO: 536120 - protein, 11 aa, Influenza virus
RATVSADPLVS

SEQ ID NO: 536121 - protein, 11 aa, Influenza virus
RAVDGTIAGFI

SEQ ID NO: 536122 - protein, 11 aa, Influenza virus
RAVGKCPRYVK

SEQ ID NO: 536123 - protein, 11 aa, Influenza virus
RAVKLYKKLKR

SEQ ID NO: 536124 - protein, 11 aa, Influenza virus
RAVKLYRKLKR

SEQ ID NO: 536125 - protein, 11 aa, Influenza virus
RAWLHVCVTGD

SEQ ID NO: 536126 - protein, 11 aa, Influenza virus
RCCNLFEKFFP

SEQ ID NO: 536127 - protein, 11 aa, Influenza virus
RCDDQCMESIR

SEQ ID NO: 536128 - protein, 11 aa, Influenza virus
RCFYVELIRGK

SEQ ID NO: 536129 - protein, 11 aa, Influenza virus
RCFYVELIRGM

SEQ ID NO: 536130 - protein, 11 aa, Influenza virus
RCFYVELIRGR

SEQ ID NO: 536131 - protein, 11 aa, Influenza virus
RCFYVELIRGS

SEQ ID NO: 536132 - protein, 11 aa, Influenza virus
RCFYVELTRGR

SEQ ID NO: 536133 - protein, 11 aa, Influenza virus
RCFYVELVRGR

SEQ ID NO: 536134 - protein, 11 aa, Influenza virus
RCICEKLEQSG

SEQ ID NO: 536135 - protein, 11 aa, Influenza virus
RCICRDNWKGS

SEQ ID NO: 536136 - protein, 11 aa, Influenza virus
RCINRCFYVEL

SEQ ID NO: 536137 - protein, 11 aa, Influenza virus
RCLLQSLQQIE

SEQ ID NO: 536138 - protein, 11 aa, Influenza virus
RCNTKCQTSLG

SEQ ID NO: 536139 - protein, 11 aa, Influenza virus
RCNTKCQTSVG

SEQ ID NO: 536140 - protein, 11 aa, Influenza virus
RCNTRCQTSVG

SEQ ID NO: 536141 - protein, 11 aa, Influenza virus
RCPRYVKQSSL

SEQ ID NO: 536142 - protein, 11 aa, Influenza virus
RCQTPLGAINT

SEQ ID NO: 536143 - protein, 11 aa, Influenza virus
RCQTSVGGINT

SEQ ID NO: 536144 - protein, 11 aa, Influenza virus
RCRETRGLFGA

SEQ ID NO: 536145 - protein, 11 aa, Influenza virus
RCRKTRGLFGA

SEQ ID NO: 536146 - protein, 11 aa, Influenza virus
RCTCRDNWKGS

SEQ ID NO: 536147 - protein, 11 aa, Influenza virus
RCTISLVKTTL

SEQ ID NO: 536148 - protein, 11 aa, Influenza virus
RCVCRDNWKGS

SEQ ID NO: 536149 - protein, 11 aa, Influenza virus
RCVCRDNWMGS

SEQ ID NO: 536150 - protein, 11 aa, Influenza virus
RCVCRDNWRGS

SEQ ID NO: 536151 - protein, 11 aa, Influenza virus
RCYQFALGQGT

SEQ ID NO: 536152 - protein, 11 aa, Influenza virus
RDAMTEIWSYN

SEQ ID NO: 536153 - protein, 11 aa, Influenza virus
RDAMTEVWSYN

SEQ ID NO: 536154 - protein, 11 aa, Influenza virus
RDCKIEAVIYG

SEQ ID NO: 536155 - protein, 11 aa, Influenza virus
RDCKVEAVIYG

SEQ ID NO: 536156 - protein, 11 aa, Influenza virus
RDCSIAGWLLG

SEQ ID NO: 536157 - protein, 11 aa, Influenza virus
RDCSVAGWLLG

SEQ ID NO: 536158 - protein, 11 aa, Influenza virus
RDDAINNRFQI

SEQ ID NO: 536159 - protein, 11 aa, Influenza virus
RDDLEPGTFDI

SEQ ID NO: 536160 - protein, 11 aa, Influenza virus
RDEAINNRFQI

SEQ ID NO: 536161 - protein, 11 aa, Influenza virus
RDEAINNRIKI

SEQ ID NO: 536162 - protein, 11 aa, Influenza virus
RDEAINSRFQI

SEQ ID NO: 536163 - protein, 11 aa, Influenza virus
RDEAISNRFQI

SEQ ID NO: 536164 - protein, 11 aa, Influenza virus
RDEGNGCFTFY

SEQ ID NO: 536165 - protein, 11 aa, Influenza virus
RDILRTQESEC

SEQ ID NO: 536166 - protein, 11 aa, Influenza virus
RDILRTQESSC

SEQ ID NO: 536167 - protein, 11 aa, Influenza virus
RDITIGSICMV

SEQ ID NO: 536168 - protein, 11 aa, Influenza virus
RDLGNCHPIGM

SEQ ID NO: 536169 - protein, 11 aa, Influenza virus
RDNAKDEGNGC

SEQ ID NO: 536170 - protein, 11 aa, Influenza virus
RDNAKDLGNGC

SEQ ID NO: 536171 - protein, 11 aa, Influenza virus
RDNAKEIGNGC

SEQ ID NO: 536172 - protein, 11 aa, Influenza virus
RDNAKELGNGC

SEQ ID NO: 536173 - protein, 11 aa, Influenza virus
RDNAMILGNGC

SEQ ID NO: 536174 - protein, 11 aa, Influenza virus
RDNANDLGNGC

SEQ ID NO: 536175 - protein, 11 aa, Influenza virus
RDNLEPGTFDI

SEQ ID NO: 536176 - protein, 11 aa, Influenza virus
RDNLEPGTFDL

SEQ ID NO: 536177 - protein, 11 aa, Influenza virus
RDNVKELGDGC

SEQ ID NO: 536178 - protein, 11 aa, Influenza virus
RDNVKELGNGC

SEQ ID NO: 536179 - protein, 11 aa, Influenza virus
RDNWHASNRPW

SEQ ID NO: 536180 - protein, 11 aa, Influenza virus
RDNWHGSNRPW

SEQ ID NO: 536181 - protein, 11 aa, Influenza virus
RDNWKGANRPI

SEQ ID NO: 536182 - protein, 11 aa, Influenza virus
RDNWKGANRPV

SEQ ID NO: 536183 - protein, 11 aa, Influenza virus
RDNWKGSNRPI

SEQ ID NO: 536184 - protein, 11 aa, Influenza virus
RDNWKGSNRPV

SEQ ID NO: 536185 - protein, 11 aa, Influenza virus
RDNWKGSNRPW

SEQ ID NO: 536186 - protein, 11 aa, Influenza virus
RDNWKSSNRPV

SEQ ID NO: 536187 - protein, 11 aa, Influenza virus
RDNWMGSNRPV

SEQ ID NO: 536188 - protein, 11 aa, Influenza virus
RDNWNGMNRPI

SEQ ID NO: 536189 - protein, 11 aa, Influenza virus
RDNWNGMNRPV

SEQ ID NO: 536190 - protein, 11 aa, Influenza virus
RDNWQGANRPI

SEQ ID NO: 536191 - protein, 11 aa, Influenza virus
RDNWQGANRPV

SEQ ID NO: 536192 - protein, 11 aa, Influenza virus
RDNWQGSNRPV

SEQ ID NO: 536193 - protein, 11 aa, Influenza virus
RDNWRGANRPV

SEQ ID NO: 536194 - protein, 11 aa, Influenza virus
RDNWRGSNRPI

SEQ ID NO: 536195 - protein, 11 aa, Influenza virus
RDNWRGSNRPV

SEQ ID NO: 536196 - protein, 11 aa, Influenza virus
RDNWRGSNRPW

SEQ ID NO: 536197 - protein, 11 aa, Influenza virus
RDNWTGTNRPI

SEQ ID NO: 536198 - protein, 11 aa, Influenza virus
RDNWTGTNRPV

SEQ ID NO: 536199 - protein, 11 aa, Influenza virus
RDQGWSYIVER

SEQ ID NO: 536200 - protein, 11 aa, Influenza virus
RDQKSLRGRGS

SEQ ID NO: 536201 - protein, 11 aa, Influenza virus
RDSIKSWRNNI

SEQ ID NO: 536202 - protein, 11 aa, Influenza virus
RDSITEVWSYN

SEQ ID NO: 536203 - protein, 11 aa, Influenza virus
RDSLEPGTFDL

SEQ ID NO: 536204 - protein, 11 aa, Influenza virus
RDSLTEIWSYN

SEQ ID NO: 536205 - protein, 11 aa, Influenza virus
RDSMTEIWSYN

SEQ ID NO: 536206 - protein, 11 aa, Influenza virus
RDSMTEVWSYN

SEQ ID NO: 536207 - protein, 11 aa, Influenza virus
RDSRSGYETFK

SEQ ID NO: 536208 - protein, 11 aa, Influenza virus
RDSRSGYETFR

SEQ ID NO: 536209 - protein, 11 aa, Influenza virus
RDSSILTDSQT

SEQ ID NO: 536210 - protein, 11 aa, Influenza virus
RDSTQKAIDIM

SEQ ID NO: 536211 - protein, 11 aa, Influenza virus
RDSTQKAIDNM

SEQ ID NO: 536212 - protein, 11 aa, Influenza virus
RDSTQMAIDNM

SEQ ID NO: 536213 - protein, 11 aa, Influenza virus
RDSTQRAIDNM

SEQ ID NO: 536214 - protein, 11 aa, Influenza virus
RDSVTELWSYN

SEQ ID NO: 536215 - protein, 11 aa, Influenza virus
RDVLVIWGIHH

SEQ ID NO: 536216 - protein, 11 aa, Influenza virus
RDVLVLWGIHH

SEQ ID NO: 536217 - protein, 11 aa, Influenza virus
RDVLVMWGIHH

SEQ ID NO: 536218 - protein, 11 aa, Influenza virus
RDVLVMWGLHH

SEQ ID NO: 536219 - protein, 11 aa, Influenza virus
RDVWTYNAELL

SEQ ID NO: 536220 - protein, 11 aa, Influenza virus
RECFNPCFYVE

SEQ ID NO: 536221 - protein, 11 aa, Influenza virus
REEALLNRLNI

SEQ ID NO: 536222 - protein, 11 aa, Influenza virus
REEALLNRLSI

SEQ ID NO: 536223 - protein, 11 aa, Influenza virus
REEALLSRLNI

SEQ ID NO: 536224 - protein, 11 aa, Influenza virus
REEAMQNRIQI

SEQ ID NO: 536225 - protein, 11 aa, Influenza virus
REESLLNRLSI

SEQ ID NO: 536226 - protein, 11 aa, Influenza virus
REESQLKKQEI

SEQ ID NO: 536227 - protein, 11 aa, Influenza virus
REESQLKRQEI

SEQ ID NO: 536228 - protein, 11 aa, Influenza virus
REEVTNATETV

SEQ ID NO: 536229 - protein, 11 aa, Influenza virus
REFEVMNHEFS

SEQ ID NO: 536230 - protein, 11 aa, Influenza virus
REFEVVDHEFS

SEQ ID NO: 536231 - protein, 11 aa, Influenza virus
REFEVVNHEFS

SEQ ID NO: 536232 - protein, 11 aa, Influenza virus
REFGVVNHEFS

SEQ ID NO: 536233 - protein, 11 aa, Influenza virus
REGKHIVERIL

SEQ ID NO: 536234 - protein, 11 aa, Influenza virus
REGLILEYYFV

SEQ ID NO: 536235 - protein, 11 aa, Influenza virus
REGRNPGNAEI

SEQ ID NO: 536236 - protein, 11 aa, Influenza virus
REGRRKTNLYG

SEQ ID NO: 536237 - protein, 11 aa, Influenza virus
REGYSLVGIDP

SEQ ID NO: 536238 - protein, 11 aa, Influenza virus
REIGNGCFEFY

SEQ ID NO: 536239 - protein, 11 aa, Influenza virus
REILTKITVDH

SEQ ID NO: 536240 - protein, 11 aa, Influenza virus
REILTKTTVDH

SEQ ID NO: 536241 - protein, 11 aa, Influenza virus
REILTRTTVDH

SEQ ID NO: 536242 - protein, 11 aa, Influenza virus
REITFHGAKEI

SEQ ID NO: 536243 - protein, 11 aa, Influenza virus
REITFHGAKEV

SEQ ID NO: 536244 - protein, 11 aa, Influenza virus
REITFHRAKEV

SEQ ID NO: 536245 - protein, 11 aa, Influenza virus
REITFYGAKEI

SEQ ID NO: 536246 - protein, 11 aa, Influenza virus
REKNVTVTHSV

SEQ ID NO: 536247 - protein, 11 aa, Influenza virus
RELCTINSWHI

SEQ ID NO: 536248 - protein, 11 aa, Influenza virus
RELGNGCFEFY

SEQ ID NO: 536249 - protein, 11 aa, Influenza virus
RELVRKTRFLP

SEQ ID NO: 536250 - protein, 11 aa, Influenza virus
REMTFHGAKEV

SEQ ID NO: 536251 - protein, 11 aa, Influenza virus
RENAEDIGNGC

SEQ ID NO: 536252 - protein, 11 aa, Influenza virus
RENAEDKGNGC

SEQ ID NO: 536253 - protein, 11 aa, Influenza virus
RENAEDLGNGC

SEQ ID NO: 536254 - protein, 11 aa, Influenza virus
RENAEDMGDGC

SEQ ID NO: 536255 - protein, 11 aa, Influenza virus
RENAEDMGGGC

SEQ ID NO: 536256 - protein, 11 aa, Influenza virus
RENAEDMGNGC

SEQ ID NO: 536257 - protein, 11 aa, Influenza virus
RENAEDQGNGC

SEQ ID NO: 536258 - protein, 11 aa, Influenza virus
RENAEDRGNGC

SEQ ID NO: 536259 - protein, 11 aa, Influenza virus
RENAEEDCTGC

SEQ ID NO: 536260 - protein, 11 aa, Influenza virus
RENAEEDGNGC

SEQ ID NO: 536261 - protein, 11 aa, Influenza virus
RENAEEDGTAC

SEQ ID NO: 536262 - protein, 11 aa, Influenza virus
RENAEEDGTGC

SEQ ID NO: 536263 - protein, 11 aa, Influenza virus
REPFISCSHFE

SEQ ID NO: 536264 - protein, 11 aa, Influenza virus
REPFISCSHLE

SEQ ID NO: 536265 - protein, 11 aa, Influenza virus
REPFISCSPLE

SEQ ID NO: 536266 - protein, 11 aa, Influenza virus
REPFISCSQLE

SEQ ID NO: 536267 - protein, 11 aa, Influenza virus
REPFVACGPAE

SEQ ID NO: 536268 - protein, 11 aa, Influenza virus
REPFVACGPSE

SEQ ID NO: 536269 - protein, 11 aa, Influenza virus
REPFVACGPTE

SEQ ID NO: 536270 - protein, 11 aa, Influenza virus
REPFVACSPSE

SEQ ID NO: 536271 - protein, 11 aa, Influenza virus
REPFVSCGPSE

SEQ ID NO: 536272 - protein, 11 aa, Influenza virus
REPYVSCDPDE

SEQ ID NO: 536273 - protein, 11 aa, Influenza virus
REPYVSCDPDG

SEQ ID NO: 536274 - protein, 11 aa, Influenza virus
REPYVSCDPLG

SEQ ID NO: 536275 - protein, 11 aa, Influenza virus
REPYVSCDPNE

SEQ ID NO: 536276 - protein, 11 aa, Influenza virus
REPYVSCDPSG

SEQ ID NO: 536277 - protein, 11 aa, Influenza virus
REPYVSCDPTG

SEQ ID NO: 536278 - protein, 11 aa, Influenza virus
REPYVSCEPDE

SEQ ID NO: 536279 - protein, 11 aa, Influenza virus
REQKQEFKMNP

SEQ ID NO: 536280 - protein, 11 aa, Influenza virus
REQLSQKFEEI

SEQ ID NO: 536281 - protein, 11 aa, Influenza virus
REQQGRMDYYW

SEQ ID NO: 536282 - protein, 11 aa, Influenza virus
REREGGRRRKR

SEQ ID NO: 536283 - protein, 11 aa, Influenza virus
RERLGSWSWHD

SEQ ID NO: 536284 - protein, 11 aa, Influenza virus
RESGGIDKEPM

SEQ ID NO: 536285 - protein, 11 aa, Influenza virus
RESGGIDKESM

SEQ ID NO: 536286 - protein, 11 aa, Influenza virus
RESRNPGNAEI

SEQ ID NO: 536287 - protein, 11 aa, Influenza virus
RESRSPGNAEI

SEQ ID NO: 536288 - protein, 11 aa, Influenza virus
RETRGLFGAIA

SEQ ID NO: 536289 - protein, 11 aa, Influenza virus
REVEVVNATET

SEQ ID NO: 536290 - protein, 11 aa, Influenza virus
REWSYIVERPK

SEQ ID NO: 536291 - protein, 11 aa, Influenza virus
REWSYIVERTK

SEQ ID NO: 536292 - protein, 11 aa, Influenza virus
REWSYLIEDPA

SEQ ID NO: 536293 - protein, 11 aa, Influenza virus
REWSYLIEDPG

SEQ ID NO: 536294 - protein, 11 aa, Influenza virus
REWSYLIEDPN

SEQ ID NO: 536295 - protein, 11 aa, Influenza virus
REWSYLIEDPS

SEQ ID NO: 536296 - protein, 11 aa, Influenza virus
REWSYLIEDPT

SEQ ID NO: 536297 - protein, 11 aa, Influenza virus
RFADQELGDAP

SEQ ID NO: 536298 - protein, 11 aa, Influenza virus
RFEAVAWSATA

SEQ ID NO: 536299 - protein, 11 aa, Influenza virus
RFEGWIVGNPA

SEQ ID NO: 536300 - protein, 11 aa, Influenza virus
RFEIIEGRDRA

SEQ ID NO: 536301 - protein, 11 aa, Influenza virus
RFEIIEGRDRI

SEQ ID NO: 536302 - protein, 11 aa, Influenza virus
RFEIIEGRDRN

SEQ ID NO: 536303 - protein, 11 aa, Influenza virus
RFEIIEGRDRT

SEQ ID NO: 536304 - protein, 11 aa, Influenza virus
RFESVAWSASA

SEQ ID NO: 536305 - protein, 11 aa, Influenza virus
RFESVAWSATA

SEQ ID NO: 536306 - protein, 11 aa, Influenza virus
RFGEGEQIIVT

SEQ ID NO: 536307 - protein, 11 aa, Influenza virus
RFGESEQIIVT

SEQ ID NO: 536308 - protein, 11 aa, Influenza virus
RFGESEQIVVT

SEQ ID NO: 536309 - protein, 11 aa, Influenza virus
RFGESEQVIVT

SEQ ID NO: 536310 - protein, 11 aa, Influenza virus
RFIEIGVTRRE

SEQ ID NO: 536311 - protein, 11 aa, Influenza virus
RFIQNALNGNG

SEQ ID NO: 536312 - protein, 11 aa, Influenza virus
RFLEIGVTRRE

SEQ ID NO: 536313 - protein, 11 aa, Influenza virus
RFLFSSIKKYE

SEQ ID NO: 536314 - protein, 11 aa, Influenza virus
RFLPVAGGTGS

SEQ ID NO: 536315 - protein, 11 aa, Influenza virus
RFLPVAGGTSS

SEQ ID NO: 536316 - protein, 11 aa, Influenza virus
RFLPVSGGTSS

SEQ ID NO: 536317 - protein, 11 aa, Influenza virus
RFLPVTGGTSS

SEQ ID NO: 536318 - protein, 11 aa, Influenza virus
RFNSDLDYQIG

SEQ ID NO: 536319 - protein, 11 aa, Influenza virus
RFNSDPDYQIG

SEQ ID NO: 536320 - protein, 11 aa, Influenza virus
RFNSNLDYQIG

SEQ ID NO: 536321 - protein, 11 aa, Influenza virus
RFQIQGIKLTQ

SEQ ID NO: 536322 - protein, 11 aa, Influenza virus
RFQIQGVKLAQ

SEQ ID NO: 536323 - protein, 11 aa, Influenza virus
RFQIQGVKLIQ

SEQ ID NO: 536324 - protein, 11 aa, Influenza virus
RFQIQGVKLTQ

SEQ ID NO: 536325 - protein, 11 aa, Influenza virus
RFQIQGVRLTQ

SEQ ID NO: 536326 - protein, 11 aa, Influenza virus
RFRRPDSSWLF

SEQ ID NO: 536327 - protein, 11 aa, Influenza virus
RFSYVFCLALG

SEQ ID NO: 536328 - protein, 11 aa, Influenza virus
RFTEIGVTRRE

SEQ ID NO: 536329 - protein, 11 aa, Influenza virus
RFTNEEALRQI

SEQ ID NO: 536330 - protein, 11 aa, Influenza virus
RFTYSGIRTNG

SEQ ID NO: 536331 - protein, 11 aa, Influenza virus
RFVEIGVTRRE

SEQ ID NO: 536332 - protein, 11 aa, Influenza virus
RFVFSIAASYK

SEQ ID NO: 536333 - protein, 11 aa, Influenza virus
RFVFSNAASYK

SEQ ID NO: 536334 - protein, 11 aa, Influenza virus
RFVFSSAASYK

SEQ ID NO: 536335 - protein, 11 aa, Influenza virus
RFVQNALNGNG

SEQ ID NO: 536336 - protein, 11 aa, Influenza virus
RFVQNALSGNG

SEQ ID NO: 536337 - protein, 11 aa, Influenza virus
RFYALSQGTTI

SEQ ID NO: 536338 - protein, 11 aa, Influenza virus
RFYIQMCTELK

SEQ ID NO: 536339 - protein, 11 aa, Influenza virus
RFYIQMCTELQ

SEQ ID NO: 536340 - protein, 11 aa, Influenza virus
RFYRICKLVGI

SEQ ID NO: 536341 - protein, 11 aa, Influenza virus
RFYRTCKLLGI

SEQ ID NO: 536342 - protein, 11 aa, Influenza virus
RFYRTCKLVGI

SEQ ID NO: 536343 - protein, 11 aa, Influenza virus
RFYVQMCTELK

SEQ ID NO: 536344 - protein, 11 aa, Influenza virus
RGAYERMCNIL

SEQ ID NO: 536345 - protein, 11 aa, Influenza virus
RGDKICLGHHA

SEQ ID NO: 536346 - protein, 11 aa, Influenza virus
RGDLNFVNRAN

SEQ ID NO: 536347 - protein, 11 aa, Influenza virus
RGDQICIGYHA

SEQ ID NO: 536348 - protein, 11 aa, Influenza virus
RGDQICIGYHS

SEQ ID NO: 536349 - protein, 11 aa, Influenza virus
RGDQICVGYHS

SEQ ID NO: 536350 - protein, 11 aa, Influenza virus
RGDYNNTTGRD

SEQ ID NO: 536351 - protein, 11 aa, Influenza virus
RGEDTIEERFE

SEQ ID NO: 536352 - protein, 11 aa, Influenza virus
RGEETIEEKFE

SEQ ID NO: 536353 - protein, 11 aa, Influenza virus
RGEETIEERFA

SEQ ID NO: 536354 - protein, 11 aa, Influenza virus
RGEETIEERFE

SEQ ID NO: 536355 - protein, 11 aa, Influenza virus
RGEETVEERFE

SEQ ID NO: 536356 - protein, 11 aa, Influenza virus
RGEFNQVEKRI

SEQ ID NO: 536357 - protein, 11 aa, Influenza virus
RGEFNQVENRI

SEQ ID NO: 536358 - protein, 11 aa, Influenza virus
RGEFNQVEQRI

SEQ ID NO: 536359 - protein, 11 aa, Influenza virus
RGEFSQVEQRI

SEQ ID NO: 536360 - protein, 11 aa, Influenza virus
RGEFSQVERRI

SEQ ID NO: 536361 - protein, 11 aa, Influenza virus
RGEKANVLIGQ

SEQ ID NO: 536362 - protein, 11 aa, Influenza virus
RGETLKIRTNG

SEQ ID NO: 536363 - protein, 11 aa, Influenza virus
RGETTGRNCTI

SEQ ID NO: 536364 - protein, 11 aa, Influenza virus
RGETTGRNCTV

SEQ ID NO: 536365 - protein, 11 aa, Influenza virus
RGEVFVIREPF

SEQ ID NO: 536366 - protein, 11 aa, Influenza virus
RGEVSVIREPF

SEQ ID NO: 536367 - protein, 11 aa, Influenza virus
RGFAPFSKDNG

SEQ ID NO: 536368 - protein, 11 aa, Influenza virus
RGFFGAIAGFI

SEQ ID NO: 536369 - protein, 11 aa, Influenza virus
RGFFPFHKDNA

SEQ ID NO: 536370 - protein, 11 aa, Influenza virus
RGFLIIGKEDR

SEQ ID NO: 536371 - protein, 11 aa, Influenza virus
RGFLILGKEDK

SEQ ID NO: 536372 - protein, 11 aa, Influenza virus
RGFLILGKEDR

SEQ ID NO: 536373 - protein, 11 aa, Influenza virus
RGFLILGKENK

SEQ ID NO: 536374 - protein, 11 aa, Influenza virus
RGFLILGREDK

SEQ ID NO: 536375 - protein, 11 aa, Influenza virus
RGFVHFVEALA

SEQ ID NO: 536376 - protein, 11 aa, Influenza virus
RGFVYFVEALA

SEQ ID NO: 536377 - protein, 11 aa, Influenza virus
RGFVYFVEILA

SEQ ID NO: 536378 - protein, 11 aa, Influenza virus
RGFVYFVETLA

SEQ ID NO: 536379 - protein, 11 aa, Influenza virus
RGGRNSFFSRL

SEQ ID NO: 536380 - protein, 11 aa, Influenza virus
RGGSINTKLPF

SEQ ID NO: 536381 - protein, 11 aa, Influenza virus
RGGSINTRLPF

SEQ ID NO: 536382 - protein, 11 aa, Influenza virus
RGHIFVIREPF

SEQ ID NO: 536383 - protein, 11 aa, Influenza virus
RGHVFVIREPF

SEQ ID NO: 536384 - protein, 11 aa, Influenza virus
RGHYKISKSTK

SEQ ID NO: 536385 - protein, 11 aa, Influenza virus
RGIEVVNATET

SEQ ID NO: 536386 - protein, 11 aa, Influenza virus
RGIFGAIAGFI

SEQ ID NO: 536387 - protein, 11 aa, Influenza virus
RGILEDEQMYQ

SEQ ID NO: 536388 - protein, 11 aa, Influenza virus
RGILTKTTVDH

SEQ ID NO: 536389 - protein, 11 aa, Influenza virus
RGINDRNFWRG

SEQ ID NO: 536390 - protein, 11 aa, Influenza virus
RGIPPLELGDC

SEQ ID NO: 536391 - protein, 11 aa, Influenza virus
RGKHSNGTIHD

SEQ ID NO: 536392 - protein, 11 aa, Influenza virus
RGKLKRRAIAT

SEQ ID NO: 536393 - protein, 11 aa, Influenza virus
RGLCKINSWHI

SEQ ID NO: 536394 - protein, 11 aa, Influenza virus
RGLCTINSWHI

SEQ ID NO: 536395 - protein, 11 aa, Influenza virus
RGLFGAIAGFI

SEQ ID NO: 536396 - protein, 11 aa, Influenza virus
RGLFGAKAGFI

SEQ ID NO: 536397 - protein, 11 aa, Influenza virus
RGLISTPLGSP

SEQ ID NO: 536398 - protein, 11 aa, Influenza virus
RGLISTPLGTP

SEQ ID NO: 536399 - protein, 11 aa, Influenza virus
RGLLEVGTRWM

SEQ ID NO: 536400 - protein, 11 aa, Influenza virus
RGLLGAIAGFI

SEQ ID NO: 536401 - protein, 11 aa, Influenza virus
RGLMSTPLGSP

SEQ ID NO: 536402 - protein, 11 aa, Influenza virus
RGLQRRRFIQN

SEQ ID NO: 536403 - protein, 11 aa, Influenza virus
RGLQRRRFVQN

SEQ ID NO: 536404 - protein, 11 aa, Influenza virus
RGLSSRISFYW

SEQ ID NO: 536405 - protein, 11 aa, Influenza virus
RGLWDPFRQSE

SEQ ID NO: 536406 - protein, 11 aa, Influenza virus
RGLWDSFRQSE

SEQ ID NO: 536407 - protein, 11 aa, Influenza virus
RGNGCFEIFHK

SEQ ID NO: 536408 - protein, 11 aa, Influenza virus
RGNHGVKGWAF

SEQ ID NO: 536409 - protein, 11 aa, Influenza virus
RGNPGVKGWAF

SEQ ID NO: 536410 - protein, 11 aa, Influenza virus
RGNQGVKGWAF

SEQ ID NO: 536411 - protein, 11 aa, Influenza virus
RGNSPAFNYNK

SEQ ID NO: 536412 - protein, 11 aa, Influenza virus
RGNSPIFNYNK

SEQ ID NO: 536413 - protein, 11 aa, Influenza virus
RGNSPVFNYNK

SEQ ID NO: 536414 - protein, 11 aa, Influenza virus
RGNSPVFNYNR

SEQ ID NO: 536415 - protein, 11 aa, Influenza virus
RGNSPVFNYSK

SEQ ID NO: 536416 - protein, 11 aa, Influenza virus
RGQAADLKSTQ

SEQ ID NO: 536417 - protein, 11 aa, Influenza virus
RGQHANGTIHD

SEQ ID NO: 536418 - protein, 11 aa, Influenza virus
RGQPKEKAIWT

SEQ ID NO: 536419 - protein, 11 aa, Influenza virus
RGQPKEKTIWT

SEQ ID NO: 536420 - protein, 11 aa, Influenza virus
RGQPKERTIWT

SEQ ID NO: 536421 - protein, 11 aa, Influenza virus
RGQQGRMDYYW

SEQ ID NO: 536422 - protein, 11 aa, Influenza virus
RGQQGTMDYYW

SEQ ID NO: 536423 - protein, 11 aa, Influenza virus
RGQQGWMDYYW

SEQ ID NO: 536424 - protein, 11 aa, Influenza virus
RGQSGRISFYW

SEQ ID NO: 536425 - protein, 11 aa, Influenza virus
RGQSGRVSFYW

SEQ ID NO: 536426 - protein, 11 aa, Influenza virus
RGRGSTLGLDI

SEQ ID NO: 536427 - protein, 11 aa, Influenza virus
RGRGVFELSDE

SEQ ID NO: 536428 - protein, 11 aa, Influenza virus
RGRHANGTIHD

SEQ ID NO: 536429 - protein, 11 aa, Influenza virus
RGRHANGTIND

SEQ ID NO: 536430 - protein, 11 aa, Influenza virus
RGRHANGTMHD

SEQ ID NO: 536431 - protein, 11 aa, Influenza virus
RGRHSNGTIHD

SEQ ID NO: 536432 - protein, 11 aa, Influenza virus
RGRLCNPLNPF

SEQ ID NO: 536433 - protein, 11 aa, Influenza virus
RGRPEEAKYVE

SEQ ID NO: 536434 - protein, 11 aa, Influenza virus
RGRPEEAKYVW

SEQ ID NO: 536435 - protein, 11 aa, Influenza virus
RGRPEEVKYVW

SEQ ID NO: 536436 - protein, 11 aa, Influenza virus
RGRPKEDEVWW

SEQ ID NO: 536437 - protein, 11 aa, Influenza virus
RGRPKEDKVWW

SEQ ID NO: 536438 - protein, 11 aa, Influenza virus
RGRPKEDRVWW

SEQ ID NO: 536439 - protein, 11 aa, Influenza virus
RGRPKEEKVWW

SEQ ID NO: 536440 - protein, 11 aa, Influenza virus
RGSARHIEECS

SEQ ID NO: 536441 - protein, 11 aa, Influenza virus
RGSFYRSMRWL

SEQ ID NO: 536442 - protein, 11 aa, Influenza virus
RGSGLRILIRG

SEQ ID NO: 536443 - protein, 11 aa, Influenza virus
RGSGLRILVRG

SEQ ID NO: 536444 - protein, 11 aa, Influenza virus
RGSGMRILIRG

SEQ ID NO: 536445 - protein, 11 aa, Influenza virus
RGSGMRILVRG

SEQ ID NO: 536446 - protein, 11 aa, Influenza virus
RGSIAHKSCLP

SEQ ID NO: 536447 - protein, 11 aa, Influenza virus
RGSNRPWIRFN

SEQ ID NO: 536448 - protein, 11 aa, Influenza virus
RGSPGVKGWAF

SEQ ID NO: 536449 - protein, 11 aa, Influenza virus
RGSTLGLDIRT

SEQ ID NO: 536450 - protein, 11 aa, Influenza virus
RGSTQKAIDNM

SEQ ID NO: 536451 - protein, 11 aa, Influenza virus
RGSVAHKSCLP

SEQ ID NO: 536452 - protein, 11 aa, Influenza virus
RGSYNNTSGEQ

SEQ ID NO: 536453 - protein, 11 aa, Influenza virus
RGTGMRILVRG

SEQ ID NO: 536454 - protein, 11 aa, Influenza virus
RGTQGVKGWAF

SEQ ID NO: 536455 - protein, 11 aa, Influenza virus
RGVEVVDATET

SEQ ID NO: 536456 - protein, 11 aa, Influenza virus
RGVEVVNATET

SEQ ID NO: 536457 - protein, 11 aa, Influenza virus
RGVFEFSDERA

SEQ ID NO: 536458 - protein, 11 aa, Influenza virus
RGVFELSDEKA

SEQ ID NO: 536459 - protein, 11 aa, Influenza virus
RGVFELSDERA

SEQ ID NO: 536460 - protein, 11 aa, Influenza virus
RGVLEDEQMYQ

SEQ ID NO: 536461 - protein, 11 aa, Influenza virus
RGVNDRNFWRG

SEQ ID NO: 536462 - protein, 11 aa, Influenza virus
RGVVYFVETLA

SEQ ID NO: 536463 - protein, 11 aa, Influenza virus
RGWAPLSKDNG

SEQ ID NO: 536464 - protein, 11 aa, Influenza virus
RGYKMNIQILI

SEQ ID NO: 536465 - protein, 11 aa, Influenza virus
RGYKMNNQILI

SEQ ID NO: 536466 - protein, 11 aa, Influenza virus
RGYKMNTKILV

SEQ ID NO: 536467 - protein, 11 aa, Influenza virus
RGYKMNTQILI

SEQ ID NO: 536468 - protein, 11 aa, Influenza virus
RGYKMNTQILV

SEQ ID NO: 536469 - protein, 11 aa, Influenza virus
RGYKMNTRILI

SEQ ID NO: 536470 - protein, 11 aa, Influenza virus
RHANGTIHDRS

SEQ ID NO: 536471 - protein, 11 aa, Influenza virus
RHANGTINDRS

SEQ ID NO: 536472 - protein, 11 aa, Influenza virus
RHANGTMHDRS

SEQ ID NO: 536473 - protein, 11 aa, Influenza virus
RHCSKYHWNLA

SEQ ID NO: 536474 - protein, 11 aa, Influenza virus
RHENRMVIAST

SEQ ID NO: 536475 - protein, 11 aa, Influenza virus
RHENRMVLAST

SEQ ID NO: 536476 - protein, 11 aa, Influenza virus
RHIEECPCYGH

SEQ ID NO: 536477 - protein, 11 aa, Influenza virus
RHIEECSCYGD

SEQ ID NO: 536478 - protein, 11 aa, Influenza virus
RHIEECSCYGH

SEQ ID NO: 536479 - protein, 11 aa, Influenza virus
RHIEEWSCYGH

SEQ ID NO: 536480 - protein, 11 aa, Influenza virus
RHLEECSCYVD

SEQ ID NO: 536481 - protein, 11 aa, Influenza virus
RHLFSGIKSFS

SEQ ID NO: 536482 - protein, 11 aa, Influenza virus
RHLFSGIRSFS

SEQ ID NO: 536483 - protein, 11 aa, Influenza virus
RHLFSGVNSFS

SEQ ID NO: 536484 - protein, 11 aa, Influenza virus
RHQLRDNAKEL

SEQ ID NO: 536485 - protein, 11 aa, Influenza virus
RHQLRENAEDK

SEQ ID NO: 536486 - protein, 11 aa, Influenza virus
RHQNAEGTGTA

SEQ ID NO: 536487 - protein, 11 aa, Influenza virus
RHQNAQGEGIA

SEQ ID NO: 536488 - protein, 11 aa, Influenza virus
RHQNAQGEGTA

SEQ ID NO: 536489 - protein, 11 aa, Influenza virus
RHQNAQGIGQA

SEQ ID NO: 536490 - protein, 11 aa, Influenza virus
RHQNAQGQGTA

SEQ ID NO: 536491 - protein, 11 aa, Influenza virus
RHQNAQGTGQA

SEQ ID NO: 536492 - protein, 11 aa, Influenza virus
RHQNAQGTGQV

SEQ ID NO: 536493 - protein, 11 aa, Influenza virus
RHQNSEGTGTA

SEQ ID NO: 536494 - protein, 11 aa, Influenza virus
RHQNSQGEGTA

SEQ ID NO: 536495 - protein, 11 aa, Influenza virus
RHQNTQGEGTA

SEQ ID NO: 536496 - protein, 11 aa, Influenza virus
RHRLKITENSF

SEQ ID NO: 536497 - protein, 11 aa, Influenza virus
RHSNGTIHDRS

SEQ ID NO: 536498 - protein, 11 aa, Influenza virus
RHSNGTIHDRT

SEQ ID NO: 536499 - protein, 11 aa, Influenza virus
RHSNGTVKDRS

SEQ ID NO: 536500 - protein, 11 aa, Influenza virus
RHSNNTVKDRS

SEQ ID NO: 536501 - protein, 11 aa, Influenza virus
RHYIGKCPKYI

SEQ ID NO: 536502 - protein, 11 aa, Influenza virus
RIAIGNCPKYV

SEQ ID NO: 536503 - protein, 11 aa, Influenza virus
RIAWSSSSCFD

SEQ ID NO: 536504 - protein, 11 aa, Influenza virus
RIAYERMCNIL

SEQ ID NO: 536505 - protein, 11 aa, Influenza virus
RICEKLEQSGL

SEQ ID NO: 536506 - protein, 11 aa, Influenza virus
RICIDFRDMRK

SEQ ID NO: 536507 - protein, 11 aa, Influenza virus
RICIGYHANNS

SEQ ID NO: 536508 - protein, 11 aa, Influenza virus
RICIGYLSTNS

SEQ ID NO: 536509 - protein, 11 aa, Influenza virus
RICIGYQSNNS

SEQ ID NO: 536510 - protein, 11 aa, Influenza virus
RICILDQNFRN

SEQ ID NO: 536511 - protein, 11 aa, Influenza virus
RICKLVGINMS

SEQ ID NO: 536512 - protein, 11 aa, Influenza virus
RICLGHHAVAN

SEQ ID NO: 536513 - protein, 11 aa, Influenza virus
RICVGYHANNS

SEQ ID NO: 536514 - protein, 11 aa, Influenza virus
RICVGYLSTNS

SEQ ID NO: 536515 - protein, 11 aa, Influenza virus
RIDARIDFESG

SEQ ID NO: 536516 - protein, 11 aa, Influenza virus
RIDARVDFESG

SEQ ID NO: 536517 - protein, 11 aa, Influenza virus
RIDARVDSESG

SEQ ID NO: 536518 - protein, 11 aa, Influenza virus
RIDDAVTDIWS

SEQ ID NO: 536519 - protein, 11 aa, Influenza virus
RIDDAVTDVWS

SEQ ID NO: 536520 - protein, 11 aa, Influenza virus
RIDFHWMLLDP

SEQ ID NO: 536521 - protein, 11 aa, Influenza virus
RIECIGWSSTS

SEQ ID NO: 536522 - protein, 11 aa, Influenza virus
RIENLNKKIDD

SEQ ID NO: 536523 - protein, 11 aa, Influenza virus
RIENLNKKMED

SEQ ID NO: 536524 - protein, 11 aa, Influenza virus
RIENLNKKVDD

SEQ ID NO: 536525 - protein, 11 aa, Influenza virus
RIENLNRKMED

SEQ ID NO: 536526 - protein, 11 aa, Influenza virus
RIENLNRKVDD

SEQ ID NO: 536527 - protein, 11 aa, Influenza virus
RIESLNKKMED

SEQ ID NO: 536528 - protein, 11 aa, Influenza virus
RIESLNNKVDD

SEQ ID NO: 536529 - protein, 11 aa, Influenza virus
RIEVTNATELV

SEQ ID NO: 536530 - protein, 11 aa, Influenza virus
RIFLAMITYIT

SEQ ID NO: 536531 - protein, 11 aa, Influenza virus
RIFQPNIGPRP

SEQ ID NO: 536532 - protein, 11 aa, Influenza virus
RIFRPNIGPRP

SEQ ID NO: 536533 - protein, 11 aa, Influenza virus
RIGDGQRSWMK

SEQ ID NO: 536534 - protein, 11 aa, Influenza virus
RIGEDSDILVT

SEQ ID NO: 536535 - protein, 11 aa, Influenza virus
RIGEDSDVLVT

SEQ ID NO: 536536 - protein, 11 aa, Influenza virus
RIGEGQRSWMK

SEQ ID NO: 536537 - protein, 11 aa, Influenza virus
RIGENSDVLVT

SEQ ID NO: 536538 - protein, 11 aa, Influenza virus
RIGENSGVLVT

SEQ ID NO: 536539 - protein, 11 aa, Influenza virus
RIGESSDVLVT

SEQ ID NO: 536540 - protein, 11 aa, Influenza virus
RIGSCTSPCLT

SEQ ID NO: 536541 - protein, 11 aa, Influenza virus
RIGSKGDIFVI

SEQ ID NO: 536542 - protein, 11 aa, Influenza virus
RIGSKGDIFVM

SEQ ID NO: 536543 - protein, 11 aa, Influenza virus
RIGSKGDVFVI

SEQ ID NO: 536544 - protein, 11 aa, Influenza virus
RIGSKGDVFVM

SEQ ID NO: 536545 - protein, 11 aa, Influenza virus
RIGSKGHVFVI

SEQ ID NO: 536546 - protein, 11 aa, Influenza virus
RIGSRGEVFVI

SEQ ID NO: 536547 - protein, 11 aa, Influenza virus
RIGSRGHIFVI

SEQ ID NO: 536548 - protein, 11 aa, Influenza virus
RIGSRGHVFVI

SEQ ID NO: 536549 - protein, 11 aa, Influenza virus
RIIQNEDIPIE

SEQ ID NO: 536550 - protein, 11 aa, Influenza virus
RIIQNEDIPIG

SEQ ID NO: 536551 - protein, 11 aa, Influenza virus
RIKINPVTLTM

SEQ ID NO: 536552 - protein, 11 aa, Influenza virus
RIKTRLFTIRQ

SEQ ID NO: 536553 - protein, 11 aa, Influenza virus
RILDFHDSNVK

SEQ ID NO: 536554 - protein, 11 aa, Influenza virus
RILEEESDEAL

SEQ ID NO: 536555 - protein, 11 aa, Influenza virus
RILSIYSTVAA

SEQ ID NO: 536556 - protein, 11 aa, Influenza virus
RIMINPVKLSG

SEQ ID NO: 536557 - protein, 11 aa, Influenza virus
RIMINPVKLSS

SEQ ID NO: 536558 - protein, 11 aa, Influenza virus
RINGVKLEENS

SEQ ID NO: 536559 - protein, 11 aa, Influenza virus
RINGVKLEENT

SEQ ID NO: 536560 - protein, 11 aa, Influenza virus
RINMIADRVDD

SEQ ID NO: 536561 - protein, 11 aa, Influenza virus
RINMINSKIDD

SEQ ID NO: 536562 - protein, 11 aa, Influenza virus
RINMINSKIED

SEQ ID NO: 536563 - protein, 11 aa, Influenza virus
RINMINSKIND

SEQ ID NO: 536564 - protein, 11 aa, Influenza virus
RINMINSQIDD

SEQ ID NO: 536565 - protein, 11 aa, Influenza virus
RINMLADRIDD

SEQ ID NO: 536566 - protein, 11 aa, Influenza virus
RINMLADRVDD

SEQ ID NO: 536567 - protein, 11 aa, Influenza virus
RINMLADWVDD

SEQ ID NO: 536568 - protein, 11 aa, Influenza virus
RINNETILETG

SEQ ID NO: 536569 - protein, 11 aa, Influenza virus
RINNETILETR

SEQ ID NO: 536570 - protein, 11 aa, Influenza virus
RINTINSKIDD

SEQ ID NO: 536571 - protein, 11 aa, Influenza virus
RIPHRTLLMNE

SEQ ID NO: 536572 - protein, 11 aa, Influenza virus
RIPHRTLLMSE

SEQ ID NO: 536573 - protein, 11 aa, Influenza virus
RIQDIWAYNAE

SEQ ID NO: 536574 - protein, 11 aa, Influenza virus
RIQDLEKYIED

SEQ ID NO: 536575 - protein, 11 aa, Influenza virus
RIQDLEKYVED

SEQ ID NO: 536576 - protein, 11 aa, Influenza virus
RIQDLERYVED

SEQ ID NO: 536577 - protein, 11 aa, Influenza virus
RIQHLEECSCY

SEQ ID NO: 536578 - protein, 11 aa, Influenza virus
RIQIDPVKLSG

SEQ ID NO: 536579 - protein, 11 aa, Influenza virus
RIQIDPVKLSS

SEQ ID NO: 536580 - protein, 11 aa, Influenza virus
RIQIDQVKLSS

SEQ ID NO: 536581 - protein, 11 aa, Influenza virus
RIQIDSVKLSS

SEQ ID NO: 536582 - protein, 11 aa, Influenza virus
RIRLFDYSGWN

SEQ ID NO: 536583 - protein, 11 aa, Influenza virus
RIRLFDYSKWN

SEQ ID NO: 536584 - protein, 11 aa, Influenza virus
RIRLFDYSRWN

SEQ ID NO: 536585 - protein, 11 aa, Influenza virus
RIRMAINWGRI

SEQ ID NO: 536586 - protein, 11 aa, Influenza virus
RIRMATNECRI

SEQ ID NO: 536587 - protein, 11 aa, Influenza virus
RIRNNTYDHTQ

SEQ ID NO: 536588 - protein, 11 aa, Influenza virus
RISFYWTIVDP

SEQ ID NO: 536589 - protein, 11 aa, Influenza virus
RISFYWTIVEP

SEQ ID NO: 536590 - protein, 11 aa, Influenza virus
RISHRTLLMNE

SEQ ID NO: 536591 - protein, 11 aa, Influenza virus
RISIYWTLVNP

SEQ ID NO: 536592 - protein, 11 aa, Influenza virus
RISKRGSSGIM

SEQ ID NO: 536593 - protein, 11 aa, Influenza virus
RISNETILETG

SEQ ID NO: 536594 - protein, 11 aa, Influenza virus
RISSSFSFGGF

SEQ ID NO: 536595 - protein, 11 aa, Influenza virus
RISVYWTIVEP

SEQ ID NO: 536596 - protein, 11 aa, Influenza virus
RITTKINNIIE

SEQ ID NO: 536597 - protein, 11 aa, Influenza virus
RKASLRLAVGL

SEQ ID NO: 536598 - protein, 11 aa, Influenza virus
RKDILRTQESE

SEQ ID NO: 536599 - protein, 11 aa, Influenza virus
RKEPALIVWGV

SEQ ID NO: 536600 - protein, 11 aa, Influenza virus
RKEYEEEAKLE

SEQ ID NO: 536601 - protein, 11 aa, Influenza virus
RKGLILEYYSL

SEQ ID NO: 536602 - protein, 11 aa, Influenza virus
RKKILRTQESS

SEQ ID NO: 536603 - protein, 11 aa, Influenza virus
RKKRGLFGAIA

SEQ ID NO: 536604 - protein, 11 aa, Influenza virus
RKKRGLFGAKA

SEQ ID NO: 536605 - protein, 11 aa, Influenza virus
RKLKREITFHG

SEQ ID NO: 536606 - protein, 11 aa, Influenza virus
RKLKREMTFHG

SEQ ID NO: 536607 - protein, 11 aa, Influenza virus
RKMEDGFLDVW

SEQ ID NO: 536608 - protein, 11 aa, Influenza virus
RKMMTNSQDTE

SEQ ID NO: 536609 - protein, 11 aa, Influenza virus
RKMMTNSRDTE

SEQ ID NO: 536610 - protein, 11 aa, Influenza virus
RKMMTSSQDTE

SEQ ID NO: 536611 - protein, 11 aa, Influenza virus
RKQILRTQESS

SEQ ID NO: 536612 - protein, 11 aa, Influenza virus
RKQLRENAEED

SEQ ID NO: 536613 - protein, 11 aa, Influenza virus
RKQLRQNAEED

SEQ ID NO: 536614 - protein, 11 aa, Influenza virus
RKRDSSILTDS

SEQ ID NO: 536615 - protein, 11 aa, Influenza virus
RKRFADQELGD

SEQ ID NO: 536616 - protein, 11 aa, Influenza virus
RKRGLFGAIAG

SEQ ID NO: 536617 - protein, 11 aa, Influenza virus
RKRKRKTRGLF

SEQ ID NO: 536618 - protein, 11 aa, Influenza virus
RKRKTRGLFGA

SEQ ID NO: 536619 - protein, 11 aa, Influenza virus
RKRMTRGLFGA

SEQ ID NO: 536620 - protein, 11 aa, Influenza virus
RKRNSSILTDS

SEQ ID NO: 536621 - protein, 11 aa, Influenza virus
RKTNLYGFIIK

SEQ ID NO: 536622 - protein, 11 aa, Influenza virus
RKTNLYGFIVK

SEQ ID NO: 536623 - protein, 11 aa, Influenza virus
RKTRFLPVAGG

SEQ ID NO: 536624 - protein, 11 aa, Influenza virus
RKTRFLPVSGG

SEQ ID NO: 536625 - protein, 11 aa, Influenza virus
RKTRFLPVTGG

SEQ ID NO: 536626 - protein, 11 aa, Influenza virus
RKTRFLPVVGG

SEQ ID NO: 536627 - protein, 11 aa, Influenza virus
RKTRGLFGAIA

SEQ ID NO: 536628 - protein, 11 aa, Influenza virus
RLAAGGAIWVT

SEQ ID NO: 536629 - protein, 11 aa, Influenza virus
RLAAGGDIWVT

SEQ ID NO: 536630 - protein, 11 aa, Influenza virus
RLAIGLRNTPS

SEQ ID NO: 536631 - protein, 11 aa, Influenza virus
RLAKCNTKCQT

SEQ ID NO: 536632 - protein, 11 aa, Influenza virus
RLALGLRNTPS

SEQ ID NO: 536633 - protein, 11 aa, Influenza virus
RLATGLRNIPQ

SEQ ID NO: 536634 - protein, 11 aa, Influenza virus
RLATGLRNIPS

SEQ ID NO: 536635 - protein, 11 aa, Influenza virus
RLATGLRNVPK

SEQ ID NO: 536636 - protein, 11 aa, Influenza virus
RLATGLRNVPQ

SEQ ID NO: 536637 - protein, 11 aa, Influenza virus
RLATGLRNVPS

SEQ ID NO: 536638 - protein, 11 aa, Influenza virus
RLATGMRNIPE

SEQ ID NO: 536639 - protein, 11 aa, Influenza virus
RLAVGLRNTPS

SEQ ID NO: 536640 - protein, 11 aa, Influenza virus
RLCNPLNPFVG

SEQ ID NO: 536641 - protein, 11 aa, Influenza virus
RLCNPLNPFVN

SEQ ID NO: 536642 - protein, 11 aa, Influenza virus
RLCNPLNPFVS

SEQ ID NO: 536643 - protein, 11 aa, Influenza virus
RLCNPLNPFVT

SEQ ID NO: 536644 - protein, 11 aa, Influenza virus
RLCNPMNPFVS

SEQ ID NO: 536645 - protein, 11 aa, Influenza virus
RLCTINSWHIY

SEQ ID NO: 536646 - protein, 11 aa, Influenza virus
RLCYPGELDNN

SEQ ID NO: 536647 - protein, 11 aa, Influenza virus
RLEENTTYKIL

SEQ ID NO: 536648 - protein, 11 aa, Influenza virus
RLENLDKKMED

SEQ ID NO: 536649 - protein, 11 aa, Influenza virus
RLENLNKKMED

SEQ ID NO: 536650 - protein, 11 aa, Influenza virus
RLENLNKKVED

SEQ ID NO: 536651 - protein, 11 aa, Influenza virus
RLENLSKRMED

SEQ ID NO: 536652 - protein, 11 aa, Influenza virus
RLFDYSGWNVT

SEQ ID NO: 536653 - protein, 11 aa, Influenza virus
RLFDYSKWNVS

SEQ ID NO: 536654 - protein, 11 aa, Influenza virus
RLFDYSKWNVT

SEQ ID NO: 536655 - protein, 11 aa, Influenza virus
RLFDYSRWNVT

SEQ ID NO: 536656 - protein, 11 aa, Influenza virus
RLFERVRRQLR

SEQ ID NO: 536657 - protein, 11 aa, Influenza virus
RLFTIRQELAS

SEQ ID NO: 536658 - protein, 11 aa, Influenza virus
RLFTIRQEMAG

SEQ ID NO: 536659 - protein, 11 aa, Influenza virus
RLFTIRQEMAI

SEQ ID NO: 536660 - protein, 11 aa, Influenza virus
RLFTIRQEMAN

SEQ ID NO: 536661 - protein, 11 aa, Influenza virus
RLFTIRQEMAS

SEQ ID NO: 536662 - protein, 11 aa, Influenza virus
RLGKGYMFESK

SEQ ID NO: 536663 - protein, 11 aa, Influenza virus
RLGNLNKKMED

SEQ ID NO: 536664 - protein, 11 aa, Influenza virus
RLGPSFYAEMK

SEQ ID NO: 536665 - protein, 11 aa, Influenza virus
RLGRGYMFESK

SEQ ID NO: 536666 - protein, 11 aa, Influenza virus
RLGSSFYAEMK

SEQ ID NO: 536667 - protein, 11 aa, Influenza virus
RLGSWSWHDGA

SEQ ID NO: 536668 - protein, 11 aa, Influenza virus
RLIDKTNQQFE

SEQ ID NO: 536669 - protein, 11 aa, Influenza virus
RLIEKTNDKYH

SEQ ID NO: 536670 - protein, 11 aa, Influenza virus
RLIEKTNEKYH

SEQ ID NO: 536671 - protein, 11 aa, Influenza virus
RLIEKTNKQFE

SEQ ID NO: 536672 - protein, 11 aa, Influenza virus
RLIEKTNQQFE

SEQ ID NO: 536673 - protein, 11 aa, Influenza virus
RLIEKTNTEFE

SEQ ID NO: 536674 - protein, 11 aa, Influenza virus
RLIEKTNTQFE

SEQ ID NO: 536675 - protein, 11 aa, Influenza virus
RLIERTNEKYH

SEQ ID NO: 536676 - protein, 11 aa, Influenza virus
RLIERTNQQFE

SEQ ID NO: 536677 - protein, 11 aa, Influenza virus
RLKITENSFEQ

SEQ ID NO: 536678 - protein, 11 aa, Influenza virus
RLLRENAEEDG

SEQ ID NO: 536679 - protein, 11 aa, Influenza virus
RLLVLLENDKT

SEQ ID NO: 536680 - protein, 11 aa, Influenza virus
RLLVLLENEKT

SEQ ID NO: 536681 - protein, 11 aa, Influenza virus
RLNINPVKLSS

SEQ ID NO: 536682 - protein, 11 aa, Influenza virus
RLNINPVTLSS

SEQ ID NO: 536683 - protein, 11 aa, Influenza virus
RLNINSVKLSS

SEQ ID NO: 536684 - protein, 11 aa, Influenza virus
RLNNVIDKMNK

SEQ ID NO: 536685 - protein, 11 aa, Influenza virus
RLNPMHQLLRH

SEQ ID NO: 536686 - protein, 11 aa, Influenza virus
RLNRNEIKGVK

SEQ ID NO: 536687 - protein, 11 aa, Influenza virus
RLNTMHQLLRH

SEQ ID NO: 536688 - protein, 11 aa, Influenza virus
RLNWLTKATNG

SEQ ID NO: 536689 - protein, 11 aa, Influenza virus
RLNWLTKETNG

SEQ ID NO: 536690 - protein, 11 aa, Influenza virus
RLPFQNLSPRT

SEQ ID NO: 536691 - protein, 11 aa, Influenza virus
RLQDTTWDVFI

SEQ ID NO: 536692 - protein, 11 aa, Influenza virus
RLQLKDNAKEL

SEQ ID NO: 536693 - protein, 11 aa, Influenza virus
RLQLKDNAREL

SEQ ID NO: 536694 - protein, 11 aa, Influenza virus
RLQLRDNAKEL

SEQ ID NO: 536695 - protein, 11 aa, Influenza virus
RLQLRDNAREL

SEQ ID NO: 536696 - protein, 11 aa, Influenza virus
RLRGIPPLELG

SEQ ID NO: 536697 - protein, 11 aa, Influenza virus
RLRRDQKSLRG

SEQ ID NO: 536698 - protein, 11 aa, Influenza virus
RLRSGFEMLKI

SEQ ID NO: 536699 - protein, 11 aa, Influenza virus
RLSAGGAIWVT

SEQ ID NO: 536700 - protein, 11 aa, Influenza virus
RLSAGGDIWAT

SEQ ID NO: 536701 - protein, 11 aa, Influenza virus
RLSAGGDIWIT

SEQ ID NO: 536702 - protein, 11 aa, Influenza virus
RLSAGGDIWVM

SEQ ID NO: 536703 - protein, 11 aa, Influenza virus
RLSAGGDIWVT

SEQ ID NO: 536704 - protein, 11 aa, Influenza virus
RLSAGGHIWVT

SEQ ID NO: 536705 - protein, 11 aa, Influenza virus
RLSAGGNIWIT

SEQ ID NO: 536706 - protein, 11 aa, Influenza virus
RLSASGDIWIT

SEQ ID NO: 536707 - protein, 11 aa, Influenza virus
RLSASGDIWVT

SEQ ID NO: 536708 - protein, 11 aa, Influenza virus
RLSGGGDIWVT

SEQ ID NO: 536709 - protein, 11 aa, Influenza virus
RLSGIPPLELG

SEQ ID NO: 536710 - protein, 11 aa, Influenza virus
RLSINPVKLSS

SEQ ID NO: 536711 - protein, 11 aa, Influenza virus
RLSSGYKDIIL

SEQ ID NO: 536712 - protein, 11 aa, Influenza virus
RLTITYSSSMM

SEQ ID NO: 536713 - protein, 11 aa, Influenza virus
RLTQGRQTYDW

SEQ ID NO: 536714 - protein, 11 aa, Influenza virus
RLTQGYKDIIL

SEQ ID NO: 536715 - protein, 11 aa, Influenza virus
RLTTTIKPWAR

SEQ ID NO: 536716 - protein, 11 aa, Influenza virus
RLTTTIKTWAG

SEQ ID NO: 536717 - protein, 11 aa, Influenza virus
RLTTTIKTWAK

SEQ ID NO: 536718 - protein, 11 aa, Influenza virus
RLTTTIKTWAR

SEQ ID NO: 536719 - protein, 11 aa, Influenza virus
RLTTTIRTWAK

SEQ ID NO: 536720 - protein, 11 aa, Influenza virus
RLTTTVKTWAG

SEQ ID NO: 536721 - protein, 11 aa, Influenza virus
RLVLATGLRNI

SEQ ID NO: 536722 - protein, 11 aa, Influenza virus
RLVLATGLRNV

SEQ ID NO: 536723 - protein, 11 aa, Influenza virus
RLVRFRHQNSE

SEQ ID NO: 536724 - protein, 11 aa, Influenza virus
RLYIWGVHHPS

SEQ ID NO: 536725 - protein, 11 aa, Influenza virus
RLYLWGVHHPS

SEQ ID NO: 536726 - protein, 11 aa, Influenza virus
RLYVNKNPYTL

SEQ ID NO: 536727 - protein, 11 aa, Influenza virus
RMAKCNTKCQT

SEQ ID NO: 536728 - protein, 11 aa, Influenza virus
RMARCNTKCQT

SEQ ID NO: 536729 - protein, 11 aa, Influenza virus
RMATGLRNIPS

SEQ ID NO: 536730 - protein, 11 aa, Influenza virus
RMATGLRNVPS

SEQ ID NO: 536731 - protein, 11 aa, Influenza virus
RMCNILKGKFQ

SEQ ID NO: 536732 - protein, 11 aa, Influenza virus
RMCSLMQGSTL

SEQ ID NO: 536733 - protein, 11 aa, Influenza virus
RMDYYWAILKP

SEQ ID NO: 536734 - protein, 11 aa, Influenza virus
RMDYYWAVLKP

SEQ ID NO: 536735 - protein, 11 aa, Influenza virus
RMDYYWGILKR

SEQ ID NO: 536736 - protein, 11 aa, Influenza virus
RMENLNKKVDD

SEQ ID NO: 536737 - protein, 11 aa, Influenza virus
RMFALSQGTTL

SEQ ID NO: 536738 - protein, 11 aa, Influenza virus
RMFLAMITYIT

SEQ ID NO: 536739 - protein, 11 aa, Influenza virus
RMGKCNTKCQT

SEQ ID NO: 536740 - protein, 11 aa, Influenza virus
RMGVQMQRFRR

SEQ ID NO: 536741 - protein, 11 aa, Influenza virus
RMIICIQGNND

SEQ ID NO: 536742 - protein, 11 aa, Influenza virus
RMIKAVRGDLN

SEQ ID NO: 536743 - protein, 11 aa, Influenza virus
RMIKRGINDRN

SEQ ID NO: 536744 - protein, 11 aa, Influenza virus
RMIKRGVNDRN

SEQ ID NO: 536745 - protein, 11 aa, Influenza virus
RMKWMMAMKYP

SEQ ID NO: 536746 - protein, 11 aa, Influenza virus
RMKWMMAMRYP

SEQ ID NO: 536747 - protein, 11 aa, Influenza virus
RMNNETILETG

SEQ ID NO: 536748 - protein, 11 aa, Influenza virus
RMQFSSFTVNV

SEQ ID NO: 536749 - protein, 11 aa, Influenza virus
RMQFSSLAVNV

SEQ ID NO: 536750 - protein, 11 aa, Influenza virus
RMQFSSLTVNV

SEQ ID NO: 536751 - protein, 11 aa, Influenza virus
RMQFSSLTVSV

SEQ ID NO: 536752 - protein, 11 aa, Influenza virus
RMQLRDNAKEI

SEQ ID NO: 536753 - protein, 11 aa, Influenza virus
RMQLRDNAKEL

SEQ ID NO: 536754 - protein, 11 aa, Influenza virus
RMQLRDNVKEL

SEQ ID NO: 536755 - protein, 11 aa, Influenza virus
RMSICISGPNN

SEQ ID NO: 536756 - protein, 11 aa, Influenza virus
RMSICMSGPND

SEQ ID NO: 536757 - protein, 11 aa, Influenza virus
RMSICMSGPNN

SEQ ID NO: 536758 - protein, 11 aa, Influenza virus
RMSICVSGPNN

SEQ ID NO: 536759 - protein, 11 aa, Influenza virus
RMSVCISGPNN

SEQ ID NO: 536760 - protein, 11 aa, Influenza virus
RMSVCMSGPNN

SEQ ID NO: 536761 - protein, 11 aa, Influenza virus
RMTICIQGNND

SEQ ID NO: 536762 - protein, 11 aa, Influenza virus
RMTICVQGNND

SEQ ID NO: 536763 - protein, 11 aa, Influenza virus
RMTICVQGNNK

SEQ ID NO: 536764 - protein, 11 aa, Influenza virus
RMTICVQGNNN

SEQ ID NO: 536765 - protein, 11 aa, Influenza virus
RMTRGLFGAIA

SEQ ID NO: 536766 - protein, 11 aa, Influenza virus
RMVIASTTAKA

SEQ ID NO: 536767 - protein, 11 aa, Influenza virus
RMVKRGINDRN

SEQ ID NO: 536768 - protein, 11 aa, Influenza virus
RMVLASTTAKA

SEQ ID NO: 536769 - protein, 11 aa, Influenza virus
RMVLSAFDERR

SEQ ID NO: 536770 - protein, 11 aa, Influenza virus
RMVTGLRNIPS

SEQ ID NO: 536771 - protein, 11 aa, Influenza virus
RMYALHQGTTI

SEQ ID NO: 536772 - protein, 11 aa, Influenza virus
RNAHKMESRGL

SEQ ID NO: 536773 - protein, 11 aa, Influenza virus
RNAIGDCPKYI

SEQ ID NO: 536774 - protein, 11 aa, Influenza virus
RNAIGDCPKYV

SEQ ID NO: 536775 - protein, 11 aa, Influenza virus
RNALGDCPKYI

SEQ ID NO: 536776 - protein, 11 aa, Influenza virus
RNALGNCPKYI

SEQ ID NO: 536777 - protein, 11 aa, Influenza virus
RNALSIAPIMF

SEQ ID NO: 536778 - protein, 11 aa, Influenza virus
RNCTIPCFWVE

SEQ ID NO: 536779 - protein, 11 aa, Influenza virus
RNCTVPCFWVE

SEQ ID NO: 536780 - protein, 11 aa, Influenza virus
RNDDSSSNSNC

SEQ ID NO: 536781 - protein, 11 aa, Influenza virus
RNDDSSSSSNC

SEQ ID NO: 536782 - protein, 11 aa, Influenza virus
RNDEGTGIAAD

SEQ ID NO: 536783 - protein, 11 aa, Influenza virus
RNDTDVVNFLS

SEQ ID NO: 536784 - protein, 11 aa, Influenza virus
RNDTDVVNFVS

SEQ ID NO: 536785 - protein, 11 aa, Influenza virus
RNDTDVVNYVS

SEQ ID NO: 536786 - protein, 11 aa, Influenza virus
RNEAINNRFQI

SEQ ID NO: 536787 - protein, 11 aa, Influenza virus
RNEDGSSSSNC

SEQ ID NO: 536788 - protein, 11 aa, Influenza virus
RNEDSSSNSNC

SEQ ID NO: 536789 - protein, 11 aa, Influenza virus
RNEDSSSSSNC

SEQ ID NO: 536790 - protein, 11 aa, Influenza virus
RNEEGTGIAAD

SEQ ID NO: 536791 - protein, 11 aa, Influenza virus
RNEEGTGVAAD

SEQ ID NO: 536792 - protein, 11 aa, Influenza virus
RNEIKGIKLSN

SEQ ID NO: 536793 - protein, 11 aa, Influenza virus
RNEIKGVELSS

SEQ ID NO: 536794 - protein, 11 aa, Influenza virus
RNEIKGVKLSN

SEQ ID NO: 536795 - protein, 11 aa, Influenza virus
RNEIKGVKLSS

SEQ ID NO: 536796 - protein, 11 aa, Influenza virus
RNFKPNIGPRP

SEQ ID NO: 536797 - protein, 11 aa, Influenza virus
RNFPQTTNTYR

SEQ ID NO: 536798 - protein, 11 aa, Influenza virus
RNFQPNIGPRP

SEQ ID NO: 536799 - protein, 11 aa, Influenza virus
RNFWRGDNGRR

SEQ ID NO: 536800 - protein, 11 aa, Influenza virus
RNFWRGENGRK

SEQ ID NO: 536801 - protein, 11 aa, Influenza virus
RNFWRGENGRR

SEQ ID NO: 536802 - protein, 11 aa, Influenza virus
RNGFEMLKIPN

SEQ ID NO: 536803 - protein, 11 aa, Influenza virus
RNGKWREQLSQ

SEQ ID NO: 536804 - protein, 11 aa, Influenza virus
RNGNMRCTICI

SEQ ID NO: 536805 - protein, 11 aa, Influenza virus
RNGTYDHKEFE

SEQ ID NO: 536806 - protein, 11 aa, Influenza virus
RNGTYDHKEFK

SEQ ID NO: 536807 - protein, 11 aa, Influenza virus
RNGTYDHNIYR

SEQ ID NO: 536808 - protein, 11 aa, Influenza virus
RNGTYDYPKYE

SEQ ID NO: 536809 - protein, 11 aa, Influenza virus
RNGTYDYPKYS

SEQ ID NO: 536810 - protein, 11 aa, Influenza virus
RNGTYNHEDYK

SEQ ID NO: 536811 - protein, 11 aa, Influenza virus
RNGTYNHEDYR

SEQ ID NO: 536812 - protein, 11 aa, Influenza virus
RNGTYNYPKYE

SEQ ID NO: 536813 - protein, 11 aa, Influenza virus
RNICEKLEQSG

SEQ ID NO: 536814 - protein, 11 aa, Influenza virus
RNILRTQDSEC

SEQ ID NO: 536815 - protein, 11 aa, Influenza virus
RNILRTQESEC

SEQ ID NO: 536816 - protein, 11 aa, Influenza virus
RNILSIAPIMF

SEQ ID NO: 536817 - protein, 11 aa, Influenza virus
RNILSMAPIMF

SEQ ID NO: 536818 - protein, 11 aa, Influenza virus
RNIPGKQAKGL

SEQ ID NO: 536819 - protein, 11 aa, Influenza virus
RNIPQIESRGL

SEQ ID NO: 536820 - protein, 11 aa, Influenza virus
RNIPSIQSRGL

SEQ ID NO: 536821 - protein, 11 aa, Influenza virus
RNIPSVQSRGL

SEQ ID NO: 536822 - protein, 11 aa, Influenza virus
RNITVTHSVNL

SEQ ID NO: 536823 - protein, 11 aa, Influenza virus
RNIVRRAAVSA

SEQ ID NO: 536824 - protein, 11 aa, Influenza virus
RNIVRRAIVSA

SEQ ID NO: 536825 - protein, 11 aa, Influenza virus
RNIVRRATVSA

SEQ ID NO: 536826 - protein, 11 aa, Influenza virus
RNIVRRATVST

SEQ ID NO: 536827 - protein, 11 aa, Influenza virus
RNKHSNGTIHD

SEQ ID NO: 536828 - protein, 11 aa, Influenza virus
RNKHSNGTTHD

SEQ ID NO: 536829 - protein, 11 aa, Influenza virus
RNKHSNSTTHD

SEQ ID NO: 536830 - protein, 11 aa, Influenza virus
RNKYLEEHPNA

SEQ ID NO: 536831 - protein, 11 aa, Influenza virus
RNKYLEEHPSA

SEQ ID NO: 536832 - protein, 11 aa, Influenza virus
RNKYLEEHPST

SEQ ID NO: 536833 - protein, 11 aa, Influenza virus
RNLHIPEAGLK

SEQ ID NO: 536834 - protein, 11 aa, Influenza virus
RNLHIPEVCLK

SEQ ID NO: 536835 - protein, 11 aa, Influenza virus
RNLYDKVRLQL

SEQ ID NO: 536836 - protein, 11 aa, Influenza virus
RNLYDKVRMQL

SEQ ID NO: 536837 - protein, 11 aa, Influenza virus
RNNMINNDLGP

SEQ ID NO: 536838 - protein, 11 aa, Influenza virus
RNNRKEPALIV

SEQ ID NO: 536839 - protein, 11 aa, Influenza virus
RNNSYDHSKYR

SEQ ID NO: 536840 - protein, 11 aa, Influenza virus
RNNTYDHAQYR

SEQ ID NO: 536841 - protein, 11 aa, Influenza virus
RNNTYDHKKYR

SEQ ID NO: 536842 - protein, 11 aa, Influenza virus
RNNTYDHSHYR

SEQ ID NO: 536843 - protein, 11 aa, Influenza virus
RNNTYDHSKYR

SEQ ID NO: 536844 - protein, 11 aa, Influenza virus
RNNTYDHSQYR

SEQ ID NO: 536845 - protein, 11 aa, Influenza virus
RNNTYDHSRYR

SEQ ID NO: 536846 - protein, 11 aa, Influenza virus
RNNTYDHSTYR

SEQ ID NO: 536847 - protein, 11 aa, Influenza virus
RNNTYDHTKYR

SEQ ID NO: 536848 - protein, 11 aa, Influenza virus
RNNTYDHTQYR

SEQ ID NO: 536849 - protein, 11 aa, Influenza virus
RNNTYNHTEYR

SEQ ID NO: 536850 - protein, 11 aa, Influenza virus
RNNTYNHTQYR

SEQ ID NO: 536851 - protein, 11 aa, Influenza virus
RNPGNAEIEDL

SEQ ID NO: 536852 - protein, 11 aa, Influenza virus
RNQIKIRRRVD

SEQ ID NO: 536853 - protein, 11 aa, Influenza virus
RNQPAATALAN

SEQ ID NO: 536854 - protein, 11 aa, Influenza virus
RNQSGRISIYW

SEQ ID NO: 536855 - protein, 11 aa, Influenza virus
RNQVKIRRRVD

SEQ ID NO: 536856 - protein, 11 aa, Influenza virus
RNRHSNGTIHD

SEQ ID NO: 536857 - protein, 11 aa, Influenza virus
RNRSILNTSQR

SEQ ID NO: 536858 - protein, 11 aa, Influenza virus
RNRYLEEHPSA

SEQ ID NO: 536859 - protein, 11 aa, Influenza virus
RNRYLEENPSA

SEQ ID NO: 536860 - protein, 11 aa, Influenza virus
RNSFFSRLNWL

SEQ ID NO: 536861 - protein, 11 aa, Influenza virus
RNSFYAELKWL

SEQ ID NO: 536862 - protein, 11 aa, Influenza virus
RNSIWTSSSST

SEQ ID NO: 536863 - protein, 11 aa, Influenza virus
RNSSDICYPGK

SEQ ID NO: 536864 - protein, 11 aa, Influenza virus
RNSSDICYPGR

SEQ ID NO: 536865 - protein, 11 aa, Influenza virus
RNSSILTDSQT

SEQ ID NO: 536866 - protein, 11 aa, Influenza virus
RNTFGDCPKYV

SEQ ID NO: 536867 - protein, 11 aa, Influenza virus
RNTIGDCPKYM

SEQ ID NO: 536868 - protein, 11 aa, Influenza virus
RNTIGDCPKYV

SEQ ID NO: 536869 - protein, 11 aa, Influenza virus
RNTPSIDPKGL

SEQ ID NO: 536870 - protein, 11 aa, Influenza virus
RNTPSIEPKGL

SEQ ID NO: 536871 - protein, 11 aa, Influenza virus
RNTPSIEPRGL

SEQ ID NO: 536872 - protein, 11 aa, Influenza virus
RNTPSVEPKGL

SEQ ID NO: 536873 - protein, 11 aa, Influenza virus
RNTPSVEPRGL

SEQ ID NO: 536874 - protein, 11 aa, Influenza virus
RNTRKEPALIV

SEQ ID NO: 536875 - protein, 11 aa, Influenza virus
RNVLSIAPIMF

SEQ ID NO: 536876 - protein, 11 aa, Influenza virus
RNVLSVAPIMF

SEQ ID NO: 536877 - protein, 11 aa, Influenza virus
RNVPQAQDRGL

SEQ ID NO: 536878 - protein, 11 aa, Influenza virus
RNVPQAQNRGL

SEQ ID NO: 536879 - protein, 11 aa, Influenza virus
RNVPQIEPRGL

SEQ ID NO: 536880 - protein, 11 aa, Influenza virus
RNVPQIESRGL

SEQ ID NO: 536881 - protein, 11 aa, Influenza virus
RNVPQIQNRGL

SEQ ID NO: 536882 - protein, 11 aa, Influenza virus
RNVPQMESRGL

SEQ ID NO: 536883 - protein, 11 aa, Influenza virus
RNVPQVQDRGL

SEQ ID NO: 536884 - protein, 11 aa, Influenza virus
RNVPQVQNRGL

SEQ ID NO: 536885 - protein, 11 aa, Influenza virus
RNVPSIQSRGL

SEQ ID NO: 536886 - protein, 11 aa, Influenza virus
RNVPSVQSRGL

SEQ ID NO: 536887 - protein, 11 aa, Influenza virus
RNVTVTHAKDI

SEQ ID NO: 536888 - protein, 11 aa, Influenza virus
RNVTVTHAKNI

SEQ ID NO: 536889 - protein, 11 aa, Influenza virus
RNVTVTHAQDI

SEQ ID NO: 536890 - protein, 11 aa, Influenza virus
RNVTVTHSVEL

SEQ ID NO: 536891 - protein, 11 aa, Influenza virus
RNVTVTHSVNL

SEQ ID NO: 536892 - protein, 11 aa, Influenza virus
RNWSGYSGSFI

SEQ ID NO: 536893 - protein, 11 aa, Influenza virus
RNWSGYSGSFT

SEQ ID NO: 536894 - protein, 11 aa, Influenza virus
RPCFWVELIRG

SEQ ID NO: 536895 - protein, 11 aa, Influenza virus
RPCFWVELVRG

SEQ ID NO: 536896 - protein, 11 aa, Influenza virus
RPEEAKYVEWT

SEQ ID NO: 536897 - protein, 11 aa, Influenza virus
RPEEAKYVWWA

SEQ ID NO: 536898 - protein, 11 aa, Influenza virus
RPEEAKYVWWT

SEQ ID NO: 536899 - protein, 11 aa, Influenza virus
RPEEVKYVWWT

SEQ ID NO: 536900 - protein, 11 aa, Influenza virus
RPFQNVNKITY

SEQ ID NO: 536901 - protein, 11 aa, Influenza virus
RPFVRGQQGRM

SEQ ID NO: 536902 - protein, 11 aa, Influenza virus
RPGDNITFSHN

SEQ ID NO: 536903 - protein, 11 aa, Influenza virus
RPGETLNVESN

SEQ ID NO: 536904 - protein, 11 aa, Influenza virus
RPGYNGQKSWM

SEQ ID NO: 536905 - protein, 11 aa, Influenza virus
RPGYNGQKSWT

SEQ ID NO: 536906 - protein, 11 aa, Influenza virus
RPGYNGQRSWM

SEQ ID NO: 536907 - protein, 11 aa, Influenza virus
RPHPEDLNGMI

SEQ ID NO: 536908 - protein, 11 aa, Influenza virus
RPIGISSMVEA

SEQ ID NO: 536909 - protein, 11 aa, Influenza virus
RPILSPLTKGI

SEQ ID NO: 536910 - protein, 11 aa, Influenza virus
RPILSPLTKGM

SEQ ID NO: 536911 - protein, 11 aa, Influenza virus
RPITEINTWAR

SEQ ID NO: 536912 - protein, 11 aa, Influenza virus
RPKEDEVWWTS

SEQ ID NO: 536913 - protein, 11 aa, Influenza virus
RPKEDKVWWTS

SEQ ID NO: 536914 - protein, 11 aa, Influenza virus
RPKEDRVWWTS

SEQ ID NO: 536915 - protein, 11 aa, Influenza virus
RPKEEKVWWTS

SEQ ID NO: 536916 - protein, 11 aa, Influenza virus
RPKEIEGICYP

SEQ ID NO: 536917 - protein, 11 aa, Influenza virus
RPKEMEGICYP

SEQ ID NO: 536918 - protein, 11 aa, Influenza virus
RPKEMEGVCYP

SEQ ID NO: 536919 - protein, 11 aa, Influenza virus
RPKENPAHKSQ

SEQ ID NO: 536920 - protein, 11 aa, Influenza virus
RPKVNGQAGRI

SEQ ID NO: 536921 - protein, 11 aa, Influenza virus
RPLILKDCSIA

SEQ ID NO: 536922 - protein, 11 aa, Influenza virus
RPLILKDCSVA

SEQ ID NO: 536923 - protein, 11 aa, Influenza virus
RPLILRDCSVA

SEQ ID NO: 536924 - protein, 11 aa, Influenza virus
RPLIRGQQGRM

SEQ ID NO: 536925 - protein, 11 aa, Influenza virus
RPLVMGQQGRM

SEQ ID NO: 536926 - protein, 11 aa, Influenza virus
RPLVNGQRGRI

SEQ ID NO: 536927 - protein, 11 aa, Influenza virus
RPLVNGQSGRI

SEQ ID NO: 536928 - protein, 11 aa, Influenza virus
RPLVREQQGRM

SEQ ID NO: 536929 - protein, 11 aa, Influenza virus
RPLVRGQQGRM

SEQ ID NO: 536930 - protein, 11 aa, Influenza virus
RPLVRGQQGTM

SEQ ID NO: 536931 - protein, 11 aa, Influenza virus
RPLVRGQQGWM

SEQ ID NO: 536932 - protein, 11 aa, Influenza virus
RPNENPAHKSQ

SEQ ID NO: 536933 - protein, 11 aa, Influenza virus
RPNENPVHKSQ

SEQ ID NO: 536934 - protein, 11 aa, Influenza virus
RPNIGPRPLIR

SEQ ID NO: 536935 - protein, 11 aa, Influenza virus
RPNIGPRPLVR

SEQ ID NO: 536936 - protein, 11 aa, Influenza virus
RPPVNGQSGRI

SEQ ID NO: 536937 - protein, 11 aa, Influenza virus
RPQINGQSGRI

SEQ ID NO: 536938 - protein, 11 aa, Influenza virus
RPQMNGQSGRI

SEQ ID NO: 536939 - protein, 11 aa, Influenza virus
RPQVNGQRGRI

SEQ ID NO: 536940 - protein, 11 aa, Influenza virus
RPQVNGQSGRI

SEQ ID NO: 536941 - protein, 11 aa, Influenza virus
RPRRGLFGAIA

SEQ ID NO: 536942 - protein, 11 aa, Influenza virus
RPRVRNQSGRI

SEQ ID NO: 536943 - protein, 11 aa, Influenza virus
RPRYNGQRSWM

SEQ ID NO: 536944 - protein, 11 aa, Influenza virus
RPSAPEGMCYP

SEQ ID NO: 536945 - protein, 11 aa, Influenza virus
RPSIWTSSSST

SEQ ID NO: 536946 - protein, 11 aa, Influenza virus
RPTAVDTCYPF

SEQ ID NO: 536947 - protein, 11 aa, Influenza virus
RPTRNGWGCKC

SEQ ID NO: 536948 - protein, 11 aa, Influenza virus
RPTTEINTWAR

SEQ ID NO: 536949 - protein, 11 aa, Influenza virus
RPTTTIKTWAR

SEQ ID NO: 536950 - protein, 11 aa, Influenza virus
RPVAEINTWAR

SEQ ID NO: 536951 - protein, 11 aa, Influenza virus
RPVAKAGFIEN

SEQ ID NO: 536952 - protein, 11 aa, Influenza virus
RPVGISSMGEA

SEQ ID NO: 536953 - protein, 11 aa, Influenza virus
RPVGISSMMEA

SEQ ID NO: 536954 - protein, 11 aa, Influenza virus
RPVGISSMVEA

SEQ ID NO: 536955 - protein, 11 aa, Influenza virus
RPVTEINTWAR

SEQ ID NO: 536956 - protein, 11 aa, Influenza virus
RPWIRFNSDLD

SEQ ID NO: 536957 - protein, 11 aa, Influenza virus
RPWIRFNSDPD

SEQ ID NO: 536958 - protein, 11 aa, Influenza virus
RPWIRFNSNLD

SEQ ID NO: 536959 - protein, 11 aa, Influenza virus
RPWIRINNETI

SEQ ID NO: 536960 - protein, 11 aa, Influenza virus
RPWMRINNETI

SEQ ID NO: 536961 - protein, 11 aa, Influenza virus
RPWMRISNETI

SEQ ID NO: 536962 - protein, 11 aa, Influenza virus
RPWVRFNSDLD

SEQ ID NO: 536963 - protein, 11 aa, Influenza virus
RPWVRINNETI

SEQ ID NO: 536964 - protein, 11 aa, Influenza virus
RPWVRMNNETI

SEQ ID NO: 536965 - protein, 11 aa, Influenza virus
RQASPSCLVVR

SEQ ID NO: 536966 - protein, 11 aa, Influenza virus
RQCFNPMIAEL

SEQ ID NO: 536967 - protein, 11 aa, Influenza virus
RQCFNPMIIEL

SEQ ID NO: 536968 - protein, 11 aa, Influenza virus
RQCFNPMIVEL

SEQ ID NO: 536969 - protein, 11 aa, Influenza virus
RQCFNPMTVEL

SEQ ID NO: 536970 - protein, 11 aa, Influenza virus
RQCFNPMVVEL

SEQ ID NO: 536971 - protein, 11 aa, Influenza virus
RQEALQNRIMI

SEQ ID NO: 536972 - protein, 11 aa, Influenza virus
RQEIDGIKLKS

SEQ ID NO: 536973 - protein, 11 aa, Influenza virus
RQEIEGIKLES

SEQ ID NO: 536974 - protein, 11 aa, Influenza virus
RQEIEGIKLKS

SEQ ID NO: 536975 - protein, 11 aa, Influenza virus
RQEIEGIKLKT

SEQ ID NO: 536976 - protein, 11 aa, Influenza virus
RQEIEGIRLKS

SEQ ID NO: 536977 - protein, 11 aa, Influenza virus
RQEINGIKLKS

SEQ ID NO: 536978 - protein, 11 aa, Influenza virus
RQEIVDNKNWS

SEQ ID NO: 536979 - protein, 11 aa, Influenza virus
RQEIVDNNNWS

SEQ ID NO: 536980 - protein, 11 aa, Influenza virus
RQEIVDNSNWS

SEQ ID NO: 536981 - protein, 11 aa, Influenza virus
RQEIVGNDNWS

SEQ ID NO: 536982 - protein, 11 aa, Influenza virus
RQEIVSNDNWS

SEQ ID NO: 536983 - protein, 11 aa, Influenza virus
RQEKNPALRMK

SEQ ID NO: 536984 - protein, 11 aa, Influenza virus
RQEKNPSLRMK

SEQ ID NO: 536985 - protein, 11 aa, Influenza virus
RQGNSVWAGRT

SEQ ID NO: 536986 - protein, 11 aa, Influenza virus
RQGTSVWAGRT

SEQ ID NO: 536987 - protein, 11 aa, Influenza virus
RQIGNVINWTR

SEQ ID NO: 536988 - protein, 11 aa, Influenza virus
RQIIRESGGID

SEQ ID NO: 536989 - protein, 11 aa, Influenza virus
RQILRTQESSC

SEQ ID NO: 536990 - protein, 11 aa, Influenza virus
RQKIMESGGID

SEQ ID NO: 536991 - protein, 11 aa, Influenza virus
RQKIMESGGIS

SEQ ID NO: 536992 - protein, 11 aa, Influenza virus
RQKINGVKLEE

SEQ ID NO: 536993 - protein, 11 aa, Influenza virus
RQKISGVKLEE

SEQ ID NO: 536994 - protein, 11 aa, Influenza virus
RQKRGLFGAIA

SEQ ID NO: 536995 - protein, 11 aa, Influenza virus
RQKSLIWLWLV

SEQ ID NO: 536996 - protein, 11 aa, Influenza virus
RQKVNGVKLEE

SEQ ID NO: 536997 - protein, 11 aa, Influenza virus
RQKWWVWLWLV

SEQ ID NO: 536998 - protein, 11 aa, Influenza virus
RQLRENAEDIG

SEQ ID NO: 536999 - protein, 11 aa, Influenza virus
RQLRENAEDKG

SEQ ID NO: 537000 - protein, 11 aa, Influenza virus
RQLRENAEDMG

SEQ ID NO: 537001 - protein, 11 aa, Influenza virus
RQLRENAEDQG

SEQ ID NO: 537002 - protein, 11 aa, Influenza virus
RQLRENAEDRG

SEQ ID NO: 537003 - protein, 11 aa, Influenza virus
RQLRENAEEDC

SEQ ID NO: 537004 - protein, 11 aa, Influenza virus
RQLRENAEEDG

SEQ ID NO: 537005 - protein, 11 aa, Influenza virus
RQNAEEDGKGC

SEQ ID NO: 537006 - protein, 11 aa, Influenza virus
RQNAEEDGRGC

SEQ ID NO: 537007 - protein, 11 aa, Influenza virus
RQRINGVKLEE

SEQ ID NO: 537008 - protein, 11 aa, Influenza virus
RQSERGEDTIE

SEQ ID NO: 537009 - protein, 11 aa, Influenza virus
RQSERGEETIE

SEQ ID NO: 537010 - protein, 11 aa, Influenza virus
RQSERGEETVE

SEQ ID NO: 537011 - protein, 11 aa, Influenza virus
RQSFSPSPGAR

SEQ ID NO: 537012 - protein, 11 aa, Influenza virus
RQTFDWTLNRN

SEQ ID NO: 537013 - protein, 11 aa, Influenza virus
RQTRGIFGAIA

SEQ ID NO: 537014 - protein, 11 aa, Influenza virus
RQTRGLFGAIA

SEQ ID NO: 537015 - protein, 11 aa, Influenza virus
RQTYDWTLNRN

SEQ ID NO: 537016 - protein, 11 aa, Influenza virus
RQVCIAWSSSS

SEQ ID NO: 537017 - protein, 11 aa, Influenza virus
RQVCMAWSSSS

SEQ ID NO: 537018 - protein, 11 aa, Influenza virus
RQVCVAWSSSS

SEQ ID NO: 537019 - protein, 11 aa, Influenza virus
RRAAVSADPLA

SEQ ID NO: 537020 - protein, 11 aa, Influenza virus
RRAEIIKMESA

SEQ ID NO: 537021 - protein, 11 aa, Influenza virus
RRAIATPGMQI

SEQ ID NO: 537022 - protein, 11 aa, Influenza virus
RRAIVSADPLA

SEQ ID NO: 537023 - protein, 11 aa, Influenza virus
RRATVSADPLA

SEQ ID NO: 537024 - protein, 11 aa, Influenza virus
RRATVSADPLL

SEQ ID NO: 537025 - protein, 11 aa, Influenza virus
RRATVSADPLV

SEQ ID NO: 537026 - protein, 11 aa, Influenza virus
RRCLLQSLQQI

SEQ ID NO: 537027 - protein, 11 aa, Influenza virus
RRDILRTQESE

SEQ ID NO: 537028 - protein, 11 aa, Influenza virus
RRDQKSLRGRG

SEQ ID NO: 537029 - protein, 11 aa, Influenza virus
RREIHIYYLEK

SEQ ID NO: 537030 - protein, 11 aa, Influenza virus
RREVHIYYLEK

SEQ ID NO: 537031 - protein, 11 aa, Influenza virus
RREVHMYYLEK

SEQ ID NO: 537032 - protein, 11 aa, Influenza virus
RREVHTYYLEK

SEQ ID NO: 537033 - protein, 11 aa, Influenza virus
RREVHVYYLEK

SEQ ID NO: 537034 - protein, 11 aa, Influenza virus
RRFIQNALNGN

SEQ ID NO: 537035 - protein, 11 aa, Influenza virus
RRFVQNALNGN

SEQ ID NO: 537036 - protein, 11 aa, Influenza virus
RRFVQNALSGN

SEQ ID NO: 537037 - protein, 11 aa, Influenza virus
RRGLFGAIAGF

SEQ ID NO: 537038 - protein, 11 aa, Influenza virus
RRGQGHLDEKA

SEQ ID NO: 537039 - protein, 11 aa, Influenza virus
RRICEKLEQSG

SEQ ID NO: 537040 - protein, 11 aa, Influenza virus
RRIDFHWLFLD

SEQ ID NO: 537041 - protein, 11 aa, Influenza virus
RRIDFHWLLLD

SEQ ID NO: 537042 - protein, 11 aa, Influenza virus
RRIDFHWLLLE

SEQ ID NO: 537043 - protein, 11 aa, Influenza virus
RRIDFNWLLLD

SEQ ID NO: 537044 - protein, 11 aa, Influenza virus
RRIENLNKKME

SEQ ID NO: 537045 - protein, 11 aa, Influenza virus
RRIENLNRKME

SEQ ID NO: 537046 - protein, 11 aa, Influenza virus
RRIESLNKKME

SEQ ID NO: 537047 - protein, 11 aa, Influenza virus
RRINMLADRID

SEQ ID NO: 537048 - protein, 11 aa, Influenza virus
RRKKRGLFGAI

SEQ ID NO: 537049 - protein, 11 aa, Influenza virus
RRKRGLFGAIA

SEQ ID NO: 537050 - protein, 11 aa, Influenza virus
RRKTNLYGFII

SEQ ID NO: 537051 - protein, 11 aa, Influenza virus
RRKTNLYGFIV

SEQ ID NO: 537052 - protein, 11 aa, Influenza virus
RRKTNLYGFLI

SEQ ID NO: 537053 - protein, 11 aa, Influenza virus
RRLTTTIKPWA

SEQ ID NO: 537054 - protein, 11 aa, Influenza virus
RRLTTTIKTWA

SEQ ID NO: 537055 - protein, 11 aa, Influenza virus
RRLTTTIRTWA

SEQ ID NO: 537056 - protein, 11 aa, Influenza virus
RRLTTTVKTWA

SEQ ID NO: 537057 - protein, 11 aa, Influenza virus
RRLTVLGKDAG

SEQ ID NO: 537058 - protein, 11 aa, Influenza virus
RRNKYLEEHPN

SEQ ID NO: 537059 - protein, 11 aa, Influenza virus
RRNKYLEEHPS

SEQ ID NO: 537060 - protein, 11 aa, Influenza virus
RRNRYLEEHPS

SEQ ID NO: 537061 - protein, 11 aa, Influenza virus
RRNRYLEENPS

SEQ ID NO: 537062 - protein, 11 aa, Influenza virus
RRNSSDICYPG

SEQ ID NO: 537063 - protein, 11 aa, Influenza virus
RRPDSSWLFGG

SEQ ID NO: 537064 - protein, 11 aa, Influenza virus
RRPIGISSMVE

SEQ ID NO: 537065 - protein, 11 aa, Influenza virus
RRPVAKAGFIE

SEQ ID NO: 537066 - protein, 11 aa, Influenza virus
RRPVGISSMGE

SEQ ID NO: 537067 - protein, 11 aa, Influenza virus
RRPVGISSMME

SEQ ID NO: 537068 - protein, 11 aa, Influenza virus
RRPVGISSMVE

SEQ ID NO: 537069 - protein, 11 aa, Influenza virus
RRQILRTQESS

SEQ ID NO: 537070 - protein, 11 aa, Influenza virus
RRQKRGLFGAI

SEQ ID NO: 537071 - protein, 11 aa, Influenza virus
RRQKSLIWLWL

SEQ ID NO: 537072 - protein, 11 aa, Influenza virus
RRQKWWVWLWL

SEQ ID NO: 537073 - protein, 11 aa, Influenza virus
RRQLRENAEDK

SEQ ID NO: 537074 - protein, 11 aa, Influenza virus
RRQLRENAEDQ

SEQ ID NO: 537075 - protein, 11 aa, Influenza virus
RRQLRENAEDR

SEQ ID NO: 537076 - protein, 11 aa, Influenza virus
RRQLRENAEED

SEQ ID NO: 537077 - protein, 11 aa, Influenza virus
RRRFIQNALNG

SEQ ID NO: 537078 - protein, 11 aa, Influenza virus
RRRFVQNALNG

SEQ ID NO: 537079 - protein, 11 aa, Influenza virus
RRRFVQNALSG

SEQ ID NO: 537080 - protein, 11 aa, Influenza virus
RRRGLFGAIAG

SEQ ID NO: 537081 - protein, 11 aa, Influenza virus
RRRKKRGLFGA

SEQ ID NO: 537082 - protein, 11 aa, Influenza virus
RRRTNLYGFII

SEQ ID NO: 537083 - protein, 11 aa, Influenza virus
RRRVDINPGHA

SEQ ID NO: 537084 - protein, 11 aa, Influenza virus
RRRVDINPGHS

SEQ ID NO: 537085 - protein, 11 aa, Influenza virus
RRRVDMNPGHA

SEQ ID NO: 537086 - protein, 11 aa, Influenza virus
RRRVDTNPGHA

SEQ ID NO: 537087 - protein, 11 aa, Influenza virus
RRRVDVNPGHA

SEQ ID NO: 537088 - protein, 11 aa, Influenza virus
RRSGAAGAAIK

SEQ ID NO: 537089 - protein, 11 aa, Influenza virus
RRSGAAGAAVK

SEQ ID NO: 537090 - protein, 11 aa, Influenza virus
RRTNLYGFIIK

SEQ ID NO: 537091 - protein, 11 aa, Influenza virus
RRVENLNKKME

SEQ ID NO: 537092 - protein, 11 aa, Influenza virus
RRYELEIGTRI

SEQ ID NO: 537093 - protein, 11 aa, Influenza virus
RRYGPALSINE

SEQ ID NO: 537094 - protein, 11 aa, Influenza virus
RRYGPALSISE

SEQ ID NO: 537095 - protein, 11 aa, Influenza virus
RSALILRGAVA

SEQ ID NO: 537096 - protein, 11 aa, Influenza virus
RSALILRGSIA

SEQ ID NO: 537097 - protein, 11 aa, Influenza virus
RSALILRGSVA

SEQ ID NO: 537098 - protein, 11 aa, Influenza virus
RSAYERMCNIL

SEQ ID NO: 537099 - protein, 11 aa, Influenza virus
RSDKICIGYHA

SEQ ID NO: 537100 - protein, 11 aa, Influenza virus
RSDKICLGHHA

SEQ ID NO: 537101 - protein, 11 aa, Influenza virus
RSDQISIVPNI

SEQ ID NO: 537102 - protein, 11 aa, Influenza virus
RSESSFYAEME

SEQ ID NO: 537103 - protein, 11 aa, Influenza virus
RSFKPNIGPRP

SEQ ID NO: 537104 - protein, 11 aa, Influenza virus
RSFQPNIGPRA

SEQ ID NO: 537105 - protein, 11 aa, Influenza virus
RSFQPNIGPRP

SEQ ID NO: 537106 - protein, 11 aa, Influenza virus
RSFRPNIGPRP

SEQ ID NO: 537107 - protein, 11 aa, Influenza virus
RSFSRTELIAP

SEQ ID NO: 537108 - protein, 11 aa, Influenza virus
RSFSRTELIPP

SEQ ID NO: 537109 - protein, 11 aa, Influenza virus
RSGAAGAAIKG

SEQ ID NO: 537110 - protein, 11 aa, Influenza virus
RSGAAGAAVKG

SEQ ID NO: 537111 - protein, 11 aa, Influenza virus
RSGFEIIWDPN

SEQ ID NO: 537112 - protein, 11 aa, Influenza virus
RSGFEILLIED

SEQ ID NO: 537113 - protein, 11 aa, Influenza virus
RSGFEILLIEE

SEQ ID NO: 537114 - protein, 11 aa, Influenza virus
RSGFEMIWDAN

SEQ ID NO: 537115 - protein, 11 aa, Influenza virus
RSGFEMIWDPD

SEQ ID NO: 537116 - protein, 11 aa, Influenza virus
RSGFEMIWDPN

SEQ ID NO: 537117 - protein, 11 aa, Influenza virus
RSGFEMLKIHN

SEQ ID NO: 537118 - protein, 11 aa, Influenza virus
RSGFEMLKIPN

SEQ ID NO: 537119 - protein, 11 aa, Influenza virus
RSGFEMLKVPN

SEQ ID NO: 537120 - protein, 11 aa, Influenza virus
RSGFEMLRIPN

SEQ ID NO: 537121 - protein, 11 aa, Influenza virus
RSGFEMVWDAN

SEQ ID NO: 537122 - protein, 11 aa, Influenza virus
RSGFEMVWDDN

SEQ ID NO: 537123 - protein, 11 aa, Influenza virus
RSGFEMVWDPN

SEQ ID NO: 537124 - protein, 11 aa, Influenza virus
RSGFEVLFIED

SEQ ID NO: 537125 - protein, 11 aa, Influenza virus
RSGFEVLKVPN

SEQ ID NO: 537126 - protein, 11 aa, Influenza virus
RSGFEVLLIED

SEQ ID NO: 537127 - protein, 11 aa, Influenza virus
RSGFEVLLIEN

SEQ ID NO: 537128 - protein, 11 aa, Influenza virus
RSGMDPRMCSL

SEQ ID NO: 537129 - protein, 11 aa, Influenza virus
RSGPSFYAEMK

SEQ ID NO: 537130 - protein, 11 aa, Influenza virus
RSGQNHGICAV

SEQ ID NO: 537131 - protein, 11 aa, Influenza virus
RSGSSFYAELK

SEQ ID NO: 537132 - protein, 11 aa, Influenza virus
RSGSSFYAEMK

SEQ ID NO: 537133 - protein, 11 aa, Influenza virus
RSGTSKACNAL

SEQ ID NO: 537134 - protein, 11 aa, Influenza virus
RSGTSKACNAS

SEQ ID NO: 537135 - protein, 11 aa, Influenza virus
RSGYEILKVPN

SEQ ID NO: 537136 - protein, 11 aa, Influenza virus
RSGYEMLKVPD

SEQ ID NO: 537137 - protein, 11 aa, Influenza virus
RSGYEMLKVPN

SEQ ID NO: 537138 - protein, 11 aa, Influenza virus
RSGYETFKVIG

SEQ ID NO: 537139 - protein, 11 aa, Influenza virus
RSGYETFRVID

SEQ ID NO: 537140 - protein, 11 aa, Influenza virus
RSGYETFRVIG

SEQ ID NO: 537141 - protein, 11 aa, Influenza virus
RSGYETFRVIS

SEQ ID NO: 537142 - protein, 11 aa, Influenza virus
RSGYETFRVTG

SEQ ID NO: 537143 - protein, 11 aa, Influenza virus
RSGYEVLKVPD

SEQ ID NO: 537144 - protein, 11 aa, Influenza virus
RSGYEVLKVPN

SEQ ID NO: 537145 - protein, 11 aa, Influenza virus
RSGYEVLRVPN

SEQ ID NO: 537146 - protein, 11 aa, Influenza virus
RSGYSGIFSVE

SEQ ID NO: 537147 - protein, 11 aa, Influenza virus
RSGYSGSFIDY

SEQ ID NO: 537148 - protein, 11 aa, Influenza virus
RSGYSGVFSVE

SEQ ID NO: 537149 - protein, 11 aa, Influenza virus
RSGYWAIRTRS

SEQ ID NO: 537150 - protein, 11 aa, Influenza virus
RSHKICIGYHA

SEQ ID NO: 537151 - protein, 11 aa, Influenza virus
RSHLRNDTDVV

SEQ ID NO: 537152 - protein, 11 aa, Influenza virus
RSICEKLEQSG

SEQ ID NO: 537153 - protein, 11 aa, Influenza virus
RSIEEKFEITG

SEQ ID NO: 537154 - protein, 11 aa, Influenza virus
RSIIFNMERIK

SEQ ID NO: 537155 - protein, 11 aa, Influenza virus
RSILANNGKFE

SEQ ID NO: 537156 - protein, 11 aa, Influenza virus
RSILANNGRFE

SEQ ID NO: 537157 - protein, 11 aa, Influenza virus
RSILASSGSLE

SEQ ID NO: 537158 - protein, 11 aa, Influenza virus
RSILNTSQRGI

SEQ ID NO: 537159 - protein, 11 aa, Influenza virus
RSILNTSQRGV

SEQ ID NO: 537160 - protein, 11 aa, Influenza virus
RSINWLTKKEP

SEQ ID NO: 537161 - protein, 11 aa, Influenza virus
RSINWLTKKKN

SEQ ID NO: 537162 - protein, 11 aa, Influenza virus
RSINWLTKKKP

SEQ ID NO: 537163 - protein, 11 aa, Influenza virus
RSIVASSGTLE

SEQ ID NO: 537164 - protein, 11 aa, Influenza virus
RSIVRRATVSA

SEQ ID NO: 537165 - protein, 11 aa, Influenza virus
RSKFLLMDALK

SEQ ID NO: 537166 - protein, 11 aa, Influenza virus
RSKFLLMDSLK

SEQ ID NO: 537167 - protein, 11 aa, Influenza virus
RSKINEVKLEE

SEQ ID NO: 537168 - protein, 11 aa, Influenza virus
RSKINGVILEE

SEQ ID NO: 537169 - protein, 11 aa, Influenza virus
RSKINGVKLEE

SEQ ID NO: 537170 - protein, 11 aa, Influenza virus
RSKINGVRLEE

SEQ ID NO: 537171 - protein, 11 aa, Influenza virus
RSKYWAIRTRS

SEQ ID NO: 537172 - protein, 11 aa, Influenza virus
RSLFSSIKKYE

SEQ ID NO: 537173 - protein, 11 aa, Influenza virus
RSLFSSIKRYE

SEQ ID NO: 537174 - protein, 11 aa, Influenza virus
RSLIASSGTLE

SEQ ID NO: 537175 - protein, 11 aa, Influenza virus
RSLIQFPIGTA

SEQ ID NO: 537176 - protein, 11 aa, Influenza virus
RSLIQFPMGTA

SEQ ID NO: 537177 - protein, 11 aa, Influenza virus
RSLIRFPIGTA

SEQ ID NO: 537178 - protein, 11 aa, Influenza virus
RSLIRFPIGVA

SEQ ID NO: 537179 - protein, 11 aa, Influenza virus
RSLIRFPVGTA

SEQ ID NO: 537180 - protein, 11 aa, Influenza virus
RSLISWPLSSP

SEQ ID NO: 537181 - protein, 11 aa, Influenza virus
RSLKLAIGLRN

SEQ ID NO: 537182 - protein, 11 aa, Influenza virus
RSLKLATGLRN

SEQ ID NO: 537183 - protein, 11 aa, Influenza virus
RSLLLATGMRN

SEQ ID NO: 537184 - protein, 11 aa, Influenza virus
RSLMLATGMRN

SEQ ID NO: 537185 - protein, 11 aa, Influenza virus
RSLVASSGNLE

SEQ ID NO: 537186 - protein, 11 aa, Influenza virus
RSLVASSGTLE

SEQ ID NO: 537187 - protein, 11 aa, Influenza virus
RSLWDSFRQSE

SEQ ID NO: 537188 - protein, 11 aa, Influenza virus
RSNAPSGIEYN

SEQ ID NO: 537189 - protein, 11 aa, Influenza virus
RSNAPSGVEYN

SEQ ID NO: 537190 - protein, 11 aa, Influenza virus
RSNENPAHKSQ

SEQ ID NO: 537191 - protein, 11 aa, Influenza virus
RSNIFNMERIK

SEQ ID NO: 537192 - protein, 11 aa, Influenza virus
RSPFRALISWE

SEQ ID NO: 537193 - protein, 11 aa, Influenza virus
RSPFRALISWG

SEQ ID NO: 537194 - protein, 11 aa, Influenza virus
RSPFRALVSWE

SEQ ID NO: 537195 - protein, 11 aa, Influenza virus
RSPFRTLMSCP

SEQ ID NO: 537196 - protein, 11 aa, Influenza virus
RSPFRTLMSVE

SEQ ID NO: 537197 - protein, 11 aa, Influenza virus
RSPFRTLMSVK

SEQ ID NO: 537198 - protein, 11 aa, Influenza virus
RSPGNAEIEDL

SEQ ID NO: 537199 - protein, 11 aa, Influenza virus
RSPHRALMSCP

SEQ ID NO: 537200 - protein, 11 aa, Influenza virus
RSPHRSLMSCP

SEQ ID NO: 537201 - protein, 11 aa, Influenza virus
RSPHRTLLMNE

SEQ ID NO: 537202 - protein, 11 aa, Influenza virus
RSPHRTLMSCP

SEQ ID NO: 537203 - protein, 11 aa, Influenza virus
RSPQRTLMSCP

SEQ ID NO: 537204 - protein, 11 aa, Influenza virus
RSPYRALISWE

SEQ ID NO: 537205 - protein, 11 aa, Influenza virus
RSPYRALMSCP

SEQ ID NO: 537206 - protein, 11 aa, Influenza virus
RSPYRALMSVP

SEQ ID NO: 537207 - protein, 11 aa, Influenza virus
RSPYRTLMSCP

SEQ ID NO: 537208 - protein, 11 aa, Influenza virus
RSPYRTLMSVE

SEQ ID NO: 537209 - protein, 11 aa, Influenza virus
RSPYRTLMSVG

SEQ ID NO: 537210 - protein, 11 aa, Influenza virus
RSPYRTLMSVK

SEQ ID NO: 537211 - protein, 11 aa, Influenza virus
RSQFRALISWE

SEQ ID NO: 537212 - protein, 11 aa, Influenza virus
RSQSGRISFYW

SEQ ID NO: 537213 - protein, 11 aa, Influenza virus
RSQYRALISWP

SEQ ID NO: 537214 - protein, 11 aa, Influenza virus
RSQYRALVSWP

SEQ ID NO: 537215 - protein, 11 aa, Influenza virus
RSQYRSLISWP

SEQ ID NO: 537216 - protein, 11 aa, Influenza virus
RSRNGFEMLKI

SEQ ID NO: 537217 - protein, 11 aa, Influenza virus
RSRSGFEMLKI

SEQ ID NO: 537218 - protein, 11 aa, Influenza virus
RSRSGFEMLKV

SEQ ID NO: 537219 - protein, 11 aa, Influenza virus
RSRSGFEMLRI

SEQ ID NO: 537220 - protein, 11 aa, Influenza virus
RSRSSFYAEMK

SEQ ID NO: 537221 - protein, 11 aa, Influenza virus
RSRYWAIRTRS

SEQ ID NO: 537222 - protein, 11 aa, Influenza virus
RSSCHDGKAWL

SEQ ID NO: 537223 - protein, 11 aa, Influenza virus
RSSFYAEMKWL

SEQ ID NO: 537224 - protein, 11 aa, Influenza virus
RSSSSFYAEMK

SEQ ID NO: 537225 - protein, 11 aa, Influenza virus
RSTIGDCPKYV

SEQ ID NO: 537226 - protein, 11 aa, Influenza virus
RSWKKQILRTQ

SEQ ID NO: 537227 - protein, 11 aa, Influenza virus
RSWMKIYWHLM

SEQ ID NO: 537228 - protein, 11 aa, Influenza virus
RSWMKLYWHLM

SEQ ID NO: 537229 - protein, 11 aa, Influenza virus
RSWRKKILRTQ

SEQ ID NO: 537230 - protein, 11 aa, Influenza virus
RSWRKQILRTQ

SEQ ID NO: 537231 - protein, 11 aa, Influenza virus
RSWRRQILRTQ

SEQ ID NO: 537232 - protein, 11 aa, Influenza virus
RSYNNTSGEQM

SEQ ID NO: 537233 - protein, 11 aa, Influenza virus
RTAFRGLISTP

SEQ ID NO: 537234 - protein, 11 aa, Influenza virus
RTAFRGLMSTP

SEQ ID NO: 537235 - protein, 11 aa, Influenza virus
RTATREGKHIV

SEQ ID NO: 537236 - protein, 11 aa, Influenza virus
RTAYERMCNIL

SEQ ID NO: 537237 - protein, 11 aa, Influenza virus
RTCKLLGINMS

SEQ ID NO: 537238 - protein, 11 aa, Influenza virus
RTCKLVGINMS

SEQ ID NO: 537239 - protein, 11 aa, Influenza virus
RTDGATSACKR

SEQ ID NO: 537240 - protein, 11 aa, Influenza virus
RTEESECVCHN

SEQ ID NO: 537241 - protein, 11 aa, Influenza virus
RTELINPNKWG

SEQ ID NO: 537242 - protein, 11 aa, Influenza virus
RTELINPSKWG

SEQ ID NO: 537243 - protein, 11 aa, Influenza virus
RTELIPPSKWG

SEQ ID NO: 537244 - protein, 11 aa, Influenza virus
RTELISPNKWG

SEQ ID NO: 537245 - protein, 11 aa, Influenza virus
RTELISPSKWG

SEQ ID NO: 537246 - protein, 11 aa, Influenza virus
RTESLQNRIQI

SEQ ID NO: 537247 - protein, 11 aa, Influenza virus
RTFFITQGSLL

SEQ ID NO: 537248 - protein, 11 aa, Influenza virus
RTFFLTHGALL

SEQ ID NO: 537249 - protein, 11 aa, Influenza virus
RTFFLTHGSLL

SEQ ID NO: 537250 - protein, 11 aa, Influenza virus
RTFFLTQGALL

SEQ ID NO: 537251 - protein, 11 aa, Influenza virus
RTFFLTQGSLL

SEQ ID NO: 537252 - protein, 11 aa, Influenza virus
RTFFLTQGSLP

SEQ ID NO: 537253 - protein, 11 aa, Influenza virus
RTFLAMITYIT

SEQ ID NO: 537254 - protein, 11 aa, Influenza virus
RTFQNIDKNAL

SEQ ID NO: 537255 - protein, 11 aa, Influenza virus
RTFQNIDRNAL

SEQ ID NO: 537256 - protein, 11 aa, Influenza virus
RTFSFQLINNK

SEQ ID NO: 537257 - protein, 11 aa, Influenza virus
RTGMDPRMCSL

SEQ ID NO: 537258 - protein, 11 aa, Influenza virus
RTGSLQNRIQI

SEQ ID NO: 537259 - protein, 11 aa, Influenza virus
RTGTFEFTSFF

SEQ ID NO: 537260 - protein, 11 aa, Influenza virus
RTHQYSEKGKW

SEQ ID NO: 537261 - protein, 11 aa, Influenza virus
RTHQYSEKGRW

SEQ ID NO: 537262 - protein, 11 aa, Influenza virus
RTHQYSERGKW

SEQ ID NO: 537263 - protein, 11 aa, Influenza virus
RTHQYSERGRW

SEQ ID NO: 537264 - protein, 11 aa, Influenza virus
RTIQNEDIPIG

SEQ ID NO: 537265 - protein, 11 aa, Influenza virus
RTISIASRSGY

SEQ ID NO: 537266 - protein, 11 aa, Influenza virus
RTISKDLRSGY

SEQ ID NO: 537267 - protein, 11 aa, Influenza virus
RTISKDSRSGY

SEQ ID NO: 537268 - protein, 11 aa, Influenza virus
RTISKDTRSGY

SEQ ID NO: 537269 - protein, 11 aa, Influenza virus
RTISMDSRSGY

SEQ ID NO: 537270 - protein, 11 aa, Influenza virus
RTISPHSRSGF

SEQ ID NO: 537271 - protein, 11 aa, Influenza virus
RTISPKLRSGF

SEQ ID NO: 537272 - protein, 11 aa, Influenza virus
RTISPRLRSGF

SEQ ID NO: 537273 - protein, 11 aa, Influenza virus
RTISPRSRNGF

SEQ ID NO: 537274 - protein, 11 aa, Influenza virus
RTISPRSRSGF

SEQ ID NO: 537275 - protein, 11 aa, Influenza virus
RTISRDSRSGY

SEQ ID NO: 537276 - protein, 11 aa, Influenza virus
RTISTASRAGY

SEQ ID NO: 537277 - protein, 11 aa, Influenza virus
RTISTASRSGY

SEQ ID NO: 537278 - protein, 11 aa, Influenza virus
RTISTASRYGY

SEQ ID NO: 537279 - protein, 11 aa, Influenza virus
RTIWTSGSSIA

SEQ ID NO: 537280 - protein, 11 aa, Influenza virus
RTKEGRRKTNL

SEQ ID NO: 537281 - protein, 11 aa, Influenza virus
RTKEGRRRTNL

SEQ ID NO: 537282 - protein, 11 aa, Influenza virus
RTKEMEGICYP

SEQ ID NO: 537283 - protein, 11 aa, Influenza virus
RTKSLESRRGF

SEQ ID NO: 537284 - protein, 11 aa, Influenza virus
RTKSLESRSGF

SEQ ID NO: 537285 - protein, 11 aa, Influenza virus
RTLDFHDSNVK

SEQ ID NO: 537286 - protein, 11 aa, Influenza virus
RTLDFHDSNVR

SEQ ID NO: 537287 - protein, 11 aa, Influenza virus
RTLDFHDSSVK

SEQ ID NO: 537288 - protein, 11 aa, Influenza virus
RTLDLHDANVK

SEQ ID NO: 537289 - protein, 11 aa, Influenza virus
RTLDLHDANVR

SEQ ID NO: 537290 - protein, 11 aa, Influenza virus
RTLDLHDSNVK

SEQ ID NO: 537291 - protein, 11 aa, Influenza virus
RTLFQQMRDIL

SEQ ID NO: 537292 - protein, 11 aa, Influenza virus
RTLFQQMRDVI

SEQ ID NO: 537293 - protein, 11 aa, Influenza virus
RTLFQQMRDVL

SEQ ID NO: 537294 - protein, 11 aa, Influenza virus
RTLGLHDANVR

SEQ ID NO: 537295 - protein, 11 aa, Influenza virus
RTLISWEMGQA

SEQ ID NO: 537296 - protein, 11 aa, Influenza virus
RTLLAKSVFNC

SEQ ID NO: 537297 - protein, 11 aa, Influenza virus
RTLLAKSVFNN

SEQ ID NO: 537298 - protein, 11 aa, Influenza virus
RTLLAKSVFNS

SEQ ID NO: 537299 - protein, 11 aa, Influenza virus
RTLLMNELGIP

SEQ ID NO: 537300 - protein, 11 aa, Influenza virus
RTLLMNELGVP

SEQ ID NO: 537301 - protein, 11 aa, Influenza virus
RTLLMNELGVS

SEQ ID NO: 537302 - protein, 11 aa, Influenza virus
RTLLMSELGVP

SEQ ID NO: 537303 - protein, 11 aa, Influenza virus
RTLMSCHIGVA

SEQ ID NO: 537304 - protein, 11 aa, Influenza virus
RTLMSCPIGVA

SEQ ID NO: 537305 - protein, 11 aa, Influenza virus
RTLMSCPMGVA

SEQ ID NO: 537306 - protein, 11 aa, Influenza virus
RTLMSCPVGVA

SEQ ID NO: 537307 - protein, 11 aa, Influenza virus
RTLNTASRSGY

SEQ ID NO: 537308 - protein, 11 aa, Influenza virus
RTLTLNTMTKD

SEQ ID NO: 537309 - protein, 11 aa, Influenza virus
RTLYFHDSNVK

SEQ ID NO: 537310 - protein, 11 aa, Influenza virus
RTNEKFHQIEK

SEQ ID NO: 537311 - protein, 11 aa, Influenza virus
RTNEKYHQIEK

SEQ ID NO: 537312 - protein, 11 aa, Influenza virus
RTNGNLIAPEF

SEQ ID NO: 537313 - protein, 11 aa, Influenza virus
RTNGTSKIKMK

SEQ ID NO: 537314 - protein, 11 aa, Influenza virus
RTNGTSKVKMK

SEQ ID NO: 537315 - protein, 11 aa, Influenza virus
RTNHQFELIDN

SEQ ID NO: 537316 - protein, 11 aa, Influenza virus
RTNLYGFIIKG

SEQ ID NO: 537317 - protein, 11 aa, Influenza virus
RTNQQFELIDN

SEQ ID NO: 537318 - protein, 11 aa, Influenza virus
RTPHRTLLMNE

SEQ ID NO: 537319 - protein, 11 aa, Influenza virus
RTPIAFLTSSI

SEQ ID NO: 537320 - protein, 11 aa, Influenza virus
RTPYRSLIKFP

SEQ ID NO: 537321 - protein, 11 aa, Influenza virus
RTPYRSLIQFP

SEQ ID NO: 537322 - protein, 11 aa, Influenza virus
RTPYRSLIRFP

SEQ ID NO: 537323 - protein, 11 aa, Influenza virus
RTPYRTLLMNE

SEQ ID NO: 537324 - protein, 11 aa, Influenza virus
RTQDSECVSHN

SEQ ID NO: 537325 - protein, 11 aa, Influenza virus
RTQESECACAN

SEQ ID NO: 537326 - protein, 11 aa, Influenza virus
RTQESECACIN

SEQ ID NO: 537327 - protein, 11 aa, Influenza virus
RTQESECACVN

SEQ ID NO: 537328 - protein, 11 aa, Influenza virus
RTQESECICIN

SEQ ID NO: 537329 - protein, 11 aa, Influenza virus
RTQESECLCID

SEQ ID NO: 537330 - protein, 11 aa, Influenza virus
RTQESECQCID

SEQ ID NO: 537331 - protein, 11 aa, Influenza virus
RTQESECQCIG

SEQ ID NO: 537332 - protein, 11 aa, Influenza virus
RTQESECQCIS

SEQ ID NO: 537333 - protein, 11 aa, Influenza virus
RTQESECQRID

SEQ ID NO: 537334 - protein, 11 aa, Influenza virus
RTQESECVCHK

SEQ ID NO: 537335 - protein, 11 aa, Influenza virus
RTQESECVCHN

SEQ ID NO: 537336 - protein, 11 aa, Influenza virus
RTQESECVCHS

SEQ ID NO: 537337 - protein, 11 aa, Influenza virus
RTQESECVCID

SEQ ID NO: 537338 - protein, 11 aa, Influenza virus
RTQESECVCIN

SEQ ID NO: 537339 - protein, 11 aa, Influenza virus
RTQESECVCIS

SEQ ID NO: 537340 - protein, 11 aa, Influenza virus
RTQESECVCQD

SEQ ID NO: 537341 - protein, 11 aa, Influenza virus
RTQESECVCVN

SEQ ID NO: 537342 - protein, 11 aa, Influenza virus
RTQESECVRHN

SEQ ID NO: 537343 - protein, 11 aa, Influenza virus
RTQESSCTCIK

SEQ ID NO: 537344 - protein, 11 aa, Influenza virus
RTQESSCTCIL

SEQ ID NO: 537345 - protein, 11 aa, Influenza virus
RTQESSCTCIQ

SEQ ID NO: 537346 - protein, 11 aa, Influenza virus
RTQESSCTCIR

SEQ ID NO: 537347 - protein, 11 aa, Influenza virus
RTQESSCVCIK

SEQ ID NO: 537348 - protein, 11 aa, Influenza virus
RTQESSCVCMK

SEQ ID NO: 537349 - protein, 11 aa, Influenza virus
RTQESSCVCMN

SEQ ID NO: 537350 - protein, 11 aa, Influenza virus
RTQESSCVCVK

SEQ ID NO: 537351 - protein, 11 aa, Influenza virus
RTRALVRSGMD

SEQ ID NO: 537352 - protein, 11 aa, Influenza virus
RTRALVRTGMD

SEQ ID NO: 537353 - protein, 11 aa, Influenza virus
RTREGRRKTNL

SEQ ID NO: 537354 - protein, 11 aa, Influenza virus
RTREILTKITV

SEQ ID NO: 537355 - protein, 11 aa, Influenza virus
RTREILTKTTV

SEQ ID NO: 537356 - protein, 11 aa, Influenza virus
RTREILTRTTV

SEQ ID NO: 537357 - protein, 11 aa, Influenza virus
RTRGILTKTTV

SEQ ID NO: 537358 - protein, 11 aa, Influenza virus
RTRGLFGAIAG

SEQ ID NO: 537359 - protein, 11 aa, Influenza virus
RTSHRTLLMNE

SEQ ID NO: 537360 - protein, 11 aa, Influenza virus
RTSISCLYKLS

SEQ ID NO: 537361 - protein, 11 aa, Influenza virus
RTSIWTSSSSM

SEQ ID NO: 537362 - protein, 11 aa, Influenza virus
RTSIWTSSSST

SEQ ID NO: 537363 - protein, 11 aa, Influenza virus
RTSYRSLIRFP

SEQ ID NO: 537364 - protein, 11 aa, Influenza virus
RTTNTYRNTDS

SEQ ID NO: 537365 - protein, 11 aa, Influenza virus
RTTSKDSRSGY

SEQ ID NO: 537366 - protein, 11 aa, Influenza virus
RTTVDHMAIIK

SEQ ID NO: 537367 - protein, 11 aa, Influenza virus
RTVGQCPKYVK

SEQ ID NO: 537368 - protein, 11 aa, Influenza virus
RTVGQCPKYVN

SEQ ID NO: 537369 - protein, 11 aa, Influenza virus
RTVGQCPKYVS

SEQ ID NO: 537370 - protein, 11 aa, Influenza virus
RTVSSFYSEMK

SEQ ID NO: 537371 - protein, 11 aa, Influenza virus
RTWAKNILRTQ

SEQ ID NO: 537372 - protein, 11 aa, Influenza virus
RTYNNTTGRDV

SEQ ID NO: 537373 - protein, 11 aa, Influenza virus
RVARCNTKCQT

SEQ ID NO: 537374 - protein, 11 aa, Influenza virus
RVAYERMCNIL

SEQ ID NO: 537375 - protein, 11 aa, Influenza virus
RVDDAVTDIWS

SEQ ID NO: 537376 - protein, 11 aa, Influenza virus
RVDDAVTDVWS

SEQ ID NO: 537377 - protein, 11 aa, Influenza virus
RVDKLTQGRQT

SEQ ID NO: 537378 - protein, 11 aa, Influenza virus
RVDNHSMSDIE

SEQ ID NO: 537379 - protein, 11 aa, Influenza virus
RVDRLTQGRQT

SEQ ID NO: 537380 - protein, 11 aa, Influenza virus
RVDTIIESNVT

SEQ ID NO: 537381 - protein, 11 aa, Influenza virus
RVDTIMEKNVT

SEQ ID NO: 537382 - protein, 11 aa, Influenza virus
RVECIGWSSTS

SEQ ID NO: 537383 - protein, 11 aa, Influenza virus
RVENLNKKMED

SEQ ID NO: 537384 - protein, 11 aa, Influenza virus
RVFLAMITYIT

SEQ ID NO: 537385 - protein, 11 aa, Influenza virus
RVFLTMITYIT

SEQ ID NO: 537386 - protein, 11 aa, Influenza virus
RVGCVILLNPF

SEQ ID NO: 537387 - protein, 11 aa, Influenza virus
RVGSRGHVFVI

SEQ ID NO: 537388 - protein, 11 aa, Influenza virus
RVKKQLRENAE

SEQ ID NO: 537389 - protein, 11 aa, Influenza virus
RVKMFDFIKWN

SEQ ID NO: 537390 - protein, 11 aa, Influenza virus
RVKMFDFSKWN

SEQ ID NO: 537391 - protein, 11 aa, Influenza virus
RVKMFDFTKWN

SEQ ID NO: 537392 - protein, 11 aa, Influenza virus
RVKRQLRENAE

SEQ ID NO: 537393 - protein, 11 aa, Influenza virus
RVKRRPVAKAG

SEQ ID NO: 537394 - protein, 11 aa, Influenza virus
RVRHQLRENAE

SEQ ID NO: 537395 - protein, 11 aa, Influenza virus
RVRKQLRENAE

SEQ ID NO: 537396 - protein, 11 aa, Influenza virus
RVRKQLRQNAE

SEQ ID NO: 537397 - protein, 11 aa, Influenza virus
RVRLFDYSRWN

SEQ ID NO: 537398 - protein, 11 aa, Influenza virus
RVRLQLRDNAK

SEQ ID NO: 537399 - protein, 11 aa, Influenza virus
RVRMQLRDNAK

SEQ ID NO: 537400 - protein, 11 aa, Influenza virus
RVRNGTYDHKE

SEQ ID NO: 537401 - protein, 11 aa, Influenza virus
RVRNQSGRISI

SEQ ID NO: 537402 - protein, 11 aa, Influenza virus
RVRRQLRENAE

SEQ ID NO: 537403 - protein, 11 aa, Influenza virus
RVSAGGDIWVT

SEQ ID NO: 537404 - protein, 11 aa, Influenza virus
RVSFYWTIVEP

SEQ ID NO: 537405 - protein, 11 aa, Influenza virus
RVTVSTRSDQI

SEQ ID NO: 537406 - protein, 11 aa, Influenza virus
RVWWTSNSIAV

SEQ ID NO: 537407 - protein, 11 aa, Influenza virus
RVWWTSNSIIV

SEQ ID NO: 537408 - protein, 11 aa, Influenza virus
RVWWTSNSIVA

SEQ ID NO: 537409 - protein, 11 aa, Influenza virus
RVWWTSNSIVS

SEQ ID NO: 537410 - protein, 11 aa, Influenza virus
RVWWTSNSIVV

SEQ ID NO: 537411 - protein, 11 aa, Influenza virus
RVWWTTNSIVV

SEQ ID NO: 537412 - protein, 11 aa, Influenza virus
RWALGENMAPE

SEQ ID NO: 537413 - protein, 11 aa, Influenza virus
RWETTGRNCTV

SEQ ID NO: 537414 - protein, 11 aa, Influenza virus
RWKHVTNTILL

SEQ ID NO: 537415 - protein, 11 aa, Influenza virus
RWLTLKLGQFP

SEQ ID NO: 537416 - protein, 11 aa, Influenza virus
RWLTLKSEQFP

SEQ ID NO: 537417 - protein, 11 aa, Influenza virus
RWLTLKSGQFP

SEQ ID NO: 537418 - protein, 11 aa, Influenza virus
RWMKIIRVGCV

SEQ ID NO: 537419 - protein, 11 aa, Influenza virus
RWPGLVAGWYG

SEQ ID NO: 537420 - protein, 11 aa, Influenza virus
RYELEIGARIG

SEQ ID NO: 537421 - protein, 11 aa, Influenza virus
RYELEIGTRIG

SEQ ID NO: 537422 - protein, 11 aa, Influenza virus
RYERVKMFDFT

SEQ ID NO: 537423 - protein, 11 aa, Influenza virus
RYGDGVWIGRT

SEQ ID NO: 537424 - protein, 11 aa, Influenza virus
RYGFVANFSME

SEQ ID NO: 537425 - protein, 11 aa, Influenza virus
RYGNGVWIGRT

SEQ ID NO: 537426 - protein, 11 aa, Influenza virus
RYGPALSINEL

SEQ ID NO: 537427 - protein, 11 aa, Influenza virus
RYGPALSISEL

SEQ ID NO: 537428 - protein, 11 aa, Influenza virus
RYGVKGFSFRY

SEQ ID NO: 537429 - protein, 11 aa, Influenza virus
RYGYIIEEYGK

SEQ ID NO: 537430 - protein, 11 aa, Influenza virus
RYGYIIEEYGR

SEQ ID NO: 537431 - protein, 11 aa, Influenza virus
RYGYIIEKYGS

SEQ ID NO: 537432 - protein, 11 aa, Influenza virus
RYGYIIEKYGT

SEQ ID NO: 537433 - protein, 11 aa, Influenza virus
RYICSGLVGDT

SEQ ID NO: 537434 - protein, 11 aa, Influenza virus
RYIPSGSLKLA

SEQ ID NO: 537435 - protein, 11 aa, Influenza virus
RYNGQRSWMKI

SEQ ID NO: 537436 - protein, 11 aa, Influenza virus
RYPDVRCVCRD

SEQ ID NO: 537437 - protein, 11 aa, Influenza virus
RYPNVRCVCRD

SEQ ID NO: 537438 - protein, 11 aa, Influenza virus
RYREEAMQNRI

SEQ ID NO: 537439 - protein, 11 aa, Influenza virus
RYSGFVRTLFQ

SEQ ID NO: 537440 - protein, 11 aa, Influenza virus
RYSGIKTDGAT

SEQ ID NO: 537441 - protein, 11 aa, Influenza virus
RYSGIRTDGAT

SEQ ID NO: 537442 - protein, 11 aa, Influenza virus
RYSIADKICIG

SEQ ID NO: 537443 - protein, 11 aa, Influenza virus
RYSKADKICIG

SEQ ID NO: 537444 - protein, 11 aa, Influenza virus
RYSRADKICIG

SEQ ID NO: 537445 - protein, 11 aa, Influenza virus
RYTYRCHKGDT

SEQ ID NO: 537446 - protein, 11 aa, Influenza virus
RYTYRCHRGDM

SEQ ID NO: 537447 - protein, 11 aa, Influenza virus
RYTYRCHRGDT

SEQ ID NO: 537448 - protein, 11 aa, Influenza virus
RYVCSGLVGDT

SEQ ID NO: 537449 - protein, 11 aa, Influenza virus
RYVCTGILTDT

SEQ ID NO: 537450 - protein, 11 aa, Influenza virus
RYVEDTKIDLW

SEQ ID NO: 537451 - protein, 11 aa, Influenza virus
RYVKQGSLKLA

SEQ ID NO: 537452 - protein, 11 aa, Influenza virus
RYVKQSSLPLA

SEQ ID NO: 537453 - protein, 11 aa, Influenza virus
RYWAIRTRSGG

SEQ ID NO: 537454 - protein, 11 aa, Influenza virus
SAASYKRIRLF

SEQ ID NO: 537455 - protein, 11 aa, Influenza virus
SAASYKRVRLF

SEQ ID NO: 537456 - protein, 11 aa, Influenza virus
SACKRTVSSFY

SEQ ID NO: 537457 - protein, 11 aa, Influenza virus
SACLRGGRNSF

SEQ ID NO: 537458 - protein, 11 aa, Influenza virus
SACYNPCFYVE

SEQ ID NO: 537459 - protein, 11 aa, Influenza virus
SADGDIWVTRE

SEQ ID NO: 537460 - protein, 11 aa, Influenza virus
SADHRIYWIRE

SEQ ID NO: 537461 - protein, 11 aa, Influenza virus
SADHRVYWIRE

SEQ ID NO: 537462 - protein, 11 aa, Influenza virus
SADMSIGITVI

SEQ ID NO: 537463 - protein, 11 aa, Influenza virus
SADMSIGVAVI

SEQ ID NO: 537464 - protein, 11 aa, Influenza virus
SADMSIGVTVI

SEQ ID NO: 537465 - protein, 11 aa, Influenza virus
SADPLASLLEM

SEQ ID NO: 537466 - protein, 11 aa, Influenza virus
SADPLLSLLEM

SEQ ID NO: 537467 - protein, 11 aa, Influenza virus
SADPLVSLLEM

SEQ ID NO: 537468 - protein, 11 aa, Influenza virus
SAEHIEECSCY

SEQ ID NO: 537469 - protein, 11 aa, Influenza virus
SAFDERRNKYL

SEQ ID NO: 537470 - protein, 11 aa, Influenza virus
SAFDERRNRYL

SEQ ID NO: 537471 - protein, 11 aa, Influenza virus
SAGALASCMGL

SEQ ID NO: 537472 - protein, 11 aa, Influenza virus
SAGGAIWVTRE

SEQ ID NO: 537473 - protein, 11 aa, Influenza virus
SAGGDIWATRE

SEQ ID NO: 537474 - protein, 11 aa, Influenza virus
SAGGDIWITRE

SEQ ID NO: 537475 - protein, 11 aa, Influenza virus
SAGGDIWVMRE

SEQ ID NO: 537476 - protein, 11 aa, Influenza virus
SAGGDIWVTRE

SEQ ID NO: 537477 - protein, 11 aa, Influenza virus
SAGGDIWVTRK

SEQ ID NO: 537478 - protein, 11 aa, Influenza virus
SAGGDIWVTRV

SEQ ID NO: 537479 - protein, 11 aa, Influenza virus
SAGGHIWVTRE

SEQ ID NO: 537480 - protein, 11 aa, Influenza virus
SAGGNIWITRE

SEQ ID NO: 537481 - protein, 11 aa, Influenza virus
SAGKDPKKTGG

SEQ ID NO: 537482 - protein, 11 aa, Influenza virus
SAGRDPKKTGG

SEQ ID NO: 537483 - protein, 11 aa, Influenza virus
SAHHRVYWIRE

SEQ ID NO: 537484 - protein, 11 aa, Influenza virus
SAIDQITGKLN

SEQ ID NO: 537485 - protein, 11 aa, Influenza virus
SAIDQITRKLN

SEQ ID NO: 537486 - protein, 11 aa, Influenza virus
SAIDQVTGKLN

SEQ ID NO: 537487 - protein, 11 aa, Influenza virus
SAINQITGKLN

SEQ ID NO: 537488 - protein, 11 aa, Influenza virus
SAKELVETNHT

SEQ ID NO: 537489 - protein, 11 aa, Influenza virus
SAKHIEECSCY

SEQ ID NO: 537490 - protein, 11 aa, Influenza virus
SAKHVEECSCY

SEQ ID NO: 537491 - protein, 11 aa, Influenza virus
SALGSPGCDHL

SEQ ID NO: 537492 - protein, 11 aa, Influenza virus
SALILRGAVAH

SEQ ID NO: 537493 - protein, 11 aa, Influenza virus
SALILRGSIAH

SEQ ID NO: 537494 - protein, 11 aa, Influenza virus
SALILRGSVAH

SEQ ID NO: 537495 - protein, 11 aa, Influenza virus
SAPEGMCYPGF

SEQ ID NO: 537496 - protein, 11 aa, Influenza virus
SAPEGMCYPGS

SEQ ID NO: 537497 - protein, 11 aa, Influenza virus
SAPGVKGFGFL

SEQ ID NO: 537498 - protein, 11 aa, Influenza virus
SAPHGLCYPGE

SEQ ID NO: 537499 - protein, 11 aa, Influenza virus
SAPHRLCYPGE

SEQ ID NO: 537500 - protein, 11 aa, Influenza virus
SAQATEECSRY

SEQ ID NO: 537501 - protein, 11 aa, Influenza virus
SAQHIEECSCY

SEQ ID NO: 537502 - protein, 11 aa, Influenza virus
SAQHIEGCSCY

SEQ ID NO: 537503 - protein, 11 aa, Influenza virus
SAQHVEECSCY

SEQ ID NO: 537504 - protein, 11 aa, Influenza virus
SARHIEECSCY

SEQ ID NO: 537505 - protein, 11 aa, Influenza virus
SARHIEEWSCY

SEQ ID NO: 537506 - protein, 11 aa, Influenza virus
SARHVEECSCY

SEQ ID NO: 537507 - protein, 11 aa, Influenza virus
SARQEKNPALR

SEQ ID NO: 537508 - protein, 11 aa, Influenza virus
SARSALILRGS

SEQ ID NO: 537509 - protein, 11 aa, Influenza virus
SASACHDGASW

SEQ ID NO: 537510 - protein, 11 aa, Influenza virus
SASACHDGISW

SEQ ID NO: 537511 - protein, 11 aa, Influenza virus
SASACHDGSSW

SEQ ID NO: 537512 - protein, 11 aa, Influenza virus
SASACHDGTNW

SEQ ID NO: 537513 - protein, 11 aa, Influenza virus
SASACHDGTSW

SEQ ID NO: 537514 - protein, 11 aa, Influenza virus
SASALILRGSV

SEQ ID NO: 537515 - protein, 11 aa, Influenza virus
SASCHDGRAWL

SEQ ID NO: 537516 - protein, 11 aa, Influenza virus
SASGDIWITRE

SEQ ID NO: 537517 - protein, 11 aa, Influenza virus
SASGKADTRIL

SEQ ID NO: 537518 - protein, 11 aa, Influenza virus
SASGRADTKIL

SEQ ID NO: 537519 - protein, 11 aa, Influenza virus
SASGRADTRIL

SEQ ID NO: 537520 - protein, 11 aa, Influenza virus
SASSISFCGVN

SEQ ID NO: 537521 - protein, 11 aa, Influenza virus
SASTGGQSFYR

SEQ ID NO: 537522 - protein, 11 aa, Influenza virus
SATACHDGKEW

SEQ ID NO: 537523 - protein, 11 aa, Influenza virus
SATACHDGKGW

SEQ ID NO: 537524 - protein, 11 aa, Influenza virus
SATACHDGKKW

SEQ ID NO: 537525 - protein, 11 aa, Influenza virus
SATACHDGRKW

SEQ ID NO: 537526 - protein, 11 aa, Influenza virus
SATACSDGPGW

SEQ ID NO: 537527 - protein, 11 aa, Influenza virus
SATACSDGSGW

SEQ ID NO: 537528 - protein, 11 aa, Influenza virus
SATGPADTRIY

SEQ ID NO: 537529 - protein, 11 aa, Influenza virus
SATGPADTRVY

SEQ ID NO: 537530 - protein, 11 aa, Influenza virus
SATGPAETRIY

SEQ ID NO: 537531 - protein, 11 aa, Influenza virus
SATGPAETRVY

SEQ ID NO: 537532 - protein, 11 aa, Influenza virus
SAVDQITGKLN

SEQ ID NO: 537533 - protein, 11 aa, Influenza virus
SAVLRGFLIIG

SEQ ID NO: 537534 - protein, 11 aa, Influenza virus
SAVLRGFLILG

SEQ ID NO: 537535 - protein, 11 aa, Influenza virus
SAVNQITGKLN

SEQ ID NO: 537536 - protein, 11 aa, Influenza virus
SAYCNTDLGAP

SEQ ID NO: 537537 - protein, 11 aa, Influenza virus
SAYERMCNILK

SEQ ID NO: 537538 - protein, 11 aa, Influenza virus
SCAAMDDFQLI

SEQ ID NO: 537539 - protein, 11 aa, Influenza virus
SCAAMDDYQLI

SEQ ID NO: 537540 - protein, 11 aa, Influenza virus
SCAAMDEFQLI

SEQ ID NO: 537541 - protein, 11 aa, Influenza virus
SCAAMEDFQLI

SEQ ID NO: 537542 - protein, 11 aa, Influenza virus
SCASNINIREW

SEQ ID NO: 537543 - protein, 11 aa, Influenza virus
SCATNINIREW

SEQ ID NO: 537544 - protein, 11 aa, Influenza virus
SCAVVMTDGSA

SEQ ID NO: 537545 - protein, 11 aa, Influenza virus
SCDPDECRFYA

SEQ ID NO: 537546 - protein, 11 aa, Influenza virus
SCDPDGCRFYA

SEQ ID NO: 537547 - protein, 11 aa, Influenza virus
SCDPIGCKMYA

SEQ ID NO: 537548 - protein, 11 aa, Influenza virus
SCDPLGCKMYA

SEQ ID NO: 537549 - protein, 11 aa, Influenza virus
SCDPLGCRMYA

SEQ ID NO: 537550 - protein, 11 aa, Influenza virus
SCDPNECRFYA

SEQ ID NO: 537551 - protein, 11 aa, Influenza virus
SCDPSGCKMYA

SEQ ID NO: 537552 - protein, 11 aa, Influenza virus
SCDPTGCKMYA

SEQ ID NO: 537553 - protein, 11 aa, Influenza virus
SCDSPSNINGE

SEQ ID NO: 537554 - protein, 11 aa, Influenza virus
SCDSPSNINGG

SEQ ID NO: 537555 - protein, 11 aa, Influenza virus
SCDSPSNVKGG

SEQ ID NO: 537556 - protein, 11 aa, Influenza virus
SCDSPSNVNGG

SEQ ID NO: 537557 - protein, 11 aa, Influenza virus
SCEGECFYSGG

SEQ ID NO: 537558 - protein, 11 aa, Influenza virus
SCEPDECRFYA

SEQ ID NO: 537559 - protein, 11 aa, Influenza virus
SCFDGKEWLHV

SEQ ID NO: 537560 - protein, 11 aa, Influenza virus
SCFDGKEWMHI

SEQ ID NO: 537561 - protein, 11 aa, Influenza virus
SCFDGKEWMHV

SEQ ID NO: 537562 - protein, 11 aa, Influenza virus
SCFDGREWMHV

SEQ ID NO: 537563 - protein, 11 aa, Influenza virus
SCFTIMTDGPN

SEQ ID NO: 537564 - protein, 11 aa, Influenza virus
SCFTIMTDGPS

SEQ ID NO: 537565 - protein, 11 aa, Influenza virus
SCFTVLTDGPS

SEQ ID NO: 537566 - protein, 11 aa, Influenza virus
SCFTVMTDGPS

SEQ ID NO: 537567 - protein, 11 aa, Influenza virus
SCFVFVALILG

SEQ ID NO: 537568 - protein, 11 aa, Influenza virus
SCGILGTIIGP

SEQ ID NO: 537569 - protein, 11 aa, Influenza virus
SCGPSECRTFF

SEQ ID NO: 537570 - protein, 11 aa, Influenza virus
SCHDGIGRMTI

SEQ ID NO: 537571 - protein, 11 aa, Influenza virus
SCHDGKAWLHI

SEQ ID NO: 537572 - protein, 11 aa, Influenza virus
SCHDGKAWLHV

SEQ ID NO: 537573 - protein, 11 aa, Influenza virus
SCHDGKSWLHV

SEQ ID NO: 537574 - protein, 11 aa, Influenza virus
SCHDGRAWLHV

SEQ ID NO: 537575 - protein, 11 aa, Influenza virus
SCHDGVGRMTI

SEQ ID NO: 537576 - protein, 11 aa, Influenza virus
SCHIGVAPSPS

SEQ ID NO: 537577 - protein, 11 aa, Influenza virus
SCIASSIVLVG

SEQ ID NO: 537578 - protein, 11 aa, Influenza virus
SCIASSIVMVG

SEQ ID NO: 537579 - protein, 11 aa, Influenza virus
SCIASSLILAA

SEQ ID NO: 537580 - protein, 11 aa, Influenza virus
SCIASSLVLAA

SEQ ID NO: 537581 - protein, 11 aa, Influenza virus
SCIASSTVLVG

SEQ ID NO: 537582 - protein, 11 aa, Influenza virus
SCIASSTVMVG

SEQ ID NO: 537583 - protein, 11 aa, Influenza virus
SCIASSVVLVG

SEQ ID NO: 537584 - protein, 11 aa, Influenza virus
SCIESIRNGTY

SEQ ID NO: 537585 - protein, 11 aa, Influenza virus
SCINRCFYVEL

SEQ ID NO: 537586 - protein, 11 aa, Influenza virus
SCINRCFYVES

SEQ ID NO: 537587 - protein, 11 aa, Influenza virus
SCKMYALHQGT

SEQ ID NO: 537588 - protein, 11 aa, Influenza virus
SCLPACAYGPA

SEQ ID NO: 537589 - protein, 11 aa, Influenza virus
SCLPACIYGLV

SEQ ID NO: 537590 - protein, 11 aa, Influenza virus
SCLPACVYGLA

SEQ ID NO: 537591 - protein, 11 aa, Influenza virus
SCLPACVYGLV

SEQ ID NO: 537592 - protein, 11 aa, Influenza virus
SCLPACVYGPA

SEQ ID NO: 537593 - protein, 11 aa, Influenza virus
SCMDTIRNGTY

SEQ ID NO: 537594 - protein, 11 aa, Influenza virus
SCMEAIRNGTY

SEQ ID NO: 537595 - protein, 11 aa, Influenza virus
SCMERIRNNTY

SEQ ID NO: 537596 - protein, 11 aa, Influenza virus
SCMESIRNNTY

SEQ ID NO: 537597 - protein, 11 aa, Influenza virus
SCMETIRNGTY

SEQ ID NO: 537598 - protein, 11 aa, Influenza virus
SCMGLIYNRMG

SEQ ID NO: 537599 - protein, 11 aa, Influenza virus
SCPIGEAPSPY

SEQ ID NO: 537600 - protein, 11 aa, Influenza virus
SCPIGEVPSPY

SEQ ID NO: 537601 - protein, 11 aa, Influenza virus
SCPIGVAPSPS

SEQ ID NO: 537602 - protein, 11 aa, Influenza virus
SCPLGEAPSPY

SEQ ID NO: 537603 - protein, 11 aa, Influenza virus
SCPMGVAPSPS

SEQ ID NO: 537604 - protein, 11 aa, Influenza virus
SCPVGEAPSPY

SEQ ID NO: 537605 - protein, 11 aa, Influenza virus
SCPVGVAPSPS

SEQ ID NO: 537606 - protein, 11 aa, Influenza virus
SCSHLECRTFF

SEQ ID NO: 537607 - protein, 11 aa, Influenza virus
SCSHLECRTFS

SEQ ID NO: 537608 - protein, 11 aa, Influenza virus
SCSHMECRTFF

SEQ ID NO: 537609 - protein, 11 aa, Influenza virus
SCSHSECRTFF

SEQ ID NO: 537610 - protein, 11 aa, Influenza virus
SCSIDECRTFF

SEQ ID NO: 537611 - protein, 11 aa, Influenza virus
SCSIHECRTFF

SEQ ID NO: 537612 - protein, 11 aa, Influenza virus
SCSINECRTFF

SEQ ID NO: 537613 - protein, 11 aa, Influenza virus
SCSISECRTFF

SEQ ID NO: 537614 - protein, 11 aa, Influenza virus
SCSSPSGIEGR

SEQ ID NO: 537615 - protein, 11 aa, Influenza virus
SCSVSECRTFF

SEQ ID NO: 537616 - protein, 11 aa, Influenza virus
SCSYLECRTFF

SEQ ID NO: 537617 - protein, 11 aa, Influenza virus
SCTSPCLTDKG

SEQ ID NO: 537618 - protein, 11 aa, Influenza virus
SCTVVMTDGNA

SEQ ID NO: 537619 - protein, 11 aa, Influenza virus
SCTVVMTDGSA

SEQ ID NO: 537620 - protein, 11 aa, Influenza virus
SCVCRDNWQGA

SEQ ID NO: 537621 - protein, 11 aa, Influenza virus
SCVMLLAIAMG

SEQ ID NO: 537622 - protein, 11 aa, Influenza virus
SCVNRCFYVEL

SEQ ID NO: 537623 - protein, 11 aa, Influenza virus
SCYDGKAWLHI

SEQ ID NO: 537624 - protein, 11 aa, Influenza virus
SCYDGKAWLHV

SEQ ID NO: 537625 - protein, 11 aa, Influenza virus
SCYPNDGKVEC

SEQ ID NO: 537626 - protein, 11 aa, Influenza virus
SCYPNEGKVEC

SEQ ID NO: 537627 - protein, 11 aa, Influenza virus
SCYPNLGIVEC

SEQ ID NO: 537628 - protein, 11 aa, Influenza virus
SCYPNLGKVEC

SEQ ID NO: 537629 - protein, 11 aa, Influenza virus
SCYPNLGQVEC

SEQ ID NO: 537630 - protein, 11 aa, Influenza virus
SCYPNMGKVEC

SEQ ID NO: 537631 - protein, 11 aa, Influenza virus
SCYPNNGKVEC

SEQ ID NO: 537632 - protein, 11 aa, Influenza virus
SCYPNSGKVEC

SEQ ID NO: 537633 - protein, 11 aa, Influenza virus
SCYPQYPNVRC

SEQ ID NO: 537634 - protein, 11 aa, Influenza virus
SCYPRYPDVRC

SEQ ID NO: 537635 - protein, 11 aa, Influenza virus
SCYPRYPGVRC

SEQ ID NO: 537636 - protein, 11 aa, Influenza virus
SCYPRYPNVRC

SEQ ID NO: 537637 - protein, 11 aa, Influenza virus
SCYSRYPNVRC

SEQ ID NO: 537638 - protein, 11 aa, Influenza virus
SDAPFLDRLRR

SEQ ID NO: 537639 - protein, 11 aa, Influenza virus
SDAQAFYKILK

SEQ ID NO: 537640 - protein, 11 aa, Influenza virus
SDAQAFYKLLK

SEQ ID NO: 537641 - protein, 11 aa, Influenza virus
SDAQIDESCEG

SEQ ID NO: 537642 - protein, 11 aa, Influenza virus
SDDFALILNAP

SEQ ID NO: 537643 - protein, 11 aa, Influenza virus
SDDFALIVNAL

SEQ ID NO: 537644 - protein, 11 aa, Influenza virus
SDDFALIVNAP

SEQ ID NO: 537645 - protein, 11 aa, Influenza virus
SDDFALIVNAS

SEQ ID NO: 537646 - protein, 11 aa, Influenza virus
SDDNVYKALSI

SEQ ID NO: 537647 - protein, 11 aa, Influenza virus
SDDSVYKALSI

SEQ ID NO: 537648 - protein, 11 aa, Influenza virus
SDEALKMTIAS

SEQ ID NO: 537649 - protein, 11 aa, Influenza virus
SDFICVGWSST

SEQ ID NO: 537650 - protein, 11 aa, Influenza virus
SDFLCVGWSST

SEQ ID NO: 537651 - protein, 11 aa, Influenza virus
SDFMCVGWSST

SEQ ID NO: 537652 - protein, 11 aa, Influenza virus
SDGGPNLYNIR

SEQ ID NO: 537653 - protein, 11 aa, Influenza virus
SDGPGWLTIGI

SEQ ID NO: 537654 - protein, 11 aa, Influenza virus
SDGPGWLTLGI

SEQ ID NO: 537655 - protein, 11 aa, Influenza virus
SDGSGWLTLGI

SEQ ID NO: 537656 - protein, 11 aa, Influenza virus
SDHICIGYHAN

SEQ ID NO: 537657 - protein, 11 aa, Influenza virus
SDICYPGKFTN

SEQ ID NO: 537658 - protein, 11 aa, Influenza virus
SDICYPGRFTN

SEQ ID NO: 537659 - protein, 11 aa, Influenza virus
SDIEAMASQGT

SEQ ID NO: 537660 - protein, 11 aa, Influenza virus
SDIEIMASQGT

SEQ ID NO: 537661 - protein, 11 aa, Influenza virus
SDIGAMASQGT

SEQ ID NO: 537662 - protein, 11 aa, Influenza virus
SDILVTREPYV

SEQ ID NO: 537663 - protein, 11 aa, Influenza virus
SDINIMASQGT

SEQ ID NO: 537664 - protein, 11 aa, Influenza virus
SDKICIGYHAN

SEQ ID NO: 537665 - protein, 11 aa, Influenza virus
SDKICLGHHAV

SEQ ID NO: 537666 - protein, 11 aa, Influenza virus
SDKLYIWGVHH

SEQ ID NO: 537667 - protein, 11 aa, Influenza virus
SDKPFQNVSRI

SEQ ID NO: 537668 - protein, 11 aa, Influenza virus
SDKRIGSCTSP

SEQ ID NO: 537669 - protein, 11 aa, Influenza virus
SDLDYQIGYIC

SEQ ID NO: 537670 - protein, 11 aa, Influenza virus
SDLDYQIGYVC

SEQ ID NO: 537671 - protein, 11 aa, Influenza virus
SDLEALMEWLK

SEQ ID NO: 537672 - protein, 11 aa, Influenza virus
SDLNYQIGYIC

SEQ ID NO: 537673 - protein, 11 aa, Influenza virus
SDNADKICLGH

SEQ ID NO: 537674 - protein, 11 aa, Influenza virus
SDNEQTDLYKV

SEQ ID NO: 537675 - protein, 11 aa, Influenza virus
SDNRSGYSGIF

SEQ ID NO: 537676 - protein, 11 aa, Influenza virus
SDQICIGYHAN

SEQ ID NO: 537677 - protein, 11 aa, Influenza virus
SDQICVGYHAN

SEQ ID NO: 537678 - protein, 11 aa, Influenza virus
SDQISIVPNIG

SEQ ID NO: 537679 - protein, 11 aa, Influenza virus
SDQLKLATGLR

SEQ ID NO: 537680 - protein, 11 aa, Influenza virus
SDRICIGYHAN

SEQ ID NO: 537681 - protein, 11 aa, Influenza virus
SDRLVLATGLR

SEQ ID NO: 537682 - protein, 11 aa, Influenza virus
SDSIKSWRKDI

SEQ ID NO: 537683 - protein, 11 aa, Influenza virus
SDSSFYAEMKW

SEQ ID NO: 537684 - protein, 11 aa, Influenza virus
SDTPRGEDAQF

SEQ ID NO: 537685 - protein, 11 aa, Influenza virus
SDTPRGEDGQF

SEQ ID NO: 537686 - protein, 11 aa, Influenza virus
SDTPRGEDNQF

SEQ ID NO: 537687 - protein, 11 aa, Influenza virus
SDTPRGEDSQF

SEQ ID NO: 537688 - protein, 11 aa, Influenza virus
SDTTCWSWPDG

SEQ ID NO: 537689 - protein, 11 aa, Influenza virus
SDTTGWPWPDG

SEQ ID NO: 537690 - protein, 11 aa, Influenza virus
SDTTGWSWPDG

SEQ ID NO: 537691 - protein, 11 aa, Influenza virus
SDTTSWSWPDG

SEQ ID NO: 537692 - protein, 11 aa, Influenza virus
SDTVDTLTENG

SEQ ID NO: 537693 - protein, 11 aa, Influenza virus
SDVLVTREPYV

SEQ ID NO: 537694 - protein, 11 aa, Influenza virus
SDVWLGRTVST

SEQ ID NO: 537695 - protein, 11 aa, Influenza virus
SDWSGYSGSFI

SEQ ID NO: 537696 - protein, 11 aa, Influenza virus
SECICINGTCT

SEQ ID NO: 537697 - protein, 11 aa, Influenza virus
SECRTFFLTQG

SEQ ID NO: 537698 - protein, 11 aa, Influenza virus
SECVCHKGICP

SEQ ID NO: 537699 - protein, 11 aa, Influenza virus
SECVCHKGVCP

SEQ ID NO: 537700 - protein, 11 aa, Influenza virus
SECVCHNGICP

SEQ ID NO: 537701 - protein, 11 aa, Influenza virus
SECVCHNGTCA

SEQ ID NO: 537702 - protein, 11 aa, Influenza virus
SECVCHNGTCG

SEQ ID NO: 537703 - protein, 11 aa, Influenza virus
SECVCHNGTCV

SEQ ID NO: 537704 - protein, 11 aa, Influenza virus
SECVCHNGVCP

SEQ ID NO: 537705 - protein, 11 aa, Influenza virus
SECVCHNSTCV

SEQ ID NO: 537706 - protein, 11 aa, Influenza virus
SECVCHSGICP

SEQ ID NO: 537707 - protein, 11 aa, Influenza virus
SECVCINGICT

SEQ ID NO: 537708 - protein, 11 aa, Influenza virus
SECVCINGSCA

SEQ ID NO: 537709 - protein, 11 aa, Influenza virus
SECVCINGSCI

SEQ ID NO: 537710 - protein, 11 aa, Influenza virus
SECVCINGSCT

SEQ ID NO: 537711 - protein, 11 aa, Influenza virus
SECVCINGTCA

SEQ ID NO: 537712 - protein, 11 aa, Influenza virus
SECVCINGTCT

SEQ ID NO: 537713 - protein, 11 aa, Influenza virus
SECVCISGTCA

SEQ ID NO: 537714 - protein, 11 aa, Influenza virus
SECVCQDEFCY

SEQ ID NO: 537715 - protein, 11 aa, Influenza virus
SECVCQNGVCP

SEQ ID NO: 537716 - protein, 11 aa, Influenza virus
SECVRHNGTCA

SEQ ID NO: 537717 - protein, 11 aa, Influenza virus
SECVSHNGTWA

SEQ ID NO: 537718 - protein, 11 aa, Influenza virus
SECYNPCFYVE

SEQ ID NO: 537719 - protein, 11 aa, Influenza virus
SEDGVYKALSI

SEQ ID NO: 537720 - protein, 11 aa, Influenza virus
SEDNVYKALSI

SEQ ID NO: 537721 - protein, 11 aa, Influenza virus
SEDNVYKVLSI

SEQ ID NO: 537722 - protein, 11 aa, Influenza virus
SEDNVYRALSI

SEQ ID NO: 537723 - protein, 11 aa, Influenza virus
SEEALRQKIME

SEQ ID NO: 537724 - protein, 11 aa, Influenza virus
SEECSCYVDID

SEQ ID NO: 537725 - protein, 11 aa, Influenza virus
SEFICVGWSST

SEQ ID NO: 537726 - protein, 11 aa, Influenza virus
SEFLCVGWSST

SEQ ID NO: 537727 - protein, 11 aa, Influenza virus
SEFNEIEHQIG

SEQ ID NO: 537728 - protein, 11 aa, Influenza virus
SEFNEIEYQIG

SEQ ID NO: 537729 - protein, 11 aa, Influenza virus
SEFNKACELTD

SEQ ID NO: 537730 - protein, 11 aa, Influenza virus
SEFNKACELTG

SEQ ID NO: 537731 - protein, 11 aa, Influenza virus
SEFSEIEHQIG

SEQ ID NO: 537732 - protein, 11 aa, Influenza virus
SEFSEIEHQIS

SEQ ID NO: 537733 - protein, 11 aa, Influenza virus
SEFSETEHQIG

SEQ ID NO: 537734 - protein, 11 aa, Influenza virus
SEGIGQAADLK

SEQ ID NO: 537735 - protein, 11 aa, Influenza virus
SEGMGQAADLK

SEQ ID NO: 537736 - protein, 11 aa, Influenza virus
SEGRGQAADLK

SEQ ID NO: 537737 - protein, 11 aa, Influenza virus
SEGTGMAADQK

SEQ ID NO: 537738 - protein, 11 aa, Influenza virus
SEGTGQAADLK

SEQ ID NO: 537739 - protein, 11 aa, Influenza virus
SEGTGQAGDLK

SEQ ID NO: 537740 - protein, 11 aa, Influenza virus
SEGTGTAADLK

SEQ ID NO: 537741 - protein, 11 aa, Influenza virus
SEHTAYSQITN

SEQ ID NO: 537742 - protein, 11 aa, Influenza virus
SEIEGRIQDLE

SEQ ID NO: 537743 - protein, 11 aa, Influenza virus
SEIEHQIGNVI

SEQ ID NO: 537744 - protein, 11 aa, Influenza virus
SEIEHQISNVI

SEQ ID NO: 537745 - protein, 11 aa, Influenza virus
SEIEQQIGNVI

SEQ ID NO: 537746 - protein, 11 aa, Influenza virus
SEKLVLATGLR

SEQ ID NO: 537747 - protein, 11 aa, Influenza virus
SEKLVLATGPR

SEQ ID NO: 537748 - protein, 11 aa, Influenza virus
SELGVPFHLGT

SEQ ID NO: 537749 - protein, 11 aa, Influenza virus
SEMKKLYERVR

SEQ ID NO: 537750 - protein, 11 aa, Influenza virus
SEMKWLLSSKA

SEQ ID NO: 537751 - protein, 11 aa, Influenza virus
SEMKWLLSSKD

SEQ ID NO: 537752 - protein, 11 aa, Influenza virus
SEMKWLSSSGN

SEQ ID NO: 537753 - protein, 11 aa, Influenza virus
SEMKWLSSSMN

SEQ ID NO: 537754 - protein, 11 aa, Influenza virus
SEMLNLYDRVR

SEQ ID NO: 537755 - protein, 11 aa, Influenza virus
SEMLNLYERVR

SEQ ID NO: 537756 - protein, 11 aa, Influenza virus
SEMNKLFERVR

SEQ ID NO: 537757 - protein, 11 aa, Influenza virus
SEMNKLYEKVR

SEQ ID NO: 537758 - protein, 11 aa, Influenza virus
SEMNKLYERVK

SEQ ID NO: 537759 - protein, 11 aa, Influenza virus
SEMNKLYERVR

SEQ ID NO: 537760 - protein, 11 aa, Influenza virus
SEMSKLYERVK

SEQ ID NO: 537761 - protein, 11 aa, Influenza virus
SEMSKLYERVR

SEQ ID NO: 537762 - protein, 11 aa, Influenza virus
SEQAAEAIEVA

SEQ ID NO: 537763 - protein, 11 aa, Influenza virus
SEQAAEAMDIA

SEQ ID NO: 537764 - protein, 11 aa, Influenza virus
SEQAAEAMEIA

SEQ ID NO: 537765 - protein, 11 aa, Influenza virus
SEQAAEAMEVA

SEQ ID NO: 537766 - protein, 11 aa, Influenza virus
SEQFPVQTDEY

SEQ ID NO: 537767 - protein, 11 aa, Influenza virus
SEQIIVTREPY

SEQ ID NO: 537768 - protein, 11 aa, Influenza virus
SEQIVVTREPY

SEQ ID NO: 537769 - protein, 11 aa, Influenza virus
SEQMETGGERQ

SEQ ID NO: 537770 - protein, 11 aa, Influenza virus
SEQNVPVTQVE

SEQ ID NO: 537771 - protein, 11 aa, Influenza virus
SEQVIVTREPY

SEQ ID NO: 537772 - protein, 11 aa, Influenza virus
SERGEDTIEER

SEQ ID NO: 537773 - protein, 11 aa, Influenza virus
SERGEETIEEK

SEQ ID NO: 537774 - protein, 11 aa, Influenza virus
SERGEETIEER

SEQ ID NO: 537775 - protein, 11 aa, Influenza virus
SERGEETVEER

SEQ ID NO: 537776 - protein, 11 aa, Influenza virus
SERGLFGAIAG

SEQ ID NO: 537777 - protein, 11 aa, Influenza virus
SERGLQRRRFI

SEQ ID NO: 537778 - protein, 11 aa, Influenza virus
SERGLQRRRFV

SEQ ID NO: 537779 - protein, 11 aa, Influenza virus
SERLVLATGLR

SEQ ID NO: 537780 - protein, 11 aa, Influenza virus
SESGRLIDFLK

SEQ ID NO: 537781 - protein, 11 aa, Influenza virus
SESRSNIFNME

SEQ ID NO: 537782 - protein, 11 aa, Influenza virus
SESSFYAEMEW

SEQ ID NO: 537783 - protein, 11 aa, Influenza virus
SETEHQIGNVI

SEQ ID NO: 537784 - protein, 11 aa, Influenza virus
SEVEGRIQDLE

SEQ ID NO: 537785 - protein, 11 aa, Influenza virus
SEVEGRIQNLE

SEQ ID NO: 537786 - protein, 11 aa, Influenza virus
SEVPEWSWDDG

SEQ ID NO: 537787 - protein, 11 aa, Influenza virus
SEVPGWSWDDG

SEQ ID NO: 537788 - protein, 11 aa, Influenza virus
SEVPGWSWGDG

SEQ ID NO: 537789 - protein, 11 aa, Influenza virus
SEVRGDQMAHC

SEQ ID NO: 537790 - protein, 11 aa, Influenza virus
SEVRRDQMAHC

SEQ ID NO: 537791 - protein, 11 aa, Influenza virus
SFAGWILGNPM

SEQ ID NO: 537792 - protein, 11 aa, Influenza virus
SFAGWILGNPR

SEQ ID NO: 537793 - protein, 11 aa, Influenza virus
SFALAQGALLG

SEQ ID NO: 537794 - protein, 11 aa, Influenza virus
SFALAQGALVG

SEQ ID NO: 537795 - protein, 11 aa, Influenza virus
SFALAQGTLLG

SEQ ID NO: 537796 - protein, 11 aa, Influenza virus
SFALAQGVLLG

SEQ ID NO: 537797 - protein, 11 aa, Influenza virus
SFALSQGALLG

SEQ ID NO: 537798 - protein, 11 aa, Influenza virus
SFEGWIGGNPA

SEQ ID NO: 537799 - protein, 11 aa, Influenza virus
SFEGWIVGNPA

SEQ ID NO: 537800 - protein, 11 aa, Influenza virus
SFEGWIVGNPS

SEQ ID NO: 537801 - protein, 11 aa, Influenza virus
SFEQITFIQAL

SEQ ID NO: 537802 - protein, 11 aa, Influenza virus
SFEQITFLQAL

SEQ ID NO: 537803 - protein, 11 aa, Influenza virus
SFEQITFMQAL

SEQ ID NO: 537804 - protein, 11 aa, Influenza virus
SFESNGGLLAP

SEQ ID NO: 537805 - protein, 11 aa, Influenza virus
SFESNGNFIAP

SEQ ID NO: 537806 - protein, 11 aa, Influenza virus
SFESTGNLIAP

SEQ ID NO: 537807 - protein, 11 aa, Influenza virus
SFESTGNLVAP

SEQ ID NO: 537808 - protein, 11 aa, Influenza virus
SFFRNIVWLIK

SEQ ID NO: 537809 - protein, 11 aa, Influenza virus
SFFRNVVWLIK

SEQ ID NO: 537810 - protein, 11 aa, Influenza virus
SFFRNVVWLTK

SEQ ID NO: 537811 - protein, 11 aa, Influenza virus
SFFRNVVWLVK

SEQ ID NO: 537812 - protein, 11 aa, Influenza virus
SFFSRLNWLTK

SEQ ID NO: 537813 - protein, 11 aa, Influenza virus
SFFYRYGFVAN

SEQ ID NO: 537814 - protein, 11 aa, Influenza virus
SFGASCFIFLA

SEQ ID NO: 537815 - protein, 11 aa, Influenza virus
SFGASCFILLA

SEQ ID NO: 537816 - protein, 11 aa, Influenza virus
SFGASCFLFLA

SEQ ID NO: 537817 - protein, 11 aa, Influenza virus
SFGASCFLLIA

SEQ ID NO: 537818 - protein, 11 aa, Influenza virus
SFGASCFLLLA

SEQ ID NO: 537819 - protein, 11 aa, Influenza virus
SFGASCFVLLA

SEQ ID NO: 537820 - protein, 11 aa, Influenza virus
SFGASCVMLLA

SEQ ID NO: 537821 - protein, 11 aa, Influenza virus
SFGASSFVLLA

SEQ ID NO: 537822 - protein, 11 aa, Influenza virus
SFGGFTFKRTK

SEQ ID NO: 537823 - protein, 11 aa, Influenza virus
SFGGFTFKRTN

SEQ ID NO: 537824 - protein, 11 aa, Influenza virus
SFGGFTFKRTS

SEQ ID NO: 537825 - protein, 11 aa, Influenza virus
SFGSFTFKRTS

SEQ ID NO: 537826 - protein, 11 aa, Influenza virus
SFGVSGINESA

SEQ ID NO: 537827 - protein, 11 aa, Influenza virus
SFGVSGVNESA

SEQ ID NO: 537828 - protein, 11 aa, Influenza virus
SFIQHPELTGL

SEQ ID NO: 537829 - protein, 11 aa, Influenza virus
SFKPNIGPRPF

SEQ ID NO: 537830 - protein, 11 aa, Influenza virus
SFKPNIGPRPL

SEQ ID NO: 537831 - protein, 11 aa, Influenza virus
SFLAHALKLVV

SEQ ID NO: 537832 - protein, 11 aa, Influenza virus
SFNGAFIAPDR

SEQ ID NO: 537833 - protein, 11 aa, Influenza virus
SFNGAFVAPDR

SEQ ID NO: 537834 - protein, 11 aa, Influenza virus
SFPDGAKIQYF

SEQ ID NO: 537835 - protein, 11 aa, Influenza virus
SFPDGAQIKYF

SEQ ID NO: 537836 - protein, 11 aa, Influenza virus
SFPDGAQIQYF

SEQ ID NO: 537837 - protein, 11 aa, Influenza virus
SFPDGARIQYF

SEQ ID NO: 537838 - protein, 11 aa, Influenza virus
SFPNGAQIQYF

SEQ ID NO: 537839 - protein, 11 aa, Influenza virus
SFPQTTNTYRN

SEQ ID NO: 537840 - protein, 11 aa, Influenza virus
SFQGGHIEECS

SEQ ID NO: 537841 - protein, 11 aa, Influenza virus
SFQGRGVFEFS

SEQ ID NO: 537842 - protein, 11 aa, Influenza virus
SFQGRGVFELS

SEQ ID NO: 537843 - protein, 11 aa, Influenza virus
SFQPNIGPRAL

SEQ ID NO: 537844 - protein, 11 aa, Influenza virus
SFQPNIGPRPL

SEQ ID NO: 537845 - protein, 11 aa, Influenza virus
SFRGGHIEECS

SEQ ID NO: 537846 - protein, 11 aa, Influenza virus
SFRGRGVFELS

SEQ ID NO: 537847 - protein, 11 aa, Influenza virus
SFRPNIGPRPL

SEQ ID NO: 537848 - protein, 11 aa, Influenza virus
SFRQSERGEDT

SEQ ID NO: 537849 - protein, 11 aa, Influenza virus
SFRQSERGEET

SEQ ID NO: 537850 - protein, 11 aa, Influenza virus
SFRYGDGVWIG

SEQ ID NO: 537851 - protein, 11 aa, Influenza virus
SFSFGGFTFKR

SEQ ID NO: 537852 - protein, 11 aa, Influenza virus
SFSIRGETTGR

SEQ ID NO: 537853 - protein, 11 aa, Influenza virus
SFSIRWETTGR

SEQ ID NO: 537854 - protein, 11 aa, Influenza virus
SFSISCFLLAA

SEQ ID NO: 537855 - protein, 11 aa, Influenza virus
SFSISCFLLIA

SEQ ID NO: 537856 - protein, 11 aa, Influenza virus
SFSISCFLLVA

SEQ ID NO: 537857 - protein, 11 aa, Influenza virus
SFSMSCFVFVA

SEQ ID NO: 537858 - protein, 11 aa, Influenza virus
SFSPSPGARPK

SEQ ID NO: 537859 - protein, 11 aa, Influenza virus
SFSPSPGDRPK

SEQ ID NO: 537860 - protein, 11 aa, Influenza virus
SFSRTELINPN

SEQ ID NO: 537861 - protein, 11 aa, Influenza virus
SFSRTELINPS

SEQ ID NO: 537862 - protein, 11 aa, Influenza virus
SFSRTELIPPS

SEQ ID NO: 537863 - protein, 11 aa, Influenza virus
SFSRTELISPN

SEQ ID NO: 537864 - protein, 11 aa, Influenza virus
SFSRTELISPS

SEQ ID NO: 537865 - protein, 11 aa, Influenza virus
SFTGWILGNPM

SEQ ID NO: 537866 - protein, 11 aa, Influenza virus
SFTITGDNTKW

SEQ ID NO: 537867 - protein, 11 aa, Influenza virus
SFVPVVGARPQ

SEQ ID NO: 537868 - protein, 11 aa, Influenza virus
SFVQHPELTGL

SEQ ID NO: 537869 - protein, 11 aa, Influenza virus
SFVQHPELTGM

SEQ ID NO: 537870 - protein, 11 aa, Influenza virus
SFVQHPELTGV

SEQ ID NO: 537871 - protein, 11 aa, Influenza virus
SFVQHPEMTGL

SEQ ID NO: 537872 - protein, 11 aa, Influenza virus
SFWMCPNGSLQ

SEQ ID NO: 537873 - protein, 11 aa, Influenza virus
SFWMCSGHSCR

SEQ ID NO: 537874 - protein, 11 aa, Influenza virus
SFWMCSNGSLH

SEQ ID NO: 537875 - protein, 11 aa, Influenza virus
SFWMCSNGSLQ

SEQ ID NO: 537876 - protein, 11 aa, Influenza virus
SFWMCSNGSLR

SEQ ID NO: 537877 - protein, 11 aa, Influenza virus
SFWRCSNGSLQ

SEQ ID NO: 537878 - protein, 11 aa, Influenza virus
SFYAELKWLIS

SEQ ID NO: 537879 - protein, 11 aa, Influenza virus
SFYAELKWLVS

SEQ ID NO: 537880 - protein, 11 aa, Influenza virus
SFYAEMEWLLS

SEQ ID NO: 537881 - protein, 11 aa, Influenza virus
SFYAEMKWLLS

SEQ ID NO: 537882 - protein, 11 aa, Influenza virus
SFYRNLIWLVK

SEQ ID NO: 537883 - protein, 11 aa, Influenza virus
SFYRNLIWLVN

SEQ ID NO: 537884 - protein, 11 aa, Influenza virus
SFYRNLIWLVQ

SEQ ID NO: 537885 - protein, 11 aa, Influenza virus
SFYRNLVWIVK

SEQ ID NO: 537886 - protein, 11 aa, Influenza virus
SFYRNLVWLVK

SEQ ID NO: 537887 - protein, 11 aa, Influenza virus
SFYRNMRWLTL

SEQ ID NO: 537888 - protein, 11 aa, Influenza virus
SFYRNVVWLIK

SEQ ID NO: 537889 - protein, 11 aa, Influenza virus
SFYRSINWLTK

SEQ ID NO: 537890 - protein, 11 aa, Influenza virus
SFYRSIRWLTL

SEQ ID NO: 537891 - protein, 11 aa, Influenza virus
SFYRSMKWLTL

SEQ ID NO: 537892 - protein, 11 aa, Influenza virus
SFYRSMRWLTL

SEQ ID NO: 537893 - protein, 11 aa, Influenza virus
SFYSEMKWLLS

SEQ ID NO: 537894 - protein, 11 aa, Influenza virus
SFYSEMKWLSS

SEQ ID NO: 537895 - protein, 11 aa, Influenza virus
SFYWTIVDPGD

SEQ ID NO: 537896 - protein, 11 aa, Influenza virus
SFYWTIVEPED

SEQ ID NO: 537897 - protein, 11 aa, Influenza virus
SFYWTIVEPGD

SEQ ID NO: 537898 - protein, 11 aa, Influenza virus
SFYWTIVEPGN

SEQ ID NO: 537899 - protein, 11 aa, Influenza virus
SGAAGAAIKGV

SEQ ID NO: 537900 - protein, 11 aa, Influenza virus
SGAAGAAVKGI

SEQ ID NO: 537901 - protein, 11 aa, Influenza virus
SGAAGAAVKGV

SEQ ID NO: 537902 - protein, 11 aa, Influenza virus
SGADDDAYAVI

SEQ ID NO: 537903 - protein, 11 aa, Influenza virus
SGADDEAYAVI

SEQ ID NO: 537904 - protein, 11 aa, Influenza virus
SGADNDAYAVI

SEQ ID NO: 537905 - protein, 11 aa, Influenza virus
SGCKMYALHQG

SEQ ID NO: 537906 - protein, 11 aa, Influenza virus
SGDDVWMGRTI

SEQ ID NO: 537907 - protein, 11 aa, Influenza virus
SGDIWITREPY

SEQ ID NO: 537908 - protein, 11 aa, Influenza virus
SGDIWVTREPY

SEQ ID NO: 537909 - protein, 11 aa, Influenza virus
SGDYARLYIWG

SEQ ID NO: 537910 - protein, 11 aa, Influenza virus
SGEVPGWSWDD

SEQ ID NO: 537911 - protein, 11 aa, Influenza virus
SGFAIFSKDNG

SEQ ID NO: 537912 - protein, 11 aa, Influenza virus
SGFAIISKDNG

SEQ ID NO: 537913 - protein, 11 aa, Influenza virus
SGFAIVSKDNG

SEQ ID NO: 537914 - protein, 11 aa, Influenza virus
SGFAVVSKDNG

SEQ ID NO: 537915 - protein, 11 aa, Influenza virus
SGFEIIWDPNG

SEQ ID NO: 537916 - protein, 11 aa, Influenza virus
SGFEILLIEDG

SEQ ID NO: 537917 - protein, 11 aa, Influenza virus
SGFEILLIEEG

SEQ ID NO: 537918 - protein, 11 aa, Influenza virus
SGFEMIWDANG

SEQ ID NO: 537919 - protein, 11 aa, Influenza virus
SGFEMIWDPDG

SEQ ID NO: 537920 - protein, 11 aa, Influenza virus
SGFEMIWDPNG

SEQ ID NO: 537921 - protein, 11 aa, Influenza virus
SGFEMLKIHNA

SEQ ID NO: 537922 - protein, 11 aa, Influenza virus
SGFEMLKIPNA

SEQ ID NO: 537923 - protein, 11 aa, Influenza virus
SGFEMLKVPNA

SEQ ID NO: 537924 - protein, 11 aa, Influenza virus
SGFEMLRIPNA

SEQ ID NO: 537925 - protein, 11 aa, Influenza virus
SGFEMVWDANG

SEQ ID NO: 537926 - protein, 11 aa, Influenza virus
SGFEMVWDDNG

SEQ ID NO: 537927 - protein, 11 aa, Influenza virus
SGFEMVWDPNG

SEQ ID NO: 537928 - protein, 11 aa, Influenza virus
SGFEVLFIEDG

SEQ ID NO: 537929 - protein, 11 aa, Influenza virus
SGFEVLKVPNA

SEQ ID NO: 537930 - protein, 11 aa, Influenza virus
SGFEVLLIEDG

SEQ ID NO: 537931 - protein, 11 aa, Influenza virus
SGFFPDGPQIQ

SEQ ID NO: 537932 - protein, 11 aa, Influenza virus
SGFVIVSKDNG

SEQ ID NO: 537933 - protein, 11 aa, Influenza virus
SGFVRTLFQQM

SEQ ID NO: 537934 - protein, 11 aa, Influenza virus
SGGGDIWVTRE

SEQ ID NO: 537935 - protein, 11 aa, Influenza virus
SGGHIEECSCY

SEQ ID NO: 537936 - protein, 11 aa, Influenza virus
SGGIDKEPMGF

SEQ ID NO: 537937 - protein, 11 aa, Influenza virus
SGGIDKESMGF

SEQ ID NO: 537938 - protein, 11 aa, Influenza virus
SGGLLAPRYGY

SEQ ID NO: 537939 - protein, 11 aa, Influenza virus
SGGTINSPLPF

SEQ ID NO: 537940 - protein, 11 aa, Influenza virus
SGGYKDIILWF

SEQ ID NO: 537941 - protein, 11 aa, Influenza virus
SGGYKDVILWF

SEQ ID NO: 537942 - protein, 11 aa, Influenza virus
SGHWPDGSNIG

SEQ ID NO: 537943 - protein, 11 aa, Influenza virus
SGIAIALGIIN

SEQ ID NO: 537944 - protein, 11 aa, Influenza virus
SGIAIVLGIIN

SEQ ID NO: 537945 - protein, 11 aa, Influenza virus
SGICPVVFTDG

SEQ ID NO: 537946 - protein, 11 aa, Influenza virus
SGIEYNGKSLG

SEQ ID NO: 537947 - protein, 11 aa, Influenza virus
SGIKSFSRTEL

SEQ ID NO: 537948 - protein, 11 aa, Influenza virus
SGIKSFSRTQL

SEQ ID NO: 537949 - protein, 11 aa, Influenza virus
SGIKTDGATSA

SEQ ID NO: 537950 - protein, 11 aa, Influenza virus
SGINESADMSI

SEQ ID NO: 537951 - protein, 11 aa, Influenza virus
SGIPPLELGDC

SEQ ID NO: 537952 - protein, 11 aa, Influenza virus
SGIRSFSRTEL

SEQ ID NO: 537953 - protein, 11 aa, Influenza virus
SGIRTDGATSA

SEQ ID NO: 537954 - protein, 11 aa, Influenza virus
SGKADTRILFI

SEQ ID NO: 537955 - protein, 11 aa, Influenza virus
SGKADTRILFV

SEQ ID NO: 537956 - protein, 11 aa, Influenza virus
SGKNTDLEALM

SEQ ID NO: 537957 - protein, 11 aa, Influenza virus
SGKVECVCRDN

SEQ ID NO: 537958 - protein, 11 aa, Influenza virus
SGLIAGWYGFQ

SEQ ID NO: 537959 - protein, 11 aa, Influenza virus
SGLPVGGNEKK

SEQ ID NO: 537960 - protein, 11 aa, Influenza virus
SGLTHIMIWHS

SEQ ID NO: 537961 - protein, 11 aa, Influenza virus
SGLVAGWYGFQ

SEQ ID NO: 537962 - protein, 11 aa, Influenza virus
SGLVGDTPRND

SEQ ID NO: 537963 - protein, 11 aa, Influenza virus
SGLVGDTPRNE

SEQ ID NO: 537964 - protein, 11 aa, Influenza virus
SGLVGDTPRNG

SEQ ID NO: 537965 - protein, 11 aa, Influenza virus
SGLVGDTPRNN

SEQ ID NO: 537966 - protein, 11 aa, Influenza virus
SGLVGDTPRSD

SEQ ID NO: 537967 - protein, 11 aa, Influenza virus
SGMDPRMCSLM

SEQ ID NO: 537968 - protein, 11 aa, Influenza virus
SGMIDGWYGFH

SEQ ID NO: 537969 - protein, 11 aa, Influenza virus
SGMSANGDILM

SEQ ID NO: 537970 - protein, 11 aa, Influenza virus
SGNAQHVEECS

SEQ ID NO: 537971 - protein, 11 aa, Influenza virus
SGNGDPNNMDR

SEQ ID NO: 537972 - protein, 11 aa, Influenza virus
SGNLIAPEYGH

SEQ ID NO: 537973 - protein, 11 aa, Influenza virus
SGNNQVFPQLN

SEQ ID NO: 537974 - protein, 11 aa, Influenza virus
SGNWPDGANIG

SEQ ID NO: 537975 - protein, 11 aa, Influenza virus
SGNWPDGSNIG

SEQ ID NO: 537976 - protein, 11 aa, Influenza virus
SGPDDGAVAVL

SEQ ID NO: 537977 - protein, 11 aa, Influenza virus
SGPDNEAVAVL

SEQ ID NO: 537978 - protein, 11 aa, Influenza virus
SGPDNGAVAVL

SEQ ID NO: 537979 - protein, 11 aa, Influenza virus
SGPDNGAVAVV

SEQ ID NO: 537980 - protein, 11 aa, Influenza virus
SGPDSGAVAVL

SEQ ID NO: 537981 - protein, 11 aa, Influenza virus
SGPLKAEIAQK

SEQ ID NO: 537982 - protein, 11 aa, Influenza virus
SGPLKAEIAQR

SEQ ID NO: 537983 - protein, 11 aa, Influenza virus
SGPNDNASAVV

SEQ ID NO: 537984 - protein, 11 aa, Influenza virus
SGPNNNASAIV

SEQ ID NO: 537985 - protein, 11 aa, Influenza virus
SGPNNNASAVI

SEQ ID NO: 537986 - protein, 11 aa, Influenza virus
SGPNNNASAVV

SEQ ID NO: 537987 - protein, 11 aa, Influenza virus
SGPNNNASTVI

SEQ ID NO: 537988 - protein, 11 aa, Influenza virus
SGPSFYAEMKW

SEQ ID NO: 537989 - protein, 11 aa, Influenza virus
SGQFPVQTDEY

SEQ ID NO: 537990 - protein, 11 aa, Influenza virus
SGQLKLATGLK

SEQ ID NO: 537991 - protein, 11 aa, Influenza virus
SGQLKLATGLR

SEQ ID NO: 537992 - protein, 11 aa, Influenza virus
SGQNHGICAVA

SEQ ID NO: 537993 - protein, 11 aa, Influenza virus
SGRADTKILFI

SEQ ID NO: 537994 - protein, 11 aa, Influenza virus
SGRADTRILFI

SEQ ID NO: 537995 - protein, 11 aa, Influenza virus
SGREWSYIVER

SEQ ID NO: 537996 - protein, 11 aa, Influenza virus
SGRIDFHWLIL

SEQ ID NO: 537997 - protein, 11 aa, Influenza virus
SGRIDFHWLLL

SEQ ID NO: 537998 - protein, 11 aa, Influenza virus
SGRIDFHWLML

SEQ ID NO: 537999 - protein, 11 aa, Influenza virus
SGRIDFHWLVL

SEQ ID NO: 538000 - protein, 11 aa, Influenza virus
SGRISFYWTIV

SEQ ID NO: 538001 - protein, 11 aa, Influenza virus
SGRISIYWTLV

SEQ ID NO: 538002 - protein, 11 aa, Influenza virus
SGRLIDFLKDV

SEQ ID NO: 538003 - protein, 11 aa, Influenza virus
SGRLMDFLKDV

SEQ ID NO: 538004 - protein, 11 aa, Influenza virus
SGRQEKNPALR

SEQ ID NO: 538005 - protein, 11 aa, Influenza virus
SGRQEKNPSLR

SEQ ID NO: 538006 - protein, 11 aa, Influenza virus
SGRSSFFRNVV

SEQ ID NO: 538007 - protein, 11 aa, Influenza virus
SGRVSFYWTIV

SEQ ID NO: 538008 - protein, 11 aa, Influenza virus
SGSAQHIEECS

SEQ ID NO: 538009 - protein, 11 aa, Influenza virus
SGSAQHVEECS

SEQ ID NO: 538010 - protein, 11 aa, Influenza virus
SGSFIDYWAEG

SEQ ID NO: 538011 - protein, 11 aa, Influenza virus
SGSFIDYWAKE

SEQ ID NO: 538012 - protein, 11 aa, Influenza virus
SGSFIDYWAKG

SEQ ID NO: 538013 - protein, 11 aa, Influenza virus
SGSFIQHPELT

SEQ ID NO: 538014 - protein, 11 aa, Influenza virus
SGSFMDYWAEG

SEQ ID NO: 538015 - protein, 11 aa, Influenza virus
SGSFPDGAKIQ

SEQ ID NO: 538016 - protein, 11 aa, Influenza virus
SGSFPDGAQIK

SEQ ID NO: 538017 - protein, 11 aa, Influenza virus
SGSFPDGAQIQ

SEQ ID NO: 538018 - protein, 11 aa, Influenza virus
SGSFPNGAQIQ

SEQ ID NO: 538019 - protein, 11 aa, Influenza virus
SGSFSIRGETT

SEQ ID NO: 538020 - protein, 11 aa, Influenza virus
SGSFSIRWETT

SEQ ID NO: 538021 - protein, 11 aa, Influenza virus
SGSFVDYWAEG

SEQ ID NO: 538022 - protein, 11 aa, Influenza virus
SGSFVQHPELT

SEQ ID NO: 538023 - protein, 11 aa, Influenza virus
SGSFVQHPEMT

SEQ ID NO: 538024 - protein, 11 aa, Influenza virus
SGSIISFCGVN

SEQ ID NO: 538025 - protein, 11 aa, Influenza virus
SGSINTKLPFQ

SEQ ID NO: 538026 - protein, 11 aa, Influenza virus
SGSLEFIAEQF

SEQ ID NO: 538027 - protein, 11 aa, Influenza virus
SGSLKLAIGLR

SEQ ID NO: 538028 - protein, 11 aa, Influenza virus
SGSLKLAIGPR

SEQ ID NO: 538029 - protein, 11 aa, Influenza virus
SGSQKQEFKMN

SEQ ID NO: 538030 - protein, 11 aa, Influenza virus
SGSSFYAELKW

SEQ ID NO: 538031 - protein, 11 aa, Influenza virus
SGSSFYAEMKW

SEQ ID NO: 538032 - protein, 11 aa, Influenza virus
SGSSIAFCGVD

SEQ ID NO: 538033 - protein, 11 aa, Influenza virus
SGSSIAFCGVN

SEQ ID NO: 538034 - protein, 11 aa, Influenza virus
SGSSISFCGVD

SEQ ID NO: 538035 - protein, 11 aa, Influenza virus
SGSSISFCGVN

SEQ ID NO: 538036 - protein, 11 aa, Influenza virus
SGSSISFCGVS

SEQ ID NO: 538037 - protein, 11 aa, Influenza virus
SGTCAVVMTDG

SEQ ID NO: 538038 - protein, 11 aa, Influenza virus
SGTDNYGVKGF

SEQ ID NO: 538039 - protein, 11 aa, Influenza virus
SGTNNYGVKGF

SEQ ID NO: 538040 - protein, 11 aa, Influenza virus
SGTSKACNALT

SEQ ID NO: 538041 - protein, 11 aa, Influenza virus
SGTSKACNAST

SEQ ID NO: 538042 - protein, 11 aa, Influenza virus
SGTSKACSAST

SEQ ID NO: 538043 - protein, 11 aa, Influenza virus
SGTVKDRSPFR

SEQ ID NO: 538044 - protein, 11 aa, Influenza virus
SGTYGAGSWPD

SEQ ID NO: 538045 - protein, 11 aa, Influenza virus
SGTYGSGSWPD

SEQ ID NO: 538046 - protein, 11 aa, Influenza virus
SGTYGTGSWPD

SEQ ID NO: 538047 - protein, 11 aa, Influenza virus
SGTYGTGTWPD

SEQ ID NO: 538048 - protein, 11 aa, Influenza virus
SGVAIALSILN

SEQ ID NO: 538049 - protein, 11 aa, Influenza virus
SGVAIALSVLN

SEQ ID NO: 538050 - protein, 11 aa, Influenza virus
SGVESAVLRGF

SEQ ID NO: 538051 - protein, 11 aa, Influenza virus
SGVEYNGKSLG

SEQ ID NO: 538052 - protein, 11 aa, Influenza virus
SGVKLEENSTY

SEQ ID NO: 538053 - protein, 11 aa, Influenza virus
SGVNESADMSI

SEQ ID NO: 538054 - protein, 11 aa, Influenza virus
SGVNSFSRTEL

SEQ ID NO: 538055 - protein, 11 aa, Influenza virus
SGWLLGNPMCD

SEQ ID NO: 538056 - protein, 11 aa, Influenza virus
SGWLTLGITGP

SEQ ID NO: 538057 - protein, 11 aa, Influenza virus
SGYAADKASTQ

SEQ ID NO: 538058 - protein, 11 aa, Influenza virus
SGYAADKESSQ

SEQ ID NO: 538059 - protein, 11 aa, Influenza virus
SGYAADKESTQ

SEQ ID NO: 538060 - protein, 11 aa, Influenza virus
SGYAADKKSTQ

SEQ ID NO: 538061 - protein, 11 aa, Influenza virus
SGYAADLKSTQ

SEQ ID NO: 538062 - protein, 11 aa, Influenza virus
SGYAADQESTQ

SEQ ID NO: 538063 - protein, 11 aa, Influenza virus
SGYAADQKSTQ

SEQ ID NO: 538064 - protein, 11 aa, Influenza virus
SGYAADRESTQ

SEQ ID NO: 538065 - protein, 11 aa, Influenza virus
SGYAADRKSTQ

SEQ ID NO: 538066 - protein, 11 aa, Influenza virus
SGYAANKESTQ

SEQ ID NO: 538067 - protein, 11 aa, Influenza virus
SGYAQTDCVLE

SEQ ID NO: 538068 - protein, 11 aa, Influenza virus
SGYEILKVPNA

SEQ ID NO: 538069 - protein, 11 aa, Influenza virus
SGYEMLKVPDA

SEQ ID NO: 538070 - protein, 11 aa, Influenza virus
SGYEMLKVPNA

SEQ ID NO: 538071 - protein, 11 aa, Influenza virus
SGYETFKVIGG

SEQ ID NO: 538072 - protein, 11 aa, Influenza virus
SGYETFRVIDG

SEQ ID NO: 538073 - protein, 11 aa, Influenza virus
SGYETFRVIGG

SEQ ID NO: 538074 - protein, 11 aa, Influenza virus
SGYETFRVISG

SEQ ID NO: 538075 - protein, 11 aa, Influenza virus
SGYEVLKVPDA

SEQ ID NO: 538076 - protein, 11 aa, Influenza virus
SGYEVLKVPNA

SEQ ID NO: 538077 - protein, 11 aa, Influenza virus
SGYGEDNESTQ

SEQ ID NO: 538078 - protein, 11 aa, Influenza virus
SGYKDIILWFS

SEQ ID NO: 538079 - protein, 11 aa, Influenza virus
SGYKDVILWFS

SEQ ID NO: 538080 - protein, 11 aa, Influenza virus
SGYKEIILWFS

SEQ ID NO: 538081 - protein, 11 aa, Influenza virus
SGYKEVILWFS

SEQ ID NO: 538082 - protein, 11 aa, Influenza virus
SGYSGAFIDYW

SEQ ID NO: 538083 - protein, 11 aa, Influenza virus
SGYSGAFMDYW

SEQ ID NO: 538084 - protein, 11 aa, Influenza virus
SGYSGAFTIPI

SEQ ID NO: 538085 - protein, 11 aa, Influenza virus
SGYSGAFTIPT

SEQ ID NO: 538086 - protein, 11 aa, Influenza virus
SGYSGAFTIPV

SEQ ID NO: 538087 - protein, 11 aa, Influenza virus
SGYSGAFTVPI

SEQ ID NO: 538088 - protein, 11 aa, Influenza virus
SGYSGAFVDYW

SEQ ID NO: 538089 - protein, 11 aa, Influenza virus
SGYSGIFSVEG

SEQ ID NO: 538090 - protein, 11 aa, Influenza virus
SGYSGIFSVEH

SEQ ID NO: 538091 - protein, 11 aa, Influenza virus
SGYSGIFSVEN

SEQ ID NO: 538092 - protein, 11 aa, Influenza virus
SGYSGIFSVES

SEQ ID NO: 538093 - protein, 11 aa, Influenza virus
SGYSGSFIDYW

SEQ ID NO: 538094 - protein, 11 aa, Influenza virus
SGYSGSFIQHP

SEQ ID NO: 538095 - protein, 11 aa, Influenza virus
SGYSGSFMDYW

SEQ ID NO: 538096 - protein, 11 aa, Influenza virus
SGYSGSFSIRG

SEQ ID NO: 538097 - protein, 11 aa, Influenza virus
SGYSGSFSIRW

SEQ ID NO: 538098 - protein, 11 aa, Influenza virus
SGYSGSFTIPT

SEQ ID NO: 538099 - protein, 11 aa, Influenza virus
SGYSGSFTLPI

SEQ ID NO: 538100 - protein, 11 aa, Influenza virus
SGYSGSFTLPV

SEQ ID NO: 538101 - protein, 11 aa, Influenza virus
SGYSGSFVDYW

SEQ ID NO: 538102 - protein, 11 aa, Influenza virus
SGYSGSFVQHP

SEQ ID NO: 538103 - protein, 11 aa, Influenza virus
SGYSGVFSVEG

SEQ ID NO: 538104 - protein, 11 aa, Influenza virus
SGYVCSGLVGD

SEQ ID NO: 538105 - protein, 11 aa, Influenza virus
SGYWAIRTRSG

SEQ ID NO: 538106 - protein, 11 aa, Influenza virus
SHCRATEYIIK

SEQ ID NO: 538107 - protein, 11 aa, Influenza virus
SHCRATEYIMK

SEQ ID NO: 538108 - protein, 11 aa, Influenza virus
SHCRATEYMMK

SEQ ID NO: 538109 - protein, 11 aa, Influenza virus
SHCRIIQNEDI

SEQ ID NO: 538110 - protein, 11 aa, Influenza virus
SHEGEGIPLCD

SEQ ID NO: 538111 - protein, 11 aa, Influenza virus
SHEGEGIPLHD

SEQ ID NO: 538112 - protein, 11 aa, Influenza virus
SHEGEGIPLYD

SEQ ID NO: 538113 - protein, 11 aa, Influenza virus
SHGKIIQNEDI

SEQ ID NO: 538114 - protein, 11 aa, Influenza virus
SHGRIIQNEDI

SEQ ID NO: 538115 - protein, 11 aa, Influenza virus
SHGRILKNDLP

SEQ ID NO: 538116 - protein, 11 aa, Influenza virus
SHGRILKNNLP

SEQ ID NO: 538117 - protein, 11 aa, Influenza virus
SHGRTIQNEDI

SEQ ID NO: 538118 - protein, 11 aa, Influenza virus
SHGRVLKNNLP

SEQ ID NO: 538119 - protein, 11 aa, Influenza virus
SHGTGTGYTMD

SEQ ID NO: 538120 - protein, 11 aa, Influenza virus
SHISPLSGSAQ

SEQ ID NO: 538121 - protein, 11 aa, Influenza virus
SHKICIGYHAN

SEQ ID NO: 538122 - protein, 11 aa, Influenza virus
SHLECRTFFLA

SEQ ID NO: 538123 - protein, 11 aa, Influenza virus
SHLECRTFFLT

SEQ ID NO: 538124 - protein, 11 aa, Influenza virus
SHLKFKADLII

SEQ ID NO: 538125 - protein, 11 aa, Influenza virus
SHLRNDTDVVN

SEQ ID NO: 538126 - protein, 11 aa, Influenza virus
SHMECRTFFLT

SEQ ID NO: 538127 - protein, 11 aa, Influenza virus
SHNGGLIAPDR

SEQ ID NO: 538128 - protein, 11 aa, Influenza virus
SHNGGLIAPSR

SEQ ID NO: 538129 - protein, 11 aa, Influenza virus
SHNGGLVAPSR

SEQ ID NO: 538130 - protein, 11 aa, Influenza virus
SHPGIFENSCI

SEQ ID NO: 538131 - protein, 11 aa, Influenza virus
SHPGIFENSCL

SEQ ID NO: 538132 - protein, 11 aa, Influenza virus
SHPGIFESSCL

SEQ ID NO: 538133 - protein, 11 aa, Influenza virus
SHPGIFGNSCL

SEQ ID NO: 538134 - protein, 11 aa, Influenza virus
SHPGLFENSCL

SEQ ID NO: 538135 - protein, 11 aa, Influenza virus
SHRTLLMNELG

SEQ ID NO: 538136 - protein, 11 aa, Influenza virus
SHSECRTFFLT

SEQ ID NO: 538137 - protein, 11 aa, Influenza virus
SHTAYSQITNG

SEQ ID NO: 538138 - protein, 11 aa, Influenza virus
SHYVCSGLVGD

SEQ ID NO: 538139 - protein, 11 aa, Influenza virus
SIAASYKRIRL

SEQ ID NO: 538140 - protein, 11 aa, Influenza virus
SIADKICIGYL

SEQ ID NO: 538141 - protein, 11 aa, Influenza virus
SIAFCGVDSDT

SEQ ID NO: 538142 - protein, 11 aa, Influenza virus
SIAFCGVNFDL

SEQ ID NO: 538143 - protein, 11 aa, Influenza virus
SIAFCGVNSDT

SEQ ID NO: 538144 - protein, 11 aa, Influenza virus
SIAGWLLGNPE

SEQ ID NO: 538145 - protein, 11 aa, Influenza virus
SIAGWLLGNPK

SEQ ID NO: 538146 - protein, 11 aa, Influenza virus
SIAGWLLGNPM

SEQ ID NO: 538147 - protein, 11 aa, Influenza virus
SIAHKSCLPAC

SEQ ID NO: 538148 - protein, 11 aa, Influenza virus
SIAPIMFSNKM

SEQ ID NO: 538149 - protein, 11 aa, Influenza virus
SIAPIMFSNKV

SEQ ID NO: 538150 - protein, 11 aa, Influenza virus
SIASRSGYEIL

SEQ ID NO: 538151 - protein, 11 aa, Influenza virus
SIASRSGYEML

SEQ ID NO: 538152 - protein, 11 aa, Influenza virus
SIAVFCGTSGT

SEQ ID NO: 538153 - protein, 11 aa, Influenza virus
SICEKLEQSGL

SEQ ID NO: 538154 - protein, 11 aa, Influenza virus
SICISGPNNNA

SEQ ID NO: 538155 - protein, 11 aa, Influenza virus
SICMSGPNDNA

SEQ ID NO: 538156 - protein, 11 aa, Influenza virus
SICMSGPNNNA

SEQ ID NO: 538157 - protein, 11 aa, Influenza virus
SICSCIASSLV

SEQ ID NO: 538158 - protein, 11 aa, Influenza virus
SICTHLEVCFM

SEQ ID NO: 538159 - protein, 11 aa, Influenza virus
SICVSGPNNNA

SEQ ID NO: 538160 - protein, 11 aa, Influenza virus
SIDECRTFFLT

SEQ ID NO: 538161 - protein, 11 aa, Influenza virus
SIDGKAPISLG

SEQ ID NO: 538162 - protein, 11 aa, Influenza virus
SIDLVETNHTG

SEQ ID NO: 538163 - protein, 11 aa, Influenza virus
SIDPKGLFGAI

SEQ ID NO: 538164 - protein, 11 aa, Influenza virus
SIDRFLRVKDQ

SEQ ID NO: 538165 - protein, 11 aa, Influenza virus
SIDRFLRVRDQ

SEQ ID NO: 538166 - protein, 11 aa, Influenza virus
SIDSGYVCSGL

SEQ ID NO: 538167 - protein, 11 aa, Influenza virus
SIDSNYVCSGL

SEQ ID NO: 538168 - protein, 11 aa, Influenza virus
SIDSSYICSGL

SEQ ID NO: 538169 - protein, 11 aa, Influenza virus
SIDSSYVCSGL

SEQ ID NO: 538170 - protein, 11 aa, Influenza virus
SIEDPDHEGEG

SEQ ID NO: 538171 - protein, 11 aa, Influenza virus
SIEDPNHEGEG

SEQ ID NO: 538172 - protein, 11 aa, Influenza virus
SIEDPSHEGEG

SEQ ID NO: 538173 - protein, 11 aa, Influenza virus
SIEECLINDPW

SEQ ID NO: 538174 - protein, 11 aa, Influenza virus
SIEEPSHEGEG

SEQ ID NO: 538175 - protein, 11 aa, Influenza virus
SIENLEELRFV

SEQ ID NO: 538176 - protein, 11 aa, Influenza virus
SIENPSHEGEG

SEQ ID NO: 538177 - protein, 11 aa, Influenza virus
SIENQEELKSL

SEQ ID NO: 538178 - protein, 11 aa, Influenza virus
SIENQEELRFL

SEQ ID NO: 538179 - protein, 11 aa, Influenza virus
SIENQEELRSL

SEQ ID NO: 538180 - protein, 11 aa, Influenza virus
SIEPKGLFGAI

SEQ ID NO: 538181 - protein, 11 aa, Influenza virus
SIEPRGLFGAI

SEQ ID NO: 538182 - protein, 11 aa, Influenza virus
SIESEFNEIEH

SEQ ID NO: 538183 - protein, 11 aa, Influenza virus
SIESEFNEIEY

SEQ ID NO: 538184 - protein, 11 aa, Influenza virus
SIESEFSEIEH

SEQ ID NO: 538185 - protein, 11 aa, Influenza virus
SIESEFSETEH

SEQ ID NO: 538186 - protein, 11 aa, Influenza virus
SIGITVIKNNM

SEQ ID NO: 538187 - protein, 11 aa, Influenza virus
SIGKVCRALLA

SEQ ID NO: 538188 - protein, 11 aa, Influenza virus
SIGKVCRTLLA

SEQ ID NO: 538189 - protein, 11 aa, Influenza virus
SIGNLIAPRGH

SEQ ID NO: 538190 - protein, 11 aa, Influenza virus
SIGSSTYQNNF

SEQ ID NO: 538191 - protein, 11 aa, Influenza virus
SIGSWSHNILR

SEQ ID NO: 538192 - protein, 11 aa, Influenza virus
SIGSWSQNILR

SEQ ID NO: 538193 - protein, 11 aa, Influenza virus
SIGTSTLNQRL

SEQ ID NO: 538194 - protein, 11 aa, Influenza virus
SIGVAVIKNNM

SEQ ID NO: 538195 - protein, 11 aa, Influenza virus
SIGVTVIKNNM

SEQ ID NO: 538196 - protein, 11 aa, Influenza virus
SIGVTVIRNNM

SEQ ID NO: 538197 - protein, 11 aa, Influenza virus
SIHECRTFFLT

SEQ ID NO: 538198 - protein, 11 aa, Influenza virus
SIHSRGLFGAI

SEQ ID NO: 538199 - protein, 11 aa, Influenza virus
SIHWTIVKPGD

SEQ ID NO: 538200 - protein, 11 aa, Influenza virus
SIIALLIGIGN

SEQ ID NO: 538201 - protein, 11 aa, Influenza virus
SIIDKMNTQFE

SEQ ID NO: 538202 - protein, 11 aa, Influenza virus
SIIDKMNTRFE

SEQ ID NO: 538203 - protein, 11 aa, Influenza virus
SIIEKMNIQFT

SEQ ID NO: 538204 - protein, 11 aa, Influenza virus
SIIEKMNTQFT

SEQ ID NO: 538205 - protein, 11 aa, Influenza virus
SIIFNMERIKE

SEQ ID NO: 538206 - protein, 11 aa, Influenza virus
SIIFNSIGNLI

SEQ ID NO: 538207 - protein, 11 aa, Influenza virus
SIIGKMNTQFE

SEQ ID NO: 538208 - protein, 11 aa, Influenza virus
SIINKMNTQFE

SEQ ID NO: 538209 - protein, 11 aa, Influenza virus
SIIPSGPLKAE

SEQ ID NO: 538210 - protein, 11 aa, Influenza virus
SIISMCSSTEF

SEQ ID NO: 538211 - protein, 11 aa, Influenza virus
SIITELPFQNL

SEQ ID NO: 538212 - protein, 11 aa, Influenza virus
SIIVFCGTSGT

SEQ ID NO: 538213 - protein, 11 aa, Influenza virus
SIKKYERVKMF

SEQ ID NO: 538214 - protein, 11 aa, Influenza virus
SIKNGTYDYPK

SEQ ID NO: 538215 - protein, 11 aa, Influenza virus
SIKNQEELRSL

SEQ ID NO: 538216 - protein, 11 aa, Influenza virus
SIKRYERVKMF

SEQ ID NO: 538217 - protein, 11 aa, Influenza virus
SIKSWRKDILR

SEQ ID NO: 538218 - protein, 11 aa, Influenza virus
SIKSWRRDILR

SEQ ID NO: 538219 - protein, 11 aa, Influenza virus
SIKTKLPFQNL

SEQ ID NO: 538220 - protein, 11 aa, Influenza virus
SILANNGKFEF

SEQ ID NO: 538221 - protein, 11 aa, Influenza virus
SILANNGRFEF

SEQ ID NO: 538222 - protein, 11 aa, Influenza virus
SILASSGSLEF

SEQ ID NO: 538223 - protein, 11 aa, Influenza virus
SILHKCNDSCM

SEQ ID NO: 538224 - protein, 11 aa, Influenza virus
SILLATGMRNV

SEQ ID NO: 538225 - protein, 11 aa, Influenza virus
SILNLLIGISN

SEQ ID NO: 538226 - protein, 11 aa, Influenza virus
SILNTSQRGIL

SEQ ID NO: 538227 - protein, 11 aa, Influenza virus
SILNTSQRGVL

SEQ ID NO: 538228 - protein, 11 aa, Influenza virus
SILTDSQTATK

SEQ ID NO: 538229 - protein, 11 aa, Influenza virus
SINECRTFFLT

SEQ ID NO: 538230 - protein, 11 aa, Influenza virus
SINGKAPISLG

SEQ ID NO: 538231 - protein, 11 aa, Influenza virus
SINGKEPISLG

SEQ ID NO: 538232 - protein, 11 aa, Influenza virus
SINGKQPISLG

SEQ ID NO: 538233 - protein, 11 aa, Influenza virus
SINPVKLSSGY

SEQ ID NO: 538234 - protein, 11 aa, Influenza virus
SINTKLPFQNL

SEQ ID NO: 538235 - protein, 11 aa, Influenza virus
SINTRLPFQNL

SEQ ID NO: 538236 - protein, 11 aa, Influenza virus
SINWLTKKEPD

SEQ ID NO: 538237 - protein, 11 aa, Influenza virus
SINWLTKKKNP

SEQ ID NO: 538238 - protein, 11 aa, Influenza virus
SINWLTKKKPD

SEQ ID NO: 538239 - protein, 11 aa, Influenza virus
SIQPTFSVQRN

SEQ ID NO: 538240 - protein, 11 aa, Influenza virus
SIQSDKPFQNV

SEQ ID NO: 538241 - protein, 11 aa, Influenza virus
SIQSKGLFGAI

SEQ ID NO: 538242 - protein, 11 aa, Influenza virus
SIQSRGLFGAI

SEQ ID NO: 538243 - protein, 11 aa, Influenza virus
SIQTRGLFGAI

SEQ ID NO: 538244 - protein, 11 aa, Influenza virus
SIRGEFNQVEK

SEQ ID NO: 538245 - protein, 11 aa, Influenza virus
SIRGEFNQVEN

SEQ ID NO: 538246 - protein, 11 aa, Influenza virus
SIRGEFNQVEQ

SEQ ID NO: 538247 - protein, 11 aa, Influenza virus
SIRGEFSQVEQ

SEQ ID NO: 538248 - protein, 11 aa, Influenza virus
SIRGEFSQVER

SEQ ID NO: 538249 - protein, 11 aa, Influenza virus
SIRGETTGRNC

SEQ ID NO: 538250 - protein, 11 aa, Influenza virus
SIRIGSKGDIF

SEQ ID NO: 538251 - protein, 11 aa, Influenza virus
SIRIGSKGDVF

SEQ ID NO: 538252 - protein, 11 aa, Influenza virus
SIRIGSRGDVF

SEQ ID NO: 538253 - protein, 11 aa, Influenza virus
SIRLAAGGAIW

SEQ ID NO: 538254 - protein, 11 aa, Influenza virus
SIRLAAGGDIW

SEQ ID NO: 538255 - protein, 11 aa, Influenza virus
SIRLSADGDIW

SEQ ID NO: 538256 - protein, 11 aa, Influenza virus
SIRLSAGGAIW

SEQ ID NO: 538257 - protein, 11 aa, Influenza virus
SIRLSAGGDIW

SEQ ID NO: 538258 - protein, 11 aa, Influenza virus
SIRLSAGGHIW

SEQ ID NO: 538259 - protein, 11 aa, Influenza virus
SIRLSAGGNIW

SEQ ID NO: 538260 - protein, 11 aa, Influenza virus
SIRLSASGDIW

SEQ ID NO: 538261 - protein, 11 aa, Influenza virus
SIRNGTYDHNI

SEQ ID NO: 538262 - protein, 11 aa, Influenza virus
SIRNNTYDHAQ

SEQ ID NO: 538263 - protein, 11 aa, Influenza virus
SIRNNTYDHSK

SEQ ID NO: 538264 - protein, 11 aa, Influenza virus
SIRNNTYDHSQ

SEQ ID NO: 538265 - protein, 11 aa, Influenza virus
SIRNNTYDHSR

SEQ ID NO: 538266 - protein, 11 aa, Influenza virus
SIRNNTYDHTK

SEQ ID NO: 538267 - protein, 11 aa, Influenza virus
SIRNNTYDHTQ

SEQ ID NO: 538268 - protein, 11 aa, Influenza virus
SIRNNTYNHTE

SEQ ID NO: 538269 - protein, 11 aa, Influenza virus
SIRNNTYNHTQ

SEQ ID NO: 538270 - protein, 11 aa, Influenza virus
SIRVSAGGDIW

SEQ ID NO: 538271 - protein, 11 aa, Influenza virus
SIRWETTGRNC

SEQ ID NO: 538272 - protein, 11 aa, Influenza virus
SISCFLLAALL

SEQ ID NO: 538273 - protein, 11 aa, Influenza virus
SISCFLLIALL

SEQ ID NO: 538274 - protein, 11 aa, Influenza virus
SISCFLLVALF

SEQ ID NO: 538275 - protein, 11 aa, Influenza virus
SISCFLLVALL

SEQ ID NO: 538276 - protein, 11 aa, Influenza virus
SISCLYKLSQF

SEQ ID NO: 538277 - protein, 11 aa, Influenza virus
SISECRTFFLT

SEQ ID NO: 538278 - protein, 11 aa, Influenza virus
SISIGSSTYQN

SEQ ID NO: 538279 - protein, 11 aa, Influenza virus
SISSWSQNILR

SEQ ID NO: 538280 - protein, 11 aa, Influenza virus
SISVESSTYQN

SEQ ID NO: 538281 - protein, 11 aa, Influenza virus
SISVGSSTYHN

SEQ ID NO: 538282 - protein, 11 aa, Influenza virus
SISVGSSTYQN

SEQ ID NO: 538283 - protein, 11 aa, Influenza virus
SISVGSSTYQS

SEQ ID NO: 538284 - protein, 11 aa, Influenza virus
SITDIWTYQAE

SEQ ID NO: 538285 - protein, 11 aa, Influenza virus
SITELWSYNAE

SEQ ID NO: 538286 - protein, 11 aa, Influenza virus
SITEVWSYNAE

SEQ ID NO: 538287 - protein, 11 aa, Influenza virus
SITQTLVSNDD

SEQ ID NO: 538288 - protein, 11 aa, Influenza virus
SITQTLVSNND

SEQ ID NO: 538289 - protein, 11 aa, Influenza virus
SITQTLVSNSD

SEQ ID NO: 538290 - protein, 11 aa, Influenza virus
SITYIWTYQAE

SEQ ID NO: 538291 - protein, 11 aa, Influenza virus
SIVAFCGTSGT

SEQ ID NO: 538292 - protein, 11 aa, Influenza virus
SIVALCGSKEQ

SEQ ID NO: 538293 - protein, 11 aa, Influenza virus
SIVALCGSKER

SEQ ID NO: 538294 - protein, 11 aa, Influenza virus
SIVALCGSKKR

SEQ ID NO: 538295 - protein, 11 aa, Influenza virus
SIVALCGSRER

SEQ ID NO: 538296 - protein, 11 aa, Influenza virus
SIVASSGTLEF

SEQ ID NO: 538297 - protein, 11 aa, Influenza virus
SIVEFCGTSGT

SEQ ID NO: 538298 - protein, 11 aa, Influenza virus
SIVLVGLILAF

SEQ ID NO: 538299 - protein, 11 aa, Influenza virus
SIVMVGLILAF

SEQ ID NO: 538300 - protein, 11 aa, Influenza virus
SIVPNIGSRPR

SEQ ID NO: 538301 - protein, 11 aa, Influenza virus
SIVPSGPLKAE

SEQ ID NO: 538302 - protein, 11 aa, Influenza virus
SIVRRATVSAD

SEQ ID NO: 538303 - protein, 11 aa, Influenza virus
SIVSMCSSTEF

SEQ ID NO: 538304 - protein, 11 aa, Influenza virus
SIVSWSQNILR

SEQ ID NO: 538305 - protein, 11 aa, Influenza virus
SIVTFCGLBNE

SEQ ID NO: 538306 - protein, 11 aa, Influenza virus
SIVTFCGLDNE

SEQ ID NO: 538307 - protein, 11 aa, Influenza virus
SIVTFCGLNNE

SEQ ID NO: 538308 - protein, 11 aa, Influenza virus
SIVVFCGTPGT

SEQ ID NO: 538309 - protein, 11 aa, Influenza virus
SIVVFCGTSGI

SEQ ID NO: 538310 - protein, 11 aa, Influenza virus
SIVVFCGTSGT

SEQ ID NO: 538311 - protein, 11 aa, Influenza virus
SIVVFCGTSRT

SEQ ID NO: 538312 - protein, 11 aa, Influenza virus
SIVVFWGTSGT

SEQ ID NO: 538313 - protein, 11 aa, Influenza virus
SIWFSHYNQIT

SEQ ID NO: 538314 - protein, 11 aa, Influenza virus
SIWFSHYNQMK

SEQ ID NO: 538315 - protein, 11 aa, Influenza virus
SIWFSHYNQMT

SEQ ID NO: 538316 - protein, 11 aa, Influenza virus
SIWFSHYNQVT

SEQ ID NO: 538317 - protein, 11 aa, Influenza virus
SIWMCSNGSLQ

SEQ ID NO: 538318 - protein, 11 aa, Influenza virus
SIWTSSSSTVF

SEQ ID NO: 538319 - protein, 11 aa, Influenza virus
SIYASPQLEGF

SEQ ID NO: 538320 - protein, 11 aa, Influenza virus
SIYIEVLHLTQ

SEQ ID NO: 538321 - protein, 11 aa, Influenza virus
SIYQNSFVPVV

SEQ ID NO: 538322 - protein, 11 aa, Influenza virus
SIYSCIASSIV

SEQ ID NO: 538323 - protein, 11 aa, Influenza virus
SIYSCIASSLI

SEQ ID NO: 538324 - protein, 11 aa, Influenza virus
SIYSCIASSLV

SEQ ID NO: 538325 - protein, 11 aa, Influenza virus
SIYSCIASSTV

SEQ ID NO: 538326 - protein, 11 aa, Influenza virus
SIYSCIASSVV

SEQ ID NO: 538327 - protein, 11 aa, Influenza virus
SIYSSVASSLV

SEQ ID NO: 538328 - protein, 11 aa, Influenza virus
SIYSTVAASLC

SEQ ID NO: 538329 - protein, 11 aa, Influenza virus
SIYWTIVKPGD

SEQ ID NO: 538330 - protein, 11 aa, Influenza virus
SIYWTLVNPGD

SEQ ID NO: 538331 - protein, 11 aa, Influenza virus
SIYWTVVKPGD

SEQ ID NO: 538332 - protein, 11 aa, Influenza virus
SKACNALTGGQ

SEQ ID NO: 538333 - protein, 11 aa, Influenza virus
SKACNASTGAQ

SEQ ID NO: 538334 - protein, 11 aa, Influenza virus
SKACNASTGGQ

SEQ ID NO: 538335 - protein, 11 aa, Influenza virus
SKACSASTGGQ

SEQ ID NO: 538336 - protein, 11 aa, Influenza virus
SKADKICIGYL

SEQ ID NO: 538337 - protein, 11 aa, Influenza virus
SKANQVFPQLN

SEQ ID NO: 538338 - protein, 11 aa, Influenza virus
SKCFWKGGSIK

SEQ ID NO: 538339 - protein, 11 aa, Influenza virus
SKCFWKGGSIN

SEQ ID NO: 538340 - protein, 11 aa, Influenza virus
SKCFWKSGSIN

SEQ ID NO: 538341 - protein, 11 aa, Influenza virus
SKCFWRGGSII

SEQ ID NO: 538342 - protein, 11 aa, Influenza virus
SKCFWRGGSIN

SEQ ID NO: 538343 - protein, 11 aa, Influenza virus
SKCKTKEGRRK

SEQ ID NO: 538344 - protein, 11 aa, Influenza virus
SKCQQSFTPSP

SEQ ID NO: 538345 - protein, 11 aa, Influenza virus
SKCRTKEGRRK

SEQ ID NO: 538346 - protein, 11 aa, Influenza virus
SKCRTKEGRRR

SEQ ID NO: 538347 - protein, 11 aa, Influenza virus
SKCRTREGRRK

SEQ ID NO: 538348 - protein, 11 aa, Influenza virus
SKCYNPCFYVE

SEQ ID NO: 538349 - protein, 11 aa, Influenza virus
SKCYQFALGQG

SEQ ID NO: 538350 - protein, 11 aa, Influenza virus
SKDNAIRIGED

SEQ ID NO: 538351 - protein, 11 aa, Influenza virus
SKDNAIRIGEE

SEQ ID NO: 538352 - protein, 11 aa, Influenza virus
SKDNAIRIGEG

SEQ ID NO: 538353 - protein, 11 aa, Influenza virus
SKDNAIRIGEN

SEQ ID NO: 538354 - protein, 11 aa, Influenza virus
SKDNAVRIGED

SEQ ID NO: 538355 - protein, 11 aa, Influenza virus
SKDNGIRIGSK

SEQ ID NO: 538356 - protein, 11 aa, Influenza virus
SKDNGIRIGSR

SEQ ID NO: 538357 - protein, 11 aa, Influenza virus
SKDNGIRVGSR

SEQ ID NO: 538358 - protein, 11 aa, Influenza virus
SKDNGVRIGSK

SEQ ID NO: 538359 - protein, 11 aa, Influenza virus
SKDNNIRIGSK

SEQ ID NO: 538360 - protein, 11 aa, Influenza virus
SKDNQVFPQLN

SEQ ID NO: 538361 - protein, 11 aa, Influenza virus
SKDNSIQLSAG

SEQ ID NO: 538362 - protein, 11 aa, Influenza virus
SKDNSIRIGSK

SEQ ID NO: 538363 - protein, 11 aa, Influenza virus
SKDNSIRIGSR

SEQ ID NO: 538364 - protein, 11 aa, Influenza virus
SKDNSIRLAAG

SEQ ID NO: 538365 - protein, 11 aa, Influenza virus
SKDNSIRLSAD

SEQ ID NO: 538366 - protein, 11 aa, Influenza virus
SKDNSIRLSAG

SEQ ID NO: 538367 - protein, 11 aa, Influenza virus
SKDNSIRLSAS

SEQ ID NO: 538368 - protein, 11 aa, Influenza virus
SKDNSVRIGSK

SEQ ID NO: 538369 - protein, 11 aa, Influenza virus
SKDNSVRLSAG

SEQ ID NO: 538370 - protein, 11 aa, Influenza virus
SKDNSVRLSAS

SEQ ID NO: 538371 - protein, 11 aa, Influenza virus
SKDSRSGYETF

SEQ ID NO: 538372 - protein, 11 aa, Influenza virus
SKEAQDVIMEV

SEQ ID NO: 538373 - protein, 11 aa, Influenza virus
SKEGSYFFGDN

SEQ ID NO: 538374 - protein, 11 aa, Influenza virus
SKEQGSGYAAD

SEQ ID NO: 538375 - protein, 11 aa, Influenza virus
SKEQLGSWSWH

SEQ ID NO: 538376 - protein, 11 aa, Influenza virus
SKERLGSWSWH

SEQ ID NO: 538377 - protein, 11 aa, Influenza virus
SKFESVAWSAS

SEQ ID NO: 538378 - protein, 11 aa, Influenza virus
SKFHSDTPRPA

SEQ ID NO: 538379 - protein, 11 aa, Influenza virus
SKFHSDTPRPD

SEQ ID NO: 538380 - protein, 11 aa, Influenza virus
SKFHSDTPRPT

SEQ ID NO: 538381 - protein, 11 aa, Influenza virus
SKFHSDTPRPV

SEQ ID NO: 538382 - protein, 11 aa, Influenza virus
SKFLLMDALKL

SEQ ID NO: 538383 - protein, 11 aa, Influenza virus
SKFLLMDSLKL

SEQ ID NO: 538384 - protein, 11 aa, Influenza virus
SKGDIFVIREP

SEQ ID NO: 538385 - protein, 11 aa, Influenza virus
SKGDIFVMREP

SEQ ID NO: 538386 - protein, 11 aa, Influenza virus
SKGDVFVIREP

SEQ ID NO: 538387 - protein, 11 aa, Influenza virus
SKGDVFVMREP

SEQ ID NO: 538388 - protein, 11 aa, Influenza virus
SKGHVFVIREP

SEQ ID NO: 538389 - protein, 11 aa, Influenza virus
SKGLFGAIAGF

SEQ ID NO: 538390 - protein, 11 aa, Influenza virus
SKGSSKQQHKE

SEQ ID NO: 538391 - protein, 11 aa, Influenza virus
SKHYIGKCPKY

SEQ ID NO: 538392 - protein, 11 aa, Influenza virus
SKHYIGKCPRY

SEQ ID NO: 538393 - protein, 11 aa, Influenza virus
SKIKMKWGMEL

SEQ ID NO: 538394 - protein, 11 aa, Influenza virus
SKIKMKWGMEM

SEQ ID NO: 538395 - protein, 11 aa, Influenza virus
SKINEVKLEEN

SEQ ID NO: 538396 - protein, 11 aa, Influenza virus
SKINGVILEEN

SEQ ID NO: 538397 - protein, 11 aa, Influenza virus
SKINGVKLEEN

SEQ ID NO: 538398 - protein, 11 aa, Influenza virus
SKINGVRLEEN

SEQ ID NO: 538399 - protein, 11 aa, Influenza virus
SKITLKFAFNM

SEQ ID NO: 538400 - protein, 11 aa, Influenza virus
SKKKSYINKTG

SEQ ID NO: 538401 - protein, 11 aa, Influenza virus
SKKKSYINRTG

SEQ ID NO: 538402 - protein, 11 aa, Influenza virus
SKKRLGSWSWH

SEQ ID NO: 538403 - protein, 11 aa, Influenza virus
SKLKRNEIKGV

SEQ ID NO: 538404 - protein, 11 aa, Influenza virus
SKLKRQEIDGI

SEQ ID NO: 538405 - protein, 11 aa, Influenza virus
SKLKRQEIEGI

SEQ ID NO: 538406 - protein, 11 aa, Influenza virus
SKLKRQEINGI

SEQ ID NO: 538407 - protein, 11 aa, Influenza virus
SKLNRNEIKGV

SEQ ID NO: 538408 - protein, 11 aa, Influenza virus
SKNILRTQESE

SEQ ID NO: 538409 - protein, 11 aa, Influenza virus
SKNPYTLVSTK

SEQ ID NO: 538410 - protein, 11 aa, Influenza virus
SKNSRSGYETF

SEQ ID NO: 538411 - protein, 11 aa, Influenza virus
SKPFQNICKPY

SEQ ID NO: 538412 - protein, 11 aa, Influenza virus
SKPFQNTSKHY

SEQ ID NO: 538413 - protein, 11 aa, Influenza virus
SKPFQNTSRHY

SEQ ID NO: 538414 - protein, 11 aa, Influenza virus
SKPLQNTSKHY

SEQ ID NO: 538415 - protein, 11 aa, Influenza virus
SKPQCKITGFA

SEQ ID NO: 538416 - protein, 11 aa, Influenza virus
SKPQCQIAGFA

SEQ ID NO: 538417 - protein, 11 aa, Influenza virus
SKPQCQITGFA

SEQ ID NO: 538418 - protein, 11 aa, Influenza virus
SKRGGSGIMKT

SEQ ID NO: 538419 - protein, 11 aa, Influenza virus
SKRGNSGIMKT

SEQ ID NO: 538420 - protein, 11 aa, Influenza virus
SKRGSSGIMKT

SEQ ID NO: 538421 - protein, 11 aa, Influenza virus
SKRGSSGIVKT

SEQ ID NO: 538422 - protein, 11 aa, Influenza virus
SKRGSSGVMKT

SEQ ID NO: 538423 - protein, 11 aa, Influenza virus
SKRKSYINKTG

SEQ ID NO: 538424 - protein, 11 aa, Influenza virus
SKRLVLATGLR

SEQ ID NO: 538425 - protein, 11 aa, Influenza virus
SKRYELEIGAR

SEQ ID NO: 538426 - protein, 11 aa, Influenza virus
SKRYELEIGTR

SEQ ID NO: 538427 - protein, 11 aa, Influenza virus
SKSLCKVEGWV

SEQ ID NO: 538428 - protein, 11 aa, Influenza virus
SKSRGYKMNIQ

SEQ ID NO: 538429 - protein, 11 aa, Influenza virus
SKSRGYKMNNQ

SEQ ID NO: 538430 - protein, 11 aa, Influenza virus
SKSRGYKMNTK

SEQ ID NO: 538431 - protein, 11 aa, Influenza virus
SKSRGYKMNTQ

SEQ ID NO: 538432 - protein, 11 aa, Influenza virus
SKSRGYKMNTR

SEQ ID NO: 538433 - protein, 11 aa, Influenza virus
SKSRSIIFNME

SEQ ID NO: 538434 - protein, 11 aa, Influenza virus
SKSRSNIFNME

SEQ ID NO: 538435 - protein, 11 aa, Influenza virus
SKSRTKEGRRK

SEQ ID NO: 538436 - protein, 11 aa, Influenza virus
SKSRVDNHSMS

SEQ ID NO: 538437 - protein, 11 aa, Influenza virus
SKSTKSTVLKS

SEQ ID NO: 538438 - protein, 11 aa, Influenza virus
SKTQCQITGFA

SEQ ID NO: 538439 - protein, 11 aa, Influenza virus
SKVKMKWGMEM

SEQ ID NO: 538440 - protein, 11 aa, Influenza virus
SKVTCVCRDNW

SEQ ID NO: 538441 - protein, 11 aa, Influenza virus
SKWGDILEGTT

SEQ ID NO: 538442 - protein, 11 aa, Influenza virus
SKWGDVLDGVT

SEQ ID NO: 538443 - protein, 11 aa, Influenza virus
SKWGNVLDGVT

SEQ ID NO: 538444 - protein, 11 aa, Influenza virus
SKWNVTYTGTS

SEQ ID NO: 538445 - protein, 11 aa, Influenza virus
SKYEEESKLNR

SEQ ID NO: 538446 - protein, 11 aa, Influenza virus
SKYHWNLALDI

SEQ ID NO: 538447 - protein, 11 aa, Influenza virus
SKYLQSFTPSP

SEQ ID NO: 538448 - protein, 11 aa, Influenza virus
SKYQQSFSPSP

SEQ ID NO: 538449 - protein, 11 aa, Influenza virus
SKYQQSFTPSP

SEQ ID NO: 538450 - protein, 11 aa, Influenza virus
SKYRQSFSPSP

SEQ ID NO: 538451 - protein, 11 aa, Influenza virus
SKYWAIRTRSG

SEQ ID NO: 538452 - protein, 11 aa, Influenza virus
SLAVNVRGSGM

SEQ ID NO: 538453 - protein, 11 aa, Influenza virus
SLCEVNSWHIL

SEQ ID NO: 538454 - protein, 11 aa, Influenza virus
SLCKIEGWVVV

SEQ ID NO: 538455 - protein, 11 aa, Influenza virus
SLCKVEEWVVV

SEQ ID NO: 538456 - protein, 11 aa, Influenza virus
SLCKVEGWVVV

SEQ ID NO: 538457 - protein, 11 aa, Influenza virus
SLCLAILIAGG

SEQ ID NO: 538458 - protein, 11 aa, Influenza virus
SLCLAILVAGG

SEQ ID NO: 538459 - protein, 11 aa, Influenza virus
SLCLAVLIAGG

SEQ ID NO: 538460 - protein, 11 aa, Influenza virus
SLCNVEGWVVI

SEQ ID NO: 538461 - protein, 11 aa, Influenza virus
SLCNVEGWVVV

SEQ ID NO: 538462 - protein, 11 aa, Influenza virus
SLCSIWFSHYN

SEQ ID NO: 538463 - protein, 11 aa, Influenza virus
SLCSVEGWVVI

SEQ ID NO: 538464 - protein, 11 aa, Influenza virus
SLDEQNKLYGA

SEQ ID NO: 538465 - protein, 11 aa, Influenza virus
SLDEQNKLYGT

SEQ ID NO: 538466 - protein, 11 aa, Influenza virus
SLDGKAPISLG

SEQ ID NO: 538467 - protein, 11 aa, Influenza virus
SLDKICLGHHA

SEQ ID NO: 538468 - protein, 11 aa, Influenza virus
SLEFIAEQFTW

SEQ ID NO: 538469 - protein, 11 aa, Influenza virus
SLEGIILGNPK

SEQ ID NO: 538470 - protein, 11 aa, Influenza virus
SLEGLILGNPK

SEQ ID NO: 538471 - protein, 11 aa, Influenza virus
SLEGLILSNPK

SEQ ID NO: 538472 - protein, 11 aa, Influenza virus
SLEGLVLGNPK

SEQ ID NO: 538473 - protein, 11 aa, Influenza virus
SLERRLENLNK

SEQ ID NO: 538474 - protein, 11 aa, Influenza virus
SLESRSGFEMI

SEQ ID NO: 538475 - protein, 11 aa, Influenza virus
SLESRSGFEMV

SEQ ID NO: 538476 - protein, 11 aa, Influenza virus
SLFEKFFPSSS

SEQ ID NO: 538477 - protein, 11 aa, Influenza virus
SLFSSIKKYER

SEQ ID NO: 538478 - protein, 11 aa, Influenza virus
SLFSSIKRYER

SEQ ID NO: 538479 - protein, 11 aa, Influenza virus
SLGAISFWMCS

SEQ ID NO: 538480 - protein, 11 aa, Influenza virus
SLGAVSFWMCS

SEQ ID NO: 538481 - protein, 11 aa, Influenza virus
SLGDCSFAGWI

SEQ ID NO: 538482 - protein, 11 aa, Influenza virus
SLGDCSFAGWL

SEQ ID NO: 538483 - protein, 11 aa, Influenza virus
SLGDCSFTGWI

SEQ ID NO: 538484 - protein, 11 aa, Influenza virus
SLGIQSDAQID

SEQ ID NO: 538485 - protein, 11 aa, Influenza virus
SLIALCGSPFP

SEQ ID NO: 538486 - protein, 11 aa, Influenza virus
SLIALCGSPFS

SEQ ID NO: 538487 - protein, 11 aa, Influenza virus
SLIASSGTLEF

SEQ ID NO: 538488 - protein, 11 aa, Influenza virus
SLIIAARNIVR

SEQ ID NO: 538489 - protein, 11 aa, Influenza virus
SLIIAARSIVR

SEQ ID NO: 538490 - protein, 11 aa, Influenza virus
SLIMRTVIALS

SEQ ID NO: 538491 - protein, 11 aa, Influenza virus
SLIQFPIGTAP

SEQ ID NO: 538492 - protein, 11 aa, Influenza virus
SLIQFPMGTAP

SEQ ID NO: 538493 - protein, 11 aa, Influenza virus
SLIRFPIGTAP

SEQ ID NO: 538494 - protein, 11 aa, Influenza virus
SLIRFPIGVAP

SEQ ID NO: 538495 - protein, 11 aa, Influenza virus
SLIRFPVGTAP

SEQ ID NO: 538496 - protein, 11 aa, Influenza virus
SLISWPLSSPP

SEQ ID NO: 538497 - protein, 11 aa, Influenza virus
SLIWLWLVLRE

SEQ ID NO: 538498 - protein, 11 aa, Influenza virus
SLKGLILGNPK

SEQ ID NO: 538499 - protein, 11 aa, Influenza virus
SLKLAIGLRNV

SEQ ID NO: 538500 - protein, 11 aa, Influenza virus
SLKLAIGPRNV

SEQ ID NO: 538501 - protein, 11 aa, Influenza virus
SLKLASGLRNV

SEQ ID NO: 538502 - protein, 11 aa, Influenza virus
SLKLATGLRNI

SEQ ID NO: 538503 - protein, 11 aa, Influenza virus
SLKLATGLRNV

SEQ ID NO: 538504 - protein, 11 aa, Influenza virus
SLKLATGMRNI

SEQ ID NO: 538505 - protein, 11 aa, Influenza virus
SLKLATGPRNV

SEQ ID NO: 538506 - protein, 11 aa, Influenza virus
SLKLVTGLRNV

SEQ ID NO: 538507 - protein, 11 aa, Influenza virus
SLLEMCHGTQI

SEQ ID NO: 538508 - protein, 11 aa, Influenza virus
SLLEMCHSTQI

SEQ ID NO: 538509 - protein, 11 aa, Influenza virus
SLLEMCHSTRI

SEQ ID NO: 538510 - protein, 11 aa, Influenza virus
SLLHKCNDSCM

SEQ ID NO: 538511 - protein, 11 aa, Influenza virus
SLLLATGMKNV

SEQ ID NO: 538512 - protein, 11 aa, Influenza virus
SLLLATGMRNI

SEQ ID NO: 538513 - protein, 11 aa, Influenza virus
SLLLATGMRNV

SEQ ID NO: 538514 - protein, 11 aa, Influenza virus
SLLLLQANLCR

SEQ ID NO: 538515 - protein, 11 aa, Influenza virus
SLLLQANLCRF

SEQ ID NO: 538516 - protein, 11 aa, Influenza virus
SLLNDKHSNGT

SEQ ID NO: 538517 - protein, 11 aa, Influenza virus
SLLNDKHSSGT

SEQ ID NO: 538518 - protein, 11 aa, Influenza virus
SLLNDRHSNGT

SEQ ID NO: 538519 - protein, 11 aa, Influenza virus
SLLNRLSINPV

SEQ ID NO: 538520 - protein, 11 aa, Influenza virus
SLLQSAILSLQ

SEQ ID NO: 538521 - protein, 11 aa, Influenza virus
SLLTEVETYVL

SEQ ID NO: 538522 - protein, 11 aa, Influenza virus
SLMLATGMKNV

SEQ ID NO: 538523 - protein, 11 aa, Influenza virus
SLMLATGMRNI

SEQ ID NO: 538524 - protein, 11 aa, Influenza virus
SLMLATGMRNV

SEQ ID NO: 538525 - protein, 11 aa, Influenza virus
SLMQGSTLPRR

SEQ ID NO: 538526 - protein, 11 aa, Influenza virus
SLMWEINGPES

SEQ ID NO: 538527 - protein, 11 aa, Influenza virus
SLNGISPIHLG

SEQ ID NO: 538528 - protein, 11 aa, Influenza virus
SLNGISPVHLG

SEQ ID NO: 538529 - protein, 11 aa, Influenza virus
SLNGVSPIHLG

SEQ ID NO: 538530 - protein, 11 aa, Influenza virus
SLNGVSPVHLG

SEQ ID NO: 538531 - protein, 11 aa, Influenza virus
SLNILRTQESE

SEQ ID NO: 538532 - protein, 11 aa, Influenza virus
SLNITAASLND

SEQ ID NO: 538533 - protein, 11 aa, Influenza virus
SLNKKMEDGFL

SEQ ID NO: 538534 - protein, 11 aa, Influenza virus
SLPLALGMKNV

SEQ ID NO: 538535 - protein, 11 aa, Influenza virus
SLPLCPFKGFF

SEQ ID NO: 538536 - protein, 11 aa, Influenza virus
SLPLCPFQGFF

SEQ ID NO: 538537 - protein, 11 aa, Influenza virus
SLPLCPFRGFF

SEQ ID NO: 538538 - protein, 11 aa, Influenza virus
SLPNDKHSNGT

SEQ ID NO: 538539 - protein, 11 aa, Influenza virus
SLQCRICIDFR

SEQ ID NO: 538540 - protein, 11 aa, Influenza virus
SLQCRICILDQ

SEQ ID NO: 538541 - protein, 11 aa, Influenza virus
SLQCRICIRAD

SEQ ID NO: 538542 - protein, 11 aa, Influenza virus
SLQNRIQIDPV

SEQ ID NO: 538543 - protein, 11 aa, Influenza virus
SLQNRIQIDQV

SEQ ID NO: 538544 - protein, 11 aa, Influenza virus
SLQNRIQIDSV

SEQ ID NO: 538545 - protein, 11 aa, Influenza virus
SLQQIESIIEA

SEQ ID NO: 538546 - protein, 11 aa, Influenza virus
SLQQIESMIEA

SEQ ID NO: 538547 - protein, 11 aa, Influenza virus
SLQQIESMVEA

SEQ ID NO: 538548 - protein, 11 aa, Influenza virus
SLQQVESMIEA

SEQ ID NO: 538549 - protein, 11 aa, Influenza virus
SLRGRGSTLGL

SEQ ID NO: 538550 - protein, 11 aa, Influenza virus
SLRLAIGLRNT

SEQ ID NO: 538551 - protein, 11 aa, Influenza virus
SLRLALGLRNT

SEQ ID NO: 538552 - protein, 11 aa, Influenza virus
SLRLATGLRNI

SEQ ID NO: 538553 - protein, 11 aa, Influenza virus
SLRLATGLRNV

SEQ ID NO: 538554 - protein, 11 aa, Influenza virus
SLRLATGMRNI

SEQ ID NO: 538555 - protein, 11 aa, Influenza virus
SLRLAVGLRNT

SEQ ID NO: 538556 - protein, 11 aa, Influenza virus
SLRMKWMMAMK

SEQ ID NO: 538557 - protein, 11 aa, Influenza virus
SLRSILANNGK

SEQ ID NO: 538558 - protein, 11 aa, Influenza virus
SLRSILANNGR

SEQ ID NO: 538559 - protein, 11 aa, Influenza virus
SLRSILASSGS

SEQ ID NO: 538560 - protein, 11 aa, Influenza virus
SLRSIVASSGT

SEQ ID NO: 538561 - protein, 11 aa, Influenza virus
SLRSLIASSGT

SEQ ID NO: 538562 - protein, 11 aa, Influenza virus
SLRSLVASSGT

SEQ ID NO: 538563 - protein, 11 aa, Influenza virus
SLRSLVGSSGT

SEQ ID NO: 538564 - protein, 11 aa, Influenza virus
SLSISIGSSTY

SEQ ID NO: 538565 - protein, 11 aa, Influenza virus
SLSISVESSTY

SEQ ID NO: 538566 - protein, 11 aa, Influenza virus
SLSISVGSSTY

SEQ ID NO: 538567 - protein, 11 aa, Influenza virus
SLSLAIMIAGI

SEQ ID NO: 538568 - protein, 11 aa, Influenza virus
SLSLAIMMAGI

SEQ ID NO: 538569 - protein, 11 aa, Influenza virus
SLSLAIMVAGI

SEQ ID NO: 538570 - protein, 11 aa, Influenza virus
SLSPGMMMGMF

SEQ ID NO: 538571 - protein, 11 aa, Influenza virus
SLSYSAGALAS

SEQ ID NO: 538572 - protein, 11 aa, Influenza virus
SLSYSTGALAS

SEQ ID NO: 538573 - protein, 11 aa, Influenza virus
SLTEIWSYNAE

SEQ ID NO: 538574 - protein, 11 aa, Influenza virus
SLTHALRELWQ

SEQ ID NO: 538575 - protein, 11 aa, Influenza virus
SLTKGVLGFVF

SEQ ID NO: 538576 - protein, 11 aa, Influenza virus
SLTSLPFQNIH

SEQ ID NO: 538577 - protein, 11 aa, Influenza virus
SLTVNVRGSGL

SEQ ID NO: 538578 - protein, 11 aa, Influenza virus
SLTVNVRGSGM

SEQ ID NO: 538579 - protein, 11 aa, Influenza virus
SLTVNVRGTGM

SEQ ID NO: 538580 - protein, 11 aa, Influenza virus
SLTVSVRGSGM

SEQ ID NO: 538581 - protein, 11 aa, Influenza virus
SLVALCGSPIS

SEQ ID NO: 538582 - protein, 11 aa, Influenza virus
SLVALCGSPVP

SEQ ID NO: 538583 - protein, 11 aa, Influenza virus
SLVALCGSPVS

SEQ ID NO: 538584 - protein, 11 aa, Influenza virus
SLVASSGNLEF

SEQ ID NO: 538585 - protein, 11 aa, Influenza virus
SLVASSGTLEF

SEQ ID NO: 538586 - protein, 11 aa, Influenza virus
SLVGIDPFKLL

SEQ ID NO: 538587 - protein, 11 aa, Influenza virus
SLVGIDPFRLL

SEQ ID NO: 538588 - protein, 11 aa, Influenza virus
SLVGVDPFKLL

SEQ ID NO: 538589 - protein, 11 aa, Influenza virus
SLVGVDPFRLL

SEQ ID NO: 538590 - protein, 11 aa, Influenza virus
SLVIAARNIVR

SEQ ID NO: 538591 - protein, 11 aa, Influenza virus
SLVLLFMIIGG

SEQ ID NO: 538592 - protein, 11 aa, Influenza virus
SLVLLLMIIGG

SEQ ID NO: 538593 - protein, 11 aa, Influenza virus
SLWDSFRQSER

SEQ ID NO: 538594 - protein, 11 aa, Influenza virus
SLWMCSNGSLQ

SEQ ID NO: 538595 - protein, 11 aa, Influenza virus
SLYASPQLEGF

SEQ ID NO: 538596 - protein, 11 aa, Influenza virus
SLYASSQLEGF

SEQ ID NO: 538597 - protein, 11 aa, Influenza virus
SLYDKVRMQLR

SEQ ID NO: 538598 - protein, 11 aa, Influenza virus
SLYSSPQLEGF

SEQ ID NO: 538599 - protein, 11 aa, Influenza virus
SLYWTIVEPGD

SEQ ID NO: 538600 - protein, 11 aa, Influenza virus
SMAPIMFSNKM

SEQ ID NO: 538601 - protein, 11 aa, Influenza virus
SMCSSTEFLGQ

SEQ ID NO: 538602 - protein, 11 aa, Influenza virus
SMDSRSGYETF

SEQ ID NO: 538603 - protein, 11 aa, Influenza virus
SMEFSLTDPKL

SEQ ID NO: 538604 - protein, 11 aa, Influenza virus
SMEFSLTDPRF

SEQ ID NO: 538605 - protein, 11 aa, Influenza virus
SMEFSLTDPRL

SEQ ID NO: 538606 - protein, 11 aa, Influenza virus
SMELPSFGVSG

SEQ ID NO: 538607 - protein, 11 aa, Influenza virus
SMGEAMVSRAR

SEQ ID NO: 538608 - protein, 11 aa, Influenza virus
SMGFRYSGIRT

SEQ ID NO: 538609 - protein, 11 aa, Influenza virus
SMGIYQILAIY

SEQ ID NO: 538610 - protein, 11 aa, Influenza virus
SMGVYQILAIY

SEQ ID NO: 538611 - protein, 11 aa, Influenza virus
SMMEAMVSRAR

SEQ ID NO: 538612 - protein, 11 aa, Influenza virus
SMMWEINGPDS

SEQ ID NO: 538613 - protein, 11 aa, Influenza virus
SMMWEINGPES

SEQ ID NO: 538614 - protein, 11 aa, Influenza virus
SMMWEVNGPES

SEQ ID NO: 538615 - protein, 11 aa, Influenza virus
SMNNQVFPQLN

SEQ ID NO: 538616 - protein, 11 aa, Influenza virus
SMPFHNIHPHT

SEQ ID NO: 538617 - protein, 11 aa, Influenza virus
SMPFHNIHPLT

SEQ ID NO: 538618 - protein, 11 aa, Influenza virus
SMPFHNVHPLT

SEQ ID NO: 538619 - protein, 11 aa, Influenza virus
SMPLHNIHPLT

SEQ ID NO: 538620 - protein, 11 aa, Influenza virus
SMSCFVFVALI

SEQ ID NO: 538621 - protein, 11 aa, Influenza virus
SMSDIEAMASQ

SEQ ID NO: 538622 - protein, 11 aa, Influenza virus
SMSGFRSNLPG

SEQ ID NO: 538623 - protein, 11 aa, Influenza virus
SMTEIWSYNAE

SEQ ID NO: 538624 - protein, 11 aa, Influenza virus
SMTEVWSYNAE

SEQ ID NO: 538625 - protein, 11 aa, Influenza virus
SMVEAMISRAR

SEQ ID NO: 538626 - protein, 11 aa, Influenza virus
SMVEAMMSRAR

SEQ ID NO: 538627 - protein, 11 aa, Influenza virus
SMVEAMVSRAR

SEQ ID NO: 538628 - protein, 11 aa, Influenza virus
SMVFCGVSGEV

SEQ ID NO: 538629 - protein, 11 aa, Influenza virus
SMVKSDKICLG

SEQ ID NO: 538630 - protein, 11 aa, Influenza virus
SMVRSDKICLG

SEQ ID NO: 538631 - protein, 11 aa, Influenza virus
SMVTFCGLDNE

SEQ ID NO: 538632 - protein, 11 aa, Influenza virus
SNAASYKRIRL

SEQ ID NO: 538633 - protein, 11 aa, Influenza virus
SNAEGTGMAAD

SEQ ID NO: 538634 - protein, 11 aa, Influenza virus
SNAIDEGDGCF

SEQ ID NO: 538635 - protein, 11 aa, Influenza virus
SNAITRSGQNH

SEQ ID NO: 538636 - protein, 11 aa, Influenza virus
SNALLKHRFEI

SEQ ID NO: 538637 - protein, 11 aa, Influenza virus
SNAPSGIEYNG

SEQ ID NO: 538638 - protein, 11 aa, Influenza virus
SNAPSGVEYNG

SEQ ID NO: 538639 - protein, 11 aa, Influenza virus
SNAQAFYKILK

SEQ ID NO: 538640 - protein, 11 aa, Influenza virus
SNAYQAKFESV

SEQ ID NO: 538641 - protein, 11 aa, Influenza virus
SNCKDPNNERG

SEQ ID NO: 538642 - protein, 11 aa, Influenza virus
SNCRDPNNERG

SEQ ID NO: 538643 - protein, 11 aa, Influenza virus
SNCRNPNNEKG

SEQ ID NO: 538644 - protein, 11 aa, Influenza virus
SNCRNPNNERG

SEQ ID NO: 538645 - protein, 11 aa, Influenza virus
SNDNWSGYSGS

SEQ ID NO: 538646 - protein, 11 aa, Influenza virus
SNDQGAGYAAD

SEQ ID NO: 538647 - protein, 11 aa, Influenza virus
SNDQGSGYAAD

SEQ ID NO: 538648 - protein, 11 aa, Influenza virus
SNDTINYYNET

SEQ ID NO: 538649 - protein, 11 aa, Influenza virus
SNEGSYFFGDN

SEQ ID NO: 538650 - protein, 11 aa, Influenza virus
SNEGSYFFGDS

SEQ ID NO: 538651 - protein, 11 aa, Influenza virus
SNENPAHKSQL

SEQ ID NO: 538652 - protein, 11 aa, Influenza virus
SNEQGSGYAAD

SEQ ID NO: 538653 - protein, 11 aa, Influenza virus
SNETILETGYV

SEQ ID NO: 538654 - protein, 11 aa, Influenza virus
SNGGFLAPRYG

SEQ ID NO: 538655 - protein, 11 aa, Influenza virus
SNGGLIAPRYG

SEQ ID NO: 538656 - protein, 11 aa, Influenza virus
SNGGLLAPKYG

SEQ ID NO: 538657 - protein, 11 aa, Influenza virus
SNGGLLAPRYG

SEQ ID NO: 538658 - protein, 11 aa, Influenza virus
SNGNCRFNVCI

SEQ ID NO: 538659 - protein, 11 aa, Influenza virus
SNGNFIAPENA

SEQ ID NO: 538660 - protein, 11 aa, Influenza virus
SNGNFIAPEYA

SEQ ID NO: 538661 - protein, 11 aa, Influenza virus
SNGNFITPEYA

SEQ ID NO: 538662 - protein, 11 aa, Influenza virus
SNGNLIAPEYG

SEQ ID NO: 538663 - protein, 11 aa, Influenza virus
SNGNLIAPRGY

SEQ ID NO: 538664 - protein, 11 aa, Influenza virus
SNGNLIAPWYA

SEQ ID NO: 538665 - protein, 11 aa, Influenza virus
SNGNLVAPRGY

SEQ ID NO: 538666 - protein, 11 aa, Influenza virus
SNGNLVAPWYA

SEQ ID NO: 538667 - protein, 11 aa, Influenza virus
SNGQGSGYAAD

SEQ ID NO: 538668 - protein, 11 aa, Influenza virus
SNGSCRCTICI

SEQ ID NO: 538669 - protein, 11 aa, Influenza virus
SNGSCRFNVCI

SEQ ID NO: 538670 - protein, 11 aa, Influenza virus
SNGSLQCKICI

SEQ ID NO: 538671 - protein, 11 aa, Influenza virus
SNGSLQCRICI

SEQ ID NO: 538672 - protein, 11 aa, Influenza virus
SNGSLQCRVCI

SEQ ID NO: 538673 - protein, 11 aa, Influenza virus
SNGSLQCTICI

SEQ ID NO: 538674 - protein, 11 aa, Influenza virus
SNGSLQFRICI

SEQ ID NO: 538675 - protein, 11 aa, Influenza virus
SNGSLRCRICI

SEQ ID NO: 538676 - protein, 11 aa, Influenza virus
SNGTIHDRAAF

SEQ ID NO: 538677 - protein, 11 aa, Influenza virus
SNGTIHDRSQY

SEQ ID NO: 538678 - protein, 11 aa, Influenza virus
SNGTIHDRTAF

SEQ ID NO: 538679 - protein, 11 aa, Influenza virus
SNGTIHDRTTF

SEQ ID NO: 538680 - protein, 11 aa, Influenza virus
SNGTIKDRSPY

SEQ ID NO: 538681 - protein, 11 aa, Influenza virus
SNGTKINTLTE

SEQ ID NO: 538682 - protein, 11 aa, Influenza virus
SNGTKVNTLTE

SEQ ID NO: 538683 - protein, 11 aa, Influenza virus
SNGTMKDRSPY

SEQ ID NO: 538684 - protein, 11 aa, Influenza virus
SNGTTHDRTAF

SEQ ID NO: 538685 - protein, 11 aa, Influenza virus
SNGTVKDRSPF

SEQ ID NO: 538686 - protein, 11 aa, Influenza virus
SNGTVKDRSPY

SEQ ID NO: 538687 - protein, 11 aa, Influenza virus
SNGVQDIIDND

SEQ ID NO: 538688 - protein, 11 aa, Influenza virus
SNGVQDIIDNN

SEQ ID NO: 538689 - protein, 11 aa, Influenza virus
SNIFNMERIKE

SEQ ID NO: 538690 - protein, 11 aa, Influenza virus
SNIGLNVSLHL

SEQ ID NO: 538691 - protein, 11 aa, Influenza virus
SNINIREWSYL

SEQ ID NO: 538692 - protein, 11 aa, Influenza virus
SNKMARLGKGY

SEQ ID NO: 538693 - protein, 11 aa, Influenza virus
SNKMARLGRGY

SEQ ID NO: 538694 - protein, 11 aa, Influenza virus
SNKVARLGKGY

SEQ ID NO: 538695 - protein, 11 aa, Influenza virus
SNLDYQIGYVC

SEQ ID NO: 538696 - protein, 11 aa, Influenza virus
SNLNDATYQRT

SEQ ID NO: 538697 - protein, 11 aa, Influenza virus
SNLNDTTYQRT

SEQ ID NO: 538698 - protein, 11 aa, Influenza virus
SNLYNIRNLHI

SEQ ID NO: 538699 - protein, 11 aa, Influenza virus
SNMGIYQILAI

SEQ ID NO: 538700 - protein, 11 aa, Influenza virus
SNMGVYQILAI

SEQ ID NO: 538701 - protein, 11 aa, Influenza virus
SNMGVYQVLAI

SEQ ID NO: 538702 - protein, 11 aa, Influenza virus
SNMSLNISLYS

SEQ ID NO: 538703 - protein, 11 aa, Influenza virus
SNNATDTVDTL

SEQ ID NO: 538704 - protein, 11 aa, Influenza virus
SNNDWSGYSGS

SEQ ID NO: 538705 - protein, 11 aa, Influenza virus
SNNGVKGFSYL

SEQ ID NO: 538706 - protein, 11 aa, Influenza virus
SNNRSGYSGIF

SEQ ID NO: 538707 - protein, 11 aa, Influenza virus
SNNSSDTVDTL

SEQ ID NO: 538708 - protein, 11 aa, Influenza virus
SNNSTDKIDTL

SEQ ID NO: 538709 - protein, 11 aa, Influenza virus
SNNSTDKVDTI

SEQ ID NO: 538710 - protein, 11 aa, Influenza virus
SNNSTDKVDTL

SEQ ID NO: 538711 - protein, 11 aa, Influenza virus
SNNSTDKVNTI

SEQ ID NO: 538712 - protein, 11 aa, Influenza virus
SNNSTDTVDTL

SEQ ID NO: 538713 - protein, 11 aa, Influenza virus
SNNSTDTVNTL

SEQ ID NO: 538714 - protein, 11 aa, Influenza virus
SNNSTEKVDTI

SEQ ID NO: 538715 - protein, 11 aa, Influenza virus
SNNSTERVDTI

SEQ ID NO: 538716 - protein, 11 aa, Influenza virus
SNNSTNTVNTL

SEQ ID NO: 538717 - protein, 11 aa, Influenza virus
SNNTTNYYNET

SEQ ID NO: 538718 - protein, 11 aa, Influenza virus
SNNTVKDRSPY

SEQ ID NO: 538719 - protein, 11 aa, Influenza virus
SNNWSGYSGIF

SEQ ID NO: 538720 - protein, 11 aa, Influenza virus
SNPITGSPGAP

SEQ ID NO: 538721 - protein, 11 aa, Influenza virus
SNPITGSPSAP

SEQ ID NO: 538722 - protein, 11 aa, Influenza virus
SNPKCDLYLNG

SEQ ID NO: 538723 - protein, 11 aa, Influenza virus
SNQASYKIFKS

SEQ ID NO: 538724 - protein, 11 aa, Influenza virus
SNQDSFYRSMK

SEQ ID NO: 538725 - protein, 11 aa, Influenza virus
SNQGSFYRNMR

SEQ ID NO: 538726 - protein, 11 aa, Influenza virus
SNQGSFYRSIR

SEQ ID NO: 538727 - protein, 11 aa, Influenza virus
SNQGSFYRSMR

SEQ ID NO: 538728 - protein, 11 aa, Influenza virus
SNRGSFYRSMR

SEQ ID NO: 538729 - protein, 11 aa, Influenza virus
SNRPWIRFNSD

SEQ ID NO: 538730 - protein, 11 aa, Influenza virus
SNRPWIRFNSN

SEQ ID NO: 538731 - protein, 11 aa, Influenza virus
SNRPWIRINNE

SEQ ID NO: 538732 - protein, 11 aa, Influenza virus
SNRPWMRINNE

SEQ ID NO: 538733 - protein, 11 aa, Influenza virus
SNRPWMRISNE

SEQ ID NO: 538734 - protein, 11 aa, Influenza virus
SNRPWVRINNE

SEQ ID NO: 538735 - protein, 11 aa, Influenza virus
SNRPWVRMNNE

SEQ ID NO: 538736 - protein, 11 aa, Influenza virus
SNRSGYSGSFI

SEQ ID NO: 538737 - protein, 11 aa, Influenza virus
SNSDFICVGWS

SEQ ID NO: 538738 - protein, 11 aa, Influenza virus
SNSDFLCVGWS

SEQ ID NO: 538739 - protein, 11 aa, Influenza virus
SNSDFMCVGWS

SEQ ID NO: 538740 - protein, 11 aa, Influenza virus
SNSDWSGYSGS

SEQ ID NO: 538741 - protein, 11 aa, Influenza virus
SNSEFICVGWS

SEQ ID NO: 538742 - protein, 11 aa, Influenza virus
SNSEFLCVGWS

SEQ ID NO: 538743 - protein, 11 aa, Influenza virus
SNSEGTGMAAD

SEQ ID NO: 538744 - protein, 11 aa, Influenza virus
SNSIAVFCGTS

SEQ ID NO: 538745 - protein, 11 aa, Influenza virus
SNSIISMCSST

SEQ ID NO: 538746 - protein, 11 aa, Influenza virus
SNSIIVFCGTS

SEQ ID NO: 538747 - protein, 11 aa, Influenza virus
SNSIVAFCGTS

SEQ ID NO: 538748 - protein, 11 aa, Influenza virus
SNSIVALCGSK

SEQ ID NO: 538749 - protein, 11 aa, Influenza virus
SNSIVALCGSR

SEQ ID NO: 538750 - protein, 11 aa, Influenza virus
SNSIVSMCSST

SEQ ID NO: 538751 - protein, 11 aa, Influenza virus
SNSIVTFCGLD

SEQ ID NO: 538752 - protein, 11 aa, Influenza virus
SNSIVTFCGLN

SEQ ID NO: 538753 - protein, 11 aa, Influenza virus
SNSIVVFCGAS

SEQ ID NO: 538754 - protein, 11 aa, Influenza virus
SNSIVVFCGTP

SEQ ID NO: 538755 - protein, 11 aa, Influenza virus
SNSIVVFCGTS

SEQ ID NO: 538756 - protein, 11 aa, Influenza virus
SNSIVVFVAPS

SEQ ID NO: 538757 - protein, 11 aa, Influenza virus
SNSLIALCGSP

SEQ ID NO: 538758 - protein, 11 aa, Influenza virus
SNSLKLAIGLR

SEQ ID NO: 538759 - protein, 11 aa, Influenza virus
SNSLVALCGSP

SEQ ID NO: 538760 - protein, 11 aa, Influenza virus
SNSLVTFCGLD

SEQ ID NO: 538761 - protein, 11 aa, Influenza virus
SNSMVTFCGLD

SEQ ID NO: 538762 - protein, 11 aa, Influenza virus
SNSNCKDPNNE

SEQ ID NO: 538763 - protein, 11 aa, Influenza virus
SNSNCRDPNNE

SEQ ID NO: 538764 - protein, 11 aa, Influenza virus
SNSNCRNPNNE

SEQ ID NO: 538765 - protein, 11 aa, Influenza virus
SNSRFESVAWS

SEQ ID NO: 538766 - protein, 11 aa, Influenza virus
SNSTTHDRTAF

SEQ ID NO: 538767 - protein, 11 aa, Influenza virus
SNSVVVFCGTS

SEQ ID NO: 538768 - protein, 11 aa, Influenza virus
SNTDWSGYSGS

SEQ ID NO: 538769 - protein, 11 aa, Influenza virus
SNTWLGRTISP

SEQ ID NO: 538770 - protein, 11 aa, Influenza virus
SNVENLFDEVR

SEQ ID NO: 538771 - protein, 11 aa, Influenza virus
SNVGLNISLHL

SEQ ID NO: 538772 - protein, 11 aa, Influenza virus
SNVGLNMSLHL

SEQ ID NO: 538773 - protein, 11 aa, Influenza virus
SNVGLNVSLHL

SEQ ID NO: 538774 - protein, 11 aa, Influenza virus
SNVKKLYDRVR

SEQ ID NO: 538775 - protein, 11 aa, Influenza virus
SNVKNLFDEVK

SEQ ID NO: 538776 - protein, 11 aa, Influenza virus
SNVKNLFDEVR

SEQ ID NO: 538777 - protein, 11 aa, Influenza virus
SNVKNLYDKVR

SEQ ID NO: 538778 - protein, 11 aa, Influenza virus
SNVKNLYDRVR

SEQ ID NO: 538779 - protein, 11 aa, Influenza virus
SNVKNLYEKVR

SEQ ID NO: 538780 - protein, 11 aa, Influenza virus
SNVKNLYNKVR

SEQ ID NO: 538781 - protein, 11 aa, Influenza virus
SNVRNLYDKVR

SEQ ID NO: 538782 - protein, 11 aa, Influenza virus
SNVTVTNSVEL

SEQ ID NO: 538783 - protein, 11 aa, Influenza virus
SNVTVTSSIEL

SEQ ID NO: 538784 - protein, 11 aa, Influenza virus
SNVTVTSSVEL

SEQ ID NO: 538785 - protein, 11 aa, Influenza virus
SNVVLNVSLHL

SEQ ID NO: 538786 - protein, 11 aa, Influenza virus
SNWSGYSGIFS

SEQ ID NO: 538787 - protein, 11 aa, Influenza virus
SNWSGYSGSFI

SEQ ID NO: 538788 - protein, 11 aa, Influenza virus
SNWSGYSGSFT

SEQ ID NO: 538789 - protein, 11 aa, Influenza virus
SNYHQSFVPSP

SEQ ID NO: 538790 - protein, 11 aa, Influenza virus
SNYQQSFVPSP

SEQ ID NO: 538791 - protein, 11 aa, Influenza virus
SNYVCSGLVGD

SEQ ID NO: 538792 - protein, 11 aa, Influenza virus
SPCLTDKGSIQ

SEQ ID NO: 538793 - protein, 11 aa, Influenza virus
SPDPGVKGFAF

SEQ ID NO: 538794 - protein, 11 aa, Influenza virus
SPEEISETQGT

SEQ ID NO: 538795 - protein, 11 aa, Influenza virus
SPEEVSEAQGT

SEQ ID NO: 538796 - protein, 11 aa, Influenza virus
SPEEVSETQGI

SEQ ID NO: 538797 - protein, 11 aa, Influenza virus
SPEEVSETQGM

SEQ ID NO: 538798 - protein, 11 aa, Influenza virus
SPEEVSETQGT

SEQ ID NO: 538799 - protein, 11 aa, Influenza virus
SPFPVGSGSFP

SEQ ID NO: 538800 - protein, 11 aa, Influenza virus
SPFRALISWEM

SEQ ID NO: 538801 - protein, 11 aa, Influenza virus
SPFRALISWGM

SEQ ID NO: 538802 - protein, 11 aa, Influenza virus
SPFRALVSWEM

SEQ ID NO: 538803 - protein, 11 aa, Influenza virus
SPFRTLMSCPI

SEQ ID NO: 538804 - protein, 11 aa, Influenza virus
SPFRTLMSCPM

SEQ ID NO: 538805 - protein, 11 aa, Influenza virus
SPFRTLMSCPV

SEQ ID NO: 538806 - protein, 11 aa, Influenza virus
SPGAPGVKGFG

SEQ ID NO: 538807 - protein, 11 aa, Influenza virus
SPGARPKVNGQ

SEQ ID NO: 538808 - protein, 11 aa, Influenza virus
SPGCDRLQDTT

SEQ ID NO: 538809 - protein, 11 aa, Influenza virus
SPGDRPKVNGQ

SEQ ID NO: 538810 - protein, 11 aa, Influenza virus
SPGMMMGMFNM

SEQ ID NO: 538811 - protein, 11 aa, Influenza virus
SPGNAEIEDLI

SEQ ID NO: 538812 - protein, 11 aa, Influenza virus
SPGVKGWAFDS

SEQ ID NO: 538813 - protein, 11 aa, Influenza virus
SPHRTLLMNEL

SEQ ID NO: 538814 - protein, 11 aa, Influenza virus
SPHSRSGFEML

SEQ ID NO: 538815 - protein, 11 aa, Influenza virus
SPIHLGDCSFE

SEQ ID NO: 538816 - protein, 11 aa, Influenza virus
SPINNGKGRYG

SEQ ID NO: 538817 - protein, 11 aa, Influenza virus
SPISVGSGSFP

SEQ ID NO: 538818 - protein, 11 aa, Influenza virus
SPKLRSGFEML

SEQ ID NO: 538819 - protein, 11 aa, Influenza virus
SPKYQQSFTPS

SEQ ID NO: 538820 - protein, 11 aa, Influenza virus
SPLAGSAQHVE

SEQ ID NO: 538821 - protein, 11 aa, Influenza virus
SPLAITWWNRN

SEQ ID NO: 538822 - protein, 11 aa, Influenza virus
SPLAVTWWNRK

SEQ ID NO: 538823 - protein, 11 aa, Influenza virus
SPLAVTWWNRN

SEQ ID NO: 538824 - protein, 11 aa, Influenza virus
SPLAVTWWNRS

SEQ ID NO: 538825 - protein, 11 aa, Influenza virus
SPLELGDCSIA

SEQ ID NO: 538826 - protein, 11 aa, Influenza virus
SPLELRDCKIE

SEQ ID NO: 538827 - protein, 11 aa, Influenza virus
SPLGAINTTLP

SEQ ID NO: 538828 - protein, 11 aa, Influenza virus
SPLKLVDGQDC

SEQ ID NO: 538829 - protein, 11 aa, Influenza virus
SPLMVAYMLER

SEQ ID NO: 538830 - protein, 11 aa, Influenza virus
SPLPFQNIDSR

SEQ ID NO: 538831 - protein, 11 aa, Influenza virus
SPLPFQNIDSW

SEQ ID NO: 538832 - protein, 11 aa, Influenza virus
SPLSGSAQHIE

SEQ ID NO: 538833 - protein, 11 aa, Influenza virus
SPLSGSAQHVE

SEQ ID NO: 538834 - protein, 11 aa, Influenza virus
SPLSRCRETRG

SEQ ID NO: 538835 - protein, 11 aa, Influenza virus
SPLSRCRKTRG

SEQ ID NO: 538836 - protein, 11 aa, Influenza virus
SPLTKGILGFV

SEQ ID NO: 538837 - protein, 11 aa, Influenza virus
SPLTKGMLGFV

SEQ ID NO: 538838 - protein, 11 aa, Influenza virus
SPLVLDDCSLE

SEQ ID NO: 538839 - protein, 11 aa, Influenza virus
SPLVLDDCSLK

SEQ ID NO: 538840 - protein, 11 aa, Influenza virus
SPMMWEINGPE

SEQ ID NO: 538841 - protein, 11 aa, Influenza virus
SPNAYQAKFES

SEQ ID NO: 538842 - protein, 11 aa, Influenza virus
SPNAYQAQFES

SEQ ID NO: 538843 - protein, 11 aa, Influenza virus
SPNAYQARFES

SEQ ID NO: 538844 - protein, 11 aa, Influenza virus
SPQLEGFSAES

SEQ ID NO: 538845 - protein, 11 aa, Influenza virus
SPQNILRTQES

SEQ ID NO: 538846 - protein, 11 aa, Influenza virus
SPRLRSGFEML

SEQ ID NO: 538847 - protein, 11 aa, Influenza virus
SPRMFLAMITY

SEQ ID NO: 538848 - protein, 11 aa, Influenza virus
SPRSRNGFEML

SEQ ID NO: 538849 - protein, 11 aa, Influenza virus
SPRSRSGFEML

SEQ ID NO: 538850 - protein, 11 aa, Influenza virus
SPRTVGQCPKY

SEQ ID NO: 538851 - protein, 11 aa, Influenza virus
SPSAPGVKGFG

SEQ ID NO: 538852 - protein, 11 aa, Influenza virus
SPSECRTFFLT

SEQ ID NO: 538853 - protein, 11 aa, Influenza virus
SPSNSRFESVA

SEQ ID NO: 538854 - protein, 11 aa, Influenza virus
SPSPGARPKVN

SEQ ID NO: 538855 - protein, 11 aa, Influenza virus
SPSPGDRPKVN

SEQ ID NO: 538856 - protein, 11 aa, Influenza virus
SPVHLGDCNFE

SEQ ID NO: 538857 - protein, 11 aa, Influenza virus
SPVHLGDCRFE

SEQ ID NO: 538858 - protein, 11 aa, Influenza virus
SPVHLGDCSFE

SEQ ID NO: 538859 - protein, 11 aa, Influenza virus
SPVLTDNPRPN

SEQ ID NO: 538860 - protein, 11 aa, Influenza virus
SPVNNGKGRYG

SEQ ID NO: 538861 - protein, 11 aa, Influenza virus
SPVPVGSGSFP

SEQ ID NO: 538862 - protein, 11 aa, Influenza virus
SPVSVGSGSFP

SEQ ID NO: 538863 - protein, 11 aa, Influenza virus
SPYNSKFESVA

SEQ ID NO: 538864 - protein, 11 aa, Influenza virus
SPYNSRFESVA

SEQ ID NO: 538865 - protein, 11 aa, Influenza virus
SPYRALISWEM

SEQ ID NO: 538866 - protein, 11 aa, Influenza virus
SPYRALMSVPL

SEQ ID NO: 538867 - protein, 11 aa, Influenza virus
SPYRALMSVPM

SEQ ID NO: 538868 - protein, 11 aa, Influenza virus
SQDTEISFTIT

SEQ ID NO: 538869 - protein, 11 aa, Influenza virus
SQDTELSFTIT

SEQ ID NO: 538870 - protein, 11 aa, Influenza virus
SQDTELSFTVT

SEQ ID NO: 538871 - protein, 11 aa, Influenza virus
SQDTEVSFTIT

SEQ ID NO: 538872 - protein, 11 aa, Influenza virus
SQFRALISWEM

SEQ ID NO: 538873 - protein, 11 aa, Influenza virus
SQGEGTAADYK

SEQ ID NO: 538874 - protein, 11 aa, Influenza virus
SQGSGYAADKE

SEQ ID NO: 538875 - protein, 11 aa, Influenza virus
SQGSGYAADRE

SEQ ID NO: 538876 - protein, 11 aa, Influenza virus
SQGTKRPYEQM

SEQ ID NO: 538877 - protein, 11 aa, Influenza virus
SQGTKRSHEQM

SEQ ID NO: 538878 - protein, 11 aa, Influenza virus
SQGTKRSYEQM

SEQ ID NO: 538879 - protein, 11 aa, Influenza virus
SQGTTIRGKHS

SEQ ID NO: 538880 - protein, 11 aa, Influenza virus
SQGTTIRGRHS

SEQ ID NO: 538881 - protein, 11 aa, Influenza virus
SQGTTLKGRHA

SEQ ID NO: 538882 - protein, 11 aa, Influenza virus
SQGTTLRGQHA

SEQ ID NO: 538883 - protein, 11 aa, Influenza virus
SQGTTLRGRHA

SEQ ID NO: 538884 - protein, 11 aa, Influenza virus
SQITNGTTGNP

SEQ ID NO: 538885 - protein, 11 aa, Influenza virus
SQKGILEDEQM

SEQ ID NO: 538886 - protein, 11 aa, Influenza virus
SQKILCTSATA

SEQ ID NO: 538887 - protein, 11 aa, Influenza virus
SQKLFALSGVA

SEQ ID NO: 538888 - protein, 11 aa, Influenza virus
SQKQEFKMNPN

SEQ ID NO: 538889 - protein, 11 aa, Influenza virus
SQLEGFSAESR

SEQ ID NO: 538890 - protein, 11 aa, Influenza virus
SQLIWMACHSA

SEQ ID NO: 538891 - protein, 11 aa, Influenza virus
SQLKKQEIEGI

SEQ ID NO: 538892 - protein, 11 aa, Influenza virus
SQLKRQEIEGI

SEQ ID NO: 538893 - protein, 11 aa, Influenza virus
SQLTEVETYVL

SEQ ID NO: 538894 - protein, 11 aa, Influenza virus
SQLVWMACHSA

SEQ ID NO: 538895 - protein, 11 aa, Influenza virus
SQLVWMACNSA

SEQ ID NO: 538896 - protein, 11 aa, Influenza virus
SQNILRTHESE

SEQ ID NO: 538897 - protein, 11 aa, Influenza virus
SQNILRTQESE

SEQ ID NO: 538898 - protein, 11 aa, Influenza virus
SQRGILEDEQM

SEQ ID NO: 538899 - protein, 11 aa, Influenza virus
SQRGVLEDEQM

SEQ ID NO: 538900 - protein, 11 aa, Influenza virus
SQSGRISFYWT

SEQ ID NO: 538901 - protein, 11 aa, Influenza virus
SQTATKRIRLA

SEQ ID NO: 538902 - protein, 11 aa, Influenza virus
SQTATKRIRMA

SEQ ID NO: 538903 - protein, 11 aa, Influenza virus
SQTATKRLRMA

SEQ ID NO: 538904 - protein, 11 aa, Influenza virus
SQVEQRINMLA

SEQ ID NO: 538905 - protein, 11 aa, Influenza virus
SQVERRINMLA

SEQ ID NO: 538906 - protein, 11 aa, Influenza virus
SQYICSPVLTD

SEQ ID NO: 538907 - protein, 11 aa, Influenza virus
SQYLCTGILTD

SEQ ID NO: 538908 - protein, 11 aa, Influenza virus
SQYLCTGVLTD

SEQ ID NO: 538909 - protein, 11 aa, Influenza virus
SQYRALISWPL

SEQ ID NO: 538910 - protein, 11 aa, Influenza virus
SQYRALISWPQ

SEQ ID NO: 538911 - protein, 11 aa, Influenza virus
SQYRALVSWPL

SEQ ID NO: 538912 - protein, 11 aa, Influenza virus
SQYREEALLNR

SEQ ID NO: 538913 - protein, 11 aa, Influenza virus
SQYRSLISWPL

SEQ ID NO: 538914 - protein, 11 aa, Influenza virus
SRADKICIGYL

SEQ ID NO: 538915 - protein, 11 aa, Influenza virus
SRAGYEMLKVP

SEQ ID NO: 538916 - protein, 11 aa, Influenza virus
SRARIDARIDF

SEQ ID NO: 538917 - protein, 11 aa, Influenza virus
SRARIDARVDF

SEQ ID NO: 538918 - protein, 11 aa, Influenza virus
SRARIDARVDS

SEQ ID NO: 538919 - protein, 11 aa, Influenza virus
SRARIKTRLFT

SEQ ID NO: 538920 - protein, 11 aa, Influenza virus
SRAVGKCPRYV

SEQ ID NO: 538921 - protein, 11 aa, Influenza virus
SRCRETRGLFG

SEQ ID NO: 538922 - protein, 11 aa, Influenza virus
SRCRKTRGLFG

SEQ ID NO: 538923 - protein, 11 aa, Influenza virus
SRDSRSGYETF

SEQ ID NO: 538924 - protein, 11 aa, Influenza virus
SRERLGSWSWH

SEQ ID NO: 538925 - protein, 11 aa, Influenza virus
SRFEAVAWSAT

SEQ ID NO: 538926 - protein, 11 aa, Influenza virus
SRFESVAWSAS

SEQ ID NO: 538927 - protein, 11 aa, Influenza virus
SRFESVAWSAT

SEQ ID NO: 538928 - protein, 11 aa, Influenza virus
SRGEVFVIREP

SEQ ID NO: 538929 - protein, 11 aa, Influenza virus
SRGHIFVIREP

SEQ ID NO: 538930 - protein, 11 aa, Influenza virus
SRGHVFVIREP

SEQ ID NO: 538931 - protein, 11 aa, Influenza virus
SRGLFGAIAGF

SEQ ID NO: 538932 - protein, 11 aa, Influenza virus
SRGLFGAKAGF

SEQ ID NO: 538933 - protein, 11 aa, Influenza virus
SRGYKMNIQIL

SEQ ID NO: 538934 - protein, 11 aa, Influenza virus
SRGYKMNNQIL

SEQ ID NO: 538935 - protein, 11 aa, Influenza virus
SRGYKMNTKIL

SEQ ID NO: 538936 - protein, 11 aa, Influenza virus
SRGYKMNTQIL

SEQ ID NO: 538937 - protein, 11 aa, Influenza virus
SRGYKMNTRIL

SEQ ID NO: 538938 - protein, 11 aa, Influenza virus
SRHCSKYHWNL

SEQ ID NO: 538939 - protein, 11 aa, Influenza virus
SRHHMGECPKY

SEQ ID NO: 538940 - protein, 11 aa, Influenza virus
SRHYIGKCPKY

SEQ ID NO: 538941 - protein, 11 aa, Influenza virus
SRHYMGECPEY

SEQ ID NO: 538942 - protein, 11 aa, Influenza virus
SRHYMGECPKY

SEQ ID NO: 538943 - protein, 11 aa, Influenza virus
SRHYMGECPNY

SEQ ID NO: 538944 - protein, 11 aa, Influenza virus
SRIAIGNCPKY

SEQ ID NO: 538945 - protein, 11 aa, Influenza virus
SRINGVKLEEN

SEQ ID NO: 538946 - protein, 11 aa, Influenza virus
SRISFYWTIVE

SEQ ID NO: 538947 - protein, 11 aa, Influenza virus
SRLNINPVKLS

SEQ ID NO: 538948 - protein, 11 aa, Influenza virus
SRLNRNEIKGI

SEQ ID NO: 538949 - protein, 11 aa, Influenza virus
SRLNRNEIKGV

SEQ ID NO: 538950 - protein, 11 aa, Influenza virus
SRLNWLTKATN

SEQ ID NO: 538951 - protein, 11 aa, Influenza virus
SRLNWLTKETN

SEQ ID NO: 538952 - protein, 11 aa, Influenza virus
SRMSICISGPN

SEQ ID NO: 538953 - protein, 11 aa, Influenza virus
SRMSICMSGPN

SEQ ID NO: 538954 - protein, 11 aa, Influenza virus
SRMSICVSGPN

SEQ ID NO: 538955 - protein, 11 aa, Influenza virus
SRMSVCMSGPN

SEQ ID NO: 538956 - protein, 11 aa, Influenza virus
SRNGFEMLKIP

SEQ ID NO: 538957 - protein, 11 aa, Influenza virus
SRNGKWREQLS

SEQ ID NO: 538958 - protein, 11 aa, Influenza virus
SRNPGNAEIED

SEQ ID NO: 538959 - protein, 11 aa, Influenza virus
SRPRVRNQSGR

SEQ ID NO: 538960 - protein, 11 aa, Influenza virus
SRRGFEMIWDP

SEQ ID NO: 538961 - protein, 11 aa, Influenza virus
SRRYELEIGTR

SEQ ID NO: 538962 - protein, 11 aa, Influenza virus
SRSGFEIIWDP

SEQ ID NO: 538963 - protein, 11 aa, Influenza virus
SRSGFEILLIE

SEQ ID NO: 538964 - protein, 11 aa, Influenza virus
SRSGFEMIWDA

SEQ ID NO: 538965 - protein, 11 aa, Influenza virus
SRSGFEMIWDP

SEQ ID NO: 538966 - protein, 11 aa, Influenza virus
SRSGFEMIWDS

SEQ ID NO: 538967 - protein, 11 aa, Influenza virus
SRSGFEMLKIH

SEQ ID NO: 538968 - protein, 11 aa, Influenza virus
SRSGFEMLKIP

SEQ ID NO: 538969 - protein, 11 aa, Influenza virus
SRSGFEMLKVP

SEQ ID NO: 538970 - protein, 11 aa, Influenza virus
SRSGFEMLRIP

SEQ ID NO: 538971 - protein, 11 aa, Influenza virus
SRSGFEMVWDA

SEQ ID NO: 538972 - protein, 11 aa, Influenza virus
SRSGFEMVWDD

SEQ ID NO: 538973 - protein, 11 aa, Influenza virus
SRSGFEMVWDP

SEQ ID NO: 538974 - protein, 11 aa, Influenza virus
SRSGFEVLFIE

SEQ ID NO: 538975 - protein, 11 aa, Influenza virus
SRSGFEVLKVP

SEQ ID NO: 538976 - protein, 11 aa, Influenza virus
SRSGFEVLLIE

SEQ ID NO: 538977 - protein, 11 aa, Influenza virus
SRSGYEILKVP

SEQ ID NO: 538978 - protein, 11 aa, Influenza virus
SRSGYEMLKVP

SEQ ID NO: 538979 - protein, 11 aa, Influenza virus
SRSGYETFKVI

SEQ ID NO: 538980 - protein, 11 aa, Influenza virus
SRSGYETFRII

SEQ ID NO: 538981 - protein, 11 aa, Influenza virus
SRSGYETFRVI

SEQ ID NO: 538982 - protein, 11 aa, Influenza virus
SRSGYETFRVL

SEQ ID NO: 538983 - protein, 11 aa, Influenza virus
SRSGYETFRVT

SEQ ID NO: 538984 - protein, 11 aa, Influenza virus
SRSGYEVLKVP

SEQ ID NO: 538985 - protein, 11 aa, Influenza virus
SRSIIFNMERI

SEQ ID NO: 538986 - protein, 11 aa, Influenza virus
SRSLKLAIGLR

SEQ ID NO: 538987 - protein, 11 aa, Influenza virus
SRSNIFNMERI

SEQ ID NO: 538988 - protein, 11 aa, Influenza virus
SRSPGNAEIED

SEQ ID NO: 538989 - protein, 11 aa, Influenza virus
SRSSCHDGKAW

SEQ ID NO: 538990 - protein, 11 aa, Influenza virus
SRSSFYAEMKW

SEQ ID NO: 538991 - protein, 11 aa, Influenza virus
SRTELINPNKW

SEQ ID NO: 538992 - protein, 11 aa, Influenza virus
SRTELINPSKW

SEQ ID NO: 538993 - protein, 11 aa, Influenza virus
SRTELIPPSKW

SEQ ID NO: 538994 - protein, 11 aa, Influenza virus
SRTELISPNKW

SEQ ID NO: 538995 - protein, 11 aa, Influenza virus
SRTELISPSKW

SEQ ID NO: 538996 - protein, 11 aa, Influenza virus
SRTHQYSEKGK

SEQ ID NO: 538997 - protein, 11 aa, Influenza virus
SRTREILTKIT

SEQ ID NO: 538998 - protein, 11 aa, Influenza virus
SRTREILTKTT

SEQ ID NO: 538999 - protein, 11 aa, Influenza virus
SRTREILTRTT

SEQ ID NO: 539000 - protein, 11 aa, Influenza virus
SRTRGILTKTT

SEQ ID NO: 539001 - protein, 11 aa, Influenza virus
SRVDNHSMSDI

SEQ ID NO: 539002 - protein, 11 aa, Influenza virus
SRYICSGLVGD

SEQ ID NO: 539003 - protein, 11 aa, Influenza virus
SRYSKADKICI

SEQ ID NO: 539004 - protein, 11 aa, Influenza virus
SRYVCSGLVGD

SEQ ID NO: 539005 - protein, 11 aa, Influenza virus
SRYVCTGILTD

SEQ ID NO: 539006 - protein, 11 aa, Influenza virus
SRYWAIRTRSG

SEQ ID NO: 539007 - protein, 11 aa, Influenza virus
SRYYMGECPKY

SEQ ID NO: 539008 - protein, 11 aa, Influenza virus
SSAASYKRIRL

SEQ ID NO: 539009 - protein, 11 aa, Influenza virus
SSAASYKRVRL

SEQ ID NO: 539010 - protein, 11 aa, Influenza virus
SSACLRGGRNS

SEQ ID NO: 539011 - protein, 11 aa, Influenza virus
SSAQEKNDLYG

SEQ ID NO: 539012 - protein, 11 aa, Influenza virus
SSASCHDGRAW

SEQ ID NO: 539013 - protein, 11 aa, Influenza virus
SSCAAMDDFQL

SEQ ID NO: 539014 - protein, 11 aa, Influenza virus
SSCFDGKEWLH

SEQ ID NO: 539015 - protein, 11 aa, Influenza virus
SSCFDGKEWMH

SEQ ID NO: 539016 - protein, 11 aa, Influenza virus
SSCFDGREWMH

SEQ ID NO: 539017 - protein, 11 aa, Influenza virus
SSCHDGKAWLH

SEQ ID NO: 539018 - protein, 11 aa, Influenza virus
SSCHDGKSWLH

SEQ ID NO: 539019 - protein, 11 aa, Influenza virus
SSCHDGNAWLH

SEQ ID NO: 539020 - protein, 11 aa, Influenza virus
SSCHDGRAWLH

SEQ ID NO: 539021 - protein, 11 aa, Influenza virus
SSCYDGKAWLH

SEQ ID NO: 539022 - protein, 11 aa, Influenza virus
SSDDFALILNA

SEQ ID NO: 539023 - protein, 11 aa, Influenza virus
SSDDFALIVNA

SEQ ID NO: 539024 - protein, 11 aa, Influenza virus
SSDICYPGKFT

SEQ ID NO: 539025 - protein, 11 aa, Influenza virus
SSDICYPGRFT

SEQ ID NO: 539026 - protein, 11 aa, Influenza virus
SSDNEQTDLYK

SEQ ID NO: 539027 - protein, 11 aa, Influenza virus
SSEVPEWSWDD

SEQ ID NO: 539028 - protein, 11 aa, Influenza virus
SSEVPGWSWDD

SEQ ID NO: 539029 - protein, 11 aa, Influenza virus
SSEVPGWSWGD

SEQ ID NO: 539030 - protein, 11 aa, Influenza virus
SSFEKFEIFPK

SEQ ID NO: 539031 - protein, 11 aa, Influenza virus
SSFEQITFMQA

SEQ ID NO: 539032 - protein, 11 aa, Influenza virus
SSFERFEIFPK

SEQ ID NO: 539033 - protein, 11 aa, Influenza virus
SSFERFEIFPN

SEQ ID NO: 539034 - protein, 11 aa, Influenza virus
SSFERFEMFPK

SEQ ID NO: 539035 - protein, 11 aa, Influenza virus
SSFFRNMVWLT

SEQ ID NO: 539036 - protein, 11 aa, Influenza virus
SSFKRFEIFPK

SEQ ID NO: 539037 - protein, 11 aa, Influenza virus
SSFSFGGFTFK

SEQ ID NO: 539038 - protein, 11 aa, Influenza virus
SSFYAEMEWLL

SEQ ID NO: 539039 - protein, 11 aa, Influenza virus
SSFYAEMKWLL

SEQ ID NO: 539040 - protein, 11 aa, Influenza virus
SSFYSEMKWLL

SEQ ID NO: 539041 - protein, 11 aa, Influenza virus
SSFYSEMKWLS

SEQ ID NO: 539042 - protein, 11 aa, Influenza virus
SSGGLLAPRYG

SEQ ID NO: 539043 - protein, 11 aa, Influenza virus
SSGIAIALGII

SEQ ID NO: 539044 - protein, 11 aa, Influenza virus
SSGIAIVLGII

SEQ ID NO: 539045 - protein, 11 aa, Influenza virus
SSGNCRFNVCI

SEQ ID NO: 539046 - protein, 11 aa, Influenza virus
SSGNCRFSVCI

SEQ ID NO: 539047 - protein, 11 aa, Influenza virus
SSGNNQVFPQL

SEQ ID NO: 539048 - protein, 11 aa, Influenza virus
SSGSLEFIAEQ

SEQ ID NO: 539049 - protein, 11 aa, Influenza virus
SSGSLKLAIGL

SEQ ID NO: 539050 - protein, 11 aa, Influenza virus
SSGTSKACNAL

SEQ ID NO: 539051 - protein, 11 aa, Influenza virus
SSGTSKACNAS

SEQ ID NO: 539052 - protein, 11 aa, Influenza virus
SSGTSKACSAS

SEQ ID NO: 539053 - protein, 11 aa, Influenza virus
SSGTVKDRSPF

SEQ ID NO: 539054 - protein, 11 aa, Influenza virus
SSGYKDIILWF

SEQ ID NO: 539055 - protein, 11 aa, Influenza virus
SSGYKDVIIWF

SEQ ID NO: 539056 - protein, 11 aa, Influenza virus
SSGYKDVILWF

SEQ ID NO: 539057 - protein, 11 aa, Influenza virus
SSGYKEVILWF

SEQ ID NO: 539058 - protein, 11 aa, Influenza virus
SSGYKNVILWF

SEQ ID NO: 539059 - protein, 11 aa, Influenza virus
SSIAFCGVDSD

SEQ ID NO: 539060 - protein, 11 aa, Influenza virus
SSIAFCGVNSD

SEQ ID NO: 539061 - protein, 11 aa, Influenza virus
SSIAFCGVNSN

SEQ ID NO: 539062 - protein, 11 aa, Influenza virus
SSIDLVETNHT

SEQ ID NO: 539063 - protein, 11 aa, Influenza virus
SSIGKVCRTLL

SEQ ID NO: 539064 - protein, 11 aa, Influenza virus
SSIKKYERVKM

SEQ ID NO: 539065 - protein, 11 aa, Influenza virus
SSIKRYERVKM

SEQ ID NO: 539066 - protein, 11 aa, Influenza virus
SSILTDSQTAT

SEQ ID NO: 539067 - protein, 11 aa, Influenza virus
SSIVLVGLILA

SEQ ID NO: 539068 - protein, 11 aa, Influenza virus
SSIVMVGLILA

SEQ ID NO: 539069 - protein, 11 aa, Influenza virus
SSIYIEVLHLT

SEQ ID NO: 539070 - protein, 11 aa, Influenza virus
SSKANQVFPQL

SEQ ID NO: 539071 - protein, 11 aa, Influenza virus
SSKCQQSFTPS

SEQ ID NO: 539072 - protein, 11 aa, Influenza virus
SSKDNQVFPQL

SEQ ID NO: 539073 - protein, 11 aa, Influenza virus
SSKPFQNASRH

SEQ ID NO: 539074 - protein, 11 aa, Influenza virus
SSKPFQNASRY

SEQ ID NO: 539075 - protein, 11 aa, Influenza virus
SSKPFQNTSRH

SEQ ID NO: 539076 - protein, 11 aa, Influenza virus
SSKPLQNASRH

SEQ ID NO: 539077 - protein, 11 aa, Influenza virus
SSKYQQSFSPS

SEQ ID NO: 539078 - protein, 11 aa, Influenza virus
SSKYQQSFTPS

SEQ ID NO: 539079 - protein, 11 aa, Influenza virus
SSKYRQSFSPS

SEQ ID NO: 539080 - protein, 11 aa, Influenza virus
SSLAVNVRGSG

SEQ ID NO: 539081 - protein, 11 aa, Influenza virus
SSLDEQNKLYG

SEQ ID NO: 539082 - protein, 11 aa, Influenza virus
SSLILAAIIMG

SEQ ID NO: 539083 - protein, 11 aa, Influenza virus
SSLILAALIMG

SEQ ID NO: 539084 - protein, 11 aa, Influenza virus
SSLLLQANLCR

SEQ ID NO: 539085 - protein, 11 aa, Influenza virus
SSLMWEINGPE

SEQ ID NO: 539086 - protein, 11 aa, Influenza virus
SSLPLALGMKN

SEQ ID NO: 539087 - protein, 11 aa, Influenza virus
SSLTHALRELW

SEQ ID NO: 539088 - protein, 11 aa, Influenza virus
SSLTKGVLGFV

SEQ ID NO: 539089 - protein, 11 aa, Influenza virus
SSLTVNVRGSG

SEQ ID NO: 539090 - protein, 11 aa, Influenza virus
SSLTVNVRGTG

SEQ ID NO: 539091 - protein, 11 aa, Influenza virus
SSLTVSVRGSG

SEQ ID NO: 539092 - protein, 11 aa, Influenza virus
SSLVLAAIIMG

SEQ ID NO: 539093 - protein, 11 aa, Influenza virus
SSLVLAALIMG

SEQ ID NO: 539094 - protein, 11 aa, Influenza virus
SSLVLAASIMG

SEQ ID NO: 539095 - protein, 11 aa, Influenza virus
SSLVLIVSLGA

SEQ ID NO: 539096 - protein, 11 aa, Influenza virus
SSLVLLFMIIG

SEQ ID NO: 539097 - protein, 11 aa, Influenza virus
SSLVLLLMIIG

SEQ ID NO: 539098 - protein, 11 aa, Influenza virus
SSLVLLVSLGA

SEQ ID NO: 539099 - protein, 11 aa, Influenza virus
SSLVLVVSLGA

SEQ ID NO: 539100 - protein, 11 aa, Influenza virus
SSMGEAMVSRA

SEQ ID NO: 539101 - protein, 11 aa, Influenza virus
SSMGIYQILAI

SEQ ID NO: 539102 - protein, 11 aa, Influenza virus
SSMGVYQILAI

SEQ ID NO: 539103 - protein, 11 aa, Influenza virus
SSMMEAMVSRA

SEQ ID NO: 539104 - protein, 11 aa, Influenza virus
SSMMWEINGPD

SEQ ID NO: 539105 - protein, 11 aa, Influenza virus
SSMMWEINGPE

SEQ ID NO: 539106 - protein, 11 aa, Influenza virus
SSMMWEVNGPE

SEQ ID NO: 539107 - protein, 11 aa, Influenza virus
SSMNNQVFPQL

SEQ ID NO: 539108 - protein, 11 aa, Influenza virus
SSMPFHNIHPF

SEQ ID NO: 539109 - protein, 11 aa, Influenza virus
SSMPFHNIHPL

SEQ ID NO: 539110 - protein, 11 aa, Influenza virus
SSMPFHNVHPL

SEQ ID NO: 539111 - protein, 11 aa, Influenza virus
SSMPLHNIHPL

SEQ ID NO: 539112 - protein, 11 aa, Influenza virus
SSMVEAMISRA

SEQ ID NO: 539113 - protein, 11 aa, Influenza virus
SSMVEAMMSRA

SEQ ID NO: 539114 - protein, 11 aa, Influenza virus
SSMVEAMVSRA

SEQ ID NO: 539115 - protein, 11 aa, Influenza virus
SSMVFCGVSGE

SEQ ID NO: 539116 - protein, 11 aa, Influenza virus
SSMYIEVLHLT

SEQ ID NO: 539117 - protein, 11 aa, Influenza virus
SSNGAFIAPDR

SEQ ID NO: 539118 - protein, 11 aa, Influenza virus
SSNYHQSFVPS

SEQ ID NO: 539119 - protein, 11 aa, Influenza virus
SSNYQQSFVPS

SEQ ID NO: 539120 - protein, 11 aa, Influenza virus
SSPMMWEINGP

SEQ ID NO: 539121 - protein, 11 aa, Influenza virus
SSPNAYQAKFE

SEQ ID NO: 539122 - protein, 11 aa, Influenza virus
SSPNAYQARFE

SEQ ID NO: 539123 - protein, 11 aa, Influenza virus
SSPQNILRTQE

SEQ ID NO: 539124 - protein, 11 aa, Influenza virus
SSQLEGFSAES

SEQ ID NO: 539125 - protein, 11 aa, Influenza virus
SSRHCSKYHWN

SEQ ID NO: 539126 - protein, 11 aa, Influenza virus
SSRISFYWTIV

SEQ ID NO: 539127 - protein, 11 aa, Influenza virus
SSRNGFEILLI

SEQ ID NO: 539128 - protein, 11 aa, Influenza virus
SSRPFQNASRH

SEQ ID NO: 539129 - protein, 11 aa, Influenza virus
SSRSGFEILLI

SEQ ID NO: 539130 - protein, 11 aa, Influenza virus
SSRSGFEVLLI

SEQ ID NO: 539131 - protein, 11 aa, Influenza virus
SSSACLRGGRN

SEQ ID NO: 539132 - protein, 11 aa, Influenza virus
SSSCFDGKEWL

SEQ ID NO: 539133 - protein, 11 aa, Influenza virus
SSSCFDGKEWM

SEQ ID NO: 539134 - protein, 11 aa, Influenza virus
SSSCFDGREWM

SEQ ID NO: 539135 - protein, 11 aa, Influenza virus
SSSCHDGKAWL

SEQ ID NO: 539136 - protein, 11 aa, Influenza virus
SSSCHDGKEWL

SEQ ID NO: 539137 - protein, 11 aa, Influenza virus
SSSCHDGKSWL

SEQ ID NO: 539138 - protein, 11 aa, Influenza virus
SSSCHDGNAWL

SEQ ID NO: 539139 - protein, 11 aa, Influenza virus
SSSCHDGRAWL

SEQ ID NO: 539140 - protein, 11 aa, Influenza virus
SSSCYDGKAWL

SEQ ID NO: 539141 - protein, 11 aa, Influenza virus
SSSFSFGGFTF

SEQ ID NO: 539142 - protein, 11 aa, Influenza virus
SSSFYAEMKWL

SEQ ID NO: 539143 - protein, 11 aa, Influenza virus
SSSGNNQVFPQ

SEQ ID NO: 539144 - protein, 11 aa, Influenza virus
SSSGTSKACNA

SEQ ID NO: 539145 - protein, 11 aa, Influenza virus
SSSIVMCGVDH

SEQ ID NO: 539146 - protein, 11 aa, Influenza virus
SSSIVMCGVDY

SEQ ID NO: 539147 - protein, 11 aa, Influenza virus
SSSIVMCGVEH

SEQ ID NO: 539148 - protein, 11 aa, Influenza virus
SSSIVMCGVNY

SEQ ID NO: 539149 - protein, 11 aa, Influenza virus
SSSLDEQNKLY

SEQ ID NO: 539150 - protein, 11 aa, Influenza virus
SSSLMWEINGP

SEQ ID NO: 539151 - protein, 11 aa, Influenza virus
SSSMMWEINGP

SEQ ID NO: 539152 - protein, 11 aa, Influenza virus
SSSMMWEVNGP

SEQ ID NO: 539153 - protein, 11 aa, Influenza virus
SSSMNNQVFPQ

SEQ ID NO: 539154 - protein, 11 aa, Influenza virus
SSSMPFHNIHP

SEQ ID NO: 539155 - protein, 11 aa, Influenza virus
SSSNAYQAKFE

SEQ ID NO: 539156 - protein, 11 aa, Influenza virus
SSSNCKDPNNE

SEQ ID NO: 539157 - protein, 11 aa, Influenza virus
SSSNCRDPNNE

SEQ ID NO: 539158 - protein, 11 aa, Influenza virus
SSSNCRDSNNE

SEQ ID NO: 539159 - protein, 11 aa, Influenza virus
SSSNCRNPNNE

SEQ ID NO: 539160 - protein, 11 aa, Influenza virus
SSSSCFDGKEW

SEQ ID NO: 539161 - protein, 11 aa, Influenza virus
SSSSCFDGREW

SEQ ID NO: 539162 - protein, 11 aa, Influenza virus
SSSSCHDGKAW

SEQ ID NO: 539163 - protein, 11 aa, Influenza virus
SSSSCHDGKSW

SEQ ID NO: 539164 - protein, 11 aa, Influenza virus
SSSSCHDGNAW

SEQ ID NO: 539165 - protein, 11 aa, Influenza virus
SSSSCHDGRAW

SEQ ID NO: 539166 - protein, 11 aa, Influenza virus
SSSSCYDGKAW

SEQ ID NO: 539167 - protein, 11 aa, Influenza virus
SSSSFYAEMKW

SEQ ID NO: 539168 - protein, 11 aa, Influenza virus
SSSSIVMCGVD

SEQ ID NO: 539169 - protein, 11 aa, Influenza virus
SSSSIVMCGVN

SEQ ID NO: 539170 - protein, 11 aa, Influenza virus
SSSSTVFCGVS

SEQ ID NO: 539171 - protein, 11 aa, Influenza virus
SSSSVVMCGVD

SEQ ID NO: 539172 - protein, 11 aa, Influenza virus
SSSTVFCGVSG

SEQ ID NO: 539173 - protein, 11 aa, Influenza virus
SSSTVFCGVSS

SEQ ID NO: 539174 - protein, 11 aa, Influenza virus
SSSVLLVSLGA

SEQ ID NO: 539175 - protein, 11 aa, Influenza virus
SSSVVMCGVDH

SEQ ID NO: 539176 - protein, 11 aa, Influenza virus
SSSYRRPIGIS

SEQ ID NO: 539177 - protein, 11 aa, Influenza virus
SSSYRRPVGIS

SEQ ID NO: 539178 - protein, 11 aa, Influenza virus
SSTEFLGQWDW

SEQ ID NO: 539179 - protein, 11 aa, Influenza virus
SSTEFLGQWNW

SEQ ID NO: 539180 - protein, 11 aa, Influenza virus
SSTKEKNDLYG

SEQ ID NO: 539181 - protein, 11 aa, Influenza virus
SSTKEKNELYG

SEQ ID NO: 539182 - protein, 11 aa, Influenza virus
SSTQEKNALYG

SEQ ID NO: 539183 - protein, 11 aa, Influenza virus
SSTQEKNDLYG

SEQ ID NO: 539184 - protein, 11 aa, Influenza virus
SSTSCFDGKEW

SEQ ID NO: 539185 - protein, 11 aa, Influenza virus
SSTSCHDGIGR

SEQ ID NO: 539186 - protein, 11 aa, Influenza virus
SSTSCHDGISR

SEQ ID NO: 539187 - protein, 11 aa, Influenza virus
SSTSCHDGKAR

SEQ ID NO: 539188 - protein, 11 aa, Influenza virus
SSTSCHDGKFR

SEQ ID NO: 539189 - protein, 11 aa, Influenza virus
SSTSCHDGKSR

SEQ ID NO: 539190 - protein, 11 aa, Influenza virus
SSTSCHDGKTR

SEQ ID NO: 539191 - protein, 11 aa, Influenza virus
SSTSCHDGMSR

SEQ ID NO: 539192 - protein, 11 aa, Influenza virus
SSTSCHDGRAR

SEQ ID NO: 539193 - protein, 11 aa, Influenza virus
SSTSCHDGRSR

SEQ ID NO: 539194 - protein, 11 aa, Influenza virus
SSTSCHDGVGR

SEQ ID NO: 539195 - protein, 11 aa, Influenza virus
SSTSCHDGVSR

SEQ ID NO: 539196 - protein, 11 aa, Influenza virus
SSTTCHDGIGR

SEQ ID NO: 539197 - protein, 11 aa, Influenza virus
SSTVFCGVSSE

SEQ ID NO: 539198 - protein, 11 aa, Influenza virus
SSTVLVGLILA

SEQ ID NO: 539199 - protein, 11 aa, Influenza virus
SSTVMVGLILA

SEQ ID NO: 539200 - protein, 11 aa, Influenza virus
SSTYHNSFVPV

SEQ ID NO: 539201 - protein, 11 aa, Influenza virus
SSTYQNNFVPV

SEQ ID NO: 539202 - protein, 11 aa, Influenza virus
SSTYQNSFVPV

SEQ ID NO: 539203 - protein, 11 aa, Influenza virus
SSVASSLVLLF

SEQ ID NO: 539204 - protein, 11 aa, Influenza virus
SSVASSLVLLL

SEQ ID NO: 539205 - protein, 11 aa, Influenza virus
SSVDLVETNHT

SEQ ID NO: 539206 - protein, 11 aa, Influenza virus
SSVNTNTINRS

SEQ ID NO: 539207 - protein, 11 aa, Influenza virus
SSVSSFEKFEI

SEQ ID NO: 539208 - protein, 11 aa, Influenza virus
SSVSSFERFEI

SEQ ID NO: 539209 - protein, 11 aa, Influenza virus
SSVSSFERFEM

SEQ ID NO: 539210 - protein, 11 aa, Influenza virus
SSVSSFKRFEI

SEQ ID NO: 539211 - protein, 11 aa, Influenza virus
SSVTTNTINRI

SEQ ID NO: 539212 - protein, 11 aa, Influenza virus
SSVTTNTINRS

SEQ ID NO: 539213 - protein, 11 aa, Influenza virus
SSVVLVGLILA

SEQ ID NO: 539214 - protein, 11 aa, Influenza virus
SSVYIEVLHLT

SEQ ID NO: 539215 - protein, 11 aa, Influenza virus
SSVYVEVLHLT

SEQ ID NO: 539216 - protein, 11 aa, Influenza virus
SSWHILSKDNA

SEQ ID NO: 539217 - protein, 11 aa, Influenza virus
SSYICSGLVGD

SEQ ID NO: 539218 - protein, 11 aa, Influenza virus
SSYLCSGLVGD

SEQ ID NO: 539219 - protein, 11 aa, Influenza virus
SSYMCSGLVGD

SEQ ID NO: 539220 - protein, 11 aa, Influenza virus
SSYRRPIGISS

SEQ ID NO: 539221 - protein, 11 aa, Influenza virus
SSYRRPVGISS

SEQ ID NO: 539222 - protein, 11 aa, Influenza virus
SSYVCSGLVGD

SEQ ID NO: 539223 - protein, 11 aa, Influenza virus
STAASSLALAI

SEQ ID NO: 539224 - protein, 11 aa, Influenza virus
STASRSGYEML

SEQ ID NO: 539225 - protein, 11 aa, Influenza virus
STASRSGYEVL

SEQ ID NO: 539226 - protein, 11 aa, Influenza virus
STAVAVIKYNG

SEQ ID NO: 539227 - protein, 11 aa, Influenza virus
STDKDSNGVQD

SEQ ID NO: 539228 - protein, 11 aa, Influenza virus
STDKNSNGVQD

SEQ ID NO: 539229 - protein, 11 aa, Influenza virus
STDKVDTIIEN

SEQ ID NO: 539230 - protein, 11 aa, Influenza virus
STDKVNTIIEN

SEQ ID NO: 539231 - protein, 11 aa, Influenza virus
STDSEMNKLYE

SEQ ID NO: 539232 - protein, 11 aa, Influenza virus
STDTVDTILEK

SEQ ID NO: 539233 - protein, 11 aa, Influenza virus
STDTVDTLIEQ

SEQ ID NO: 539234 - protein, 11 aa, Influenza virus
STDTVDTLLEK

SEQ ID NO: 539235 - protein, 11 aa, Influenza virus
STDTVDTVLEK

SEQ ID NO: 539236 - protein, 11 aa, Influenza virus
STDTVDTVLER

SEQ ID NO: 539237 - protein, 11 aa, Influenza virus
STDTVDTVREK

SEQ ID NO: 539238 - protein, 11 aa, Influenza virus
STDTVNTLIEQ

SEQ ID NO: 539239 - protein, 11 aa, Influenza virus
STDTVNTLMEQ

SEQ ID NO: 539240 - protein, 11 aa, Influenza virus
STDTVNTLTEQ

SEQ ID NO: 539241 - protein, 11 aa, Influenza virus
STECRTFFLTQ

SEQ ID NO: 539242 - protein, 11 aa, Influenza virus
STEFLGQWDWP

SEQ ID NO: 539243 - protein, 11 aa, Influenza virus
STEFLGQWNWP

SEQ ID NO: 539244 - protein, 11 aa, Influenza virus
STEKVDTIIES

SEQ ID NO: 539245 - protein, 11 aa, Influenza virus
STEKVNTIIES

SEQ ID NO: 539246 - protein, 11 aa, Influenza virus
STERVDTIIES

SEQ ID NO: 539247 - protein, 11 aa, Influenza virus
STETVNTLIEQ

SEQ ID NO: 539248 - protein, 11 aa, Influenza virus
STETVNTLSEQ

SEQ ID NO: 539249 - protein, 11 aa, Influenza virus
STETVNTLTEQ

SEQ ID NO: 539250 - protein, 11 aa, Influenza virus
STGALASCMGL

SEQ ID NO: 539251 - protein, 11 aa, Influenza virus
STGAQSFYRSI

SEQ ID NO: 539252 - protein, 11 aa, Influenza virus
STGGQAFYRSI

SEQ ID NO: 539253 - protein, 11 aa, Influenza virus
STGGQSFYRSI

SEQ ID NO: 539254 - protein, 11 aa, Influenza virus
STGKDPKKTGG

SEQ ID NO: 539255 - protein, 11 aa, Influenza virus
STGNFIAPEYA

SEQ ID NO: 539256 - protein, 11 aa, Influenza virus
STGNHGSLVLS

SEQ ID NO: 539257 - protein, 11 aa, Influenza virus
STGNLIAPEYG

SEQ ID NO: 539258 - protein, 11 aa, Influenza virus
STGNLIAPRGY

SEQ ID NO: 539259 - protein, 11 aa, Influenza virus
STGNLVAPEYG

SEQ ID NO: 539260 - protein, 11 aa, Influenza virus
STIALFIGVGN

SEQ ID NO: 539261 - protein, 11 aa, Influenza virus
STIALIIGVGN

SEQ ID NO: 539262 - protein, 11 aa, Influenza virus
STIALLIGIGN

SEQ ID NO: 539263 - protein, 11 aa, Influenza virus
STIALLIGVGN

SEQ ID NO: 539264 - protein, 11 aa, Influenza virus
STIGDCPKYVN

SEQ ID NO: 539265 - protein, 11 aa, Influenza virus
STKEWSKRYEL

SEQ ID NO: 539266 - protein, 11 aa, Influenza virus
STKEWSRRYEL

SEQ ID NO: 539267 - protein, 11 aa, Influenza virus
STKSTVLKSDK

SEQ ID NO: 539268 - protein, 11 aa, Influenza virus
STLGLDIRTAT

SEQ ID NO: 539269 - protein, 11 aa, Influenza virus
STLKLATGMRN

SEQ ID NO: 539270 - protein, 11 aa, Influenza virus
STLPRRSGAAG

SEQ ID NO: 539271 - protein, 11 aa, Influenza virus
STLVLLVSLGA

SEQ ID NO: 539272 - protein, 11 aa, Influenza virus
STMLNLYERVR

SEQ ID NO: 539273 - protein, 11 aa, Influenza virus
STNAHDRICIG

SEQ ID NO: 539274 - protein, 11 aa, Influenza virus
STNAYDRICIG

SEQ ID NO: 539275 - protein, 11 aa, Influenza virus
STNSSDKVDTL

SEQ ID NO: 539276 - protein, 11 aa, Influenza virus
STNSSEKVDTL

SEQ ID NO: 539277 - protein, 11 aa, Influenza virus
STNSSEKVNTL

SEQ ID NO: 539278 - protein, 11 aa, Influenza virus
STNSSERVDTL

SEQ ID NO: 539279 - protein, 11 aa, Influenza virus
STNSTEKVDTL

SEQ ID NO: 539280 - protein, 11 aa, Influenza virus
STNTVNTLIEQ

SEQ ID NO: 539281 - protein, 11 aa, Influenza virus
STPLGSPPIVS

SEQ ID NO: 539282 - protein, 11 aa, Influenza virus
STPLGSPPMVS

SEQ ID NO: 539283 - protein, 11 aa, Influenza virus
STPLGSPPVVS

SEQ ID NO: 539284 - protein, 11 aa, Influenza virus
STPLGTPPTVS

SEQ ID NO: 539285 - protein, 11 aa, Influenza virus
STPSAIDQITG

SEQ ID NO: 539286 - protein, 11 aa, Influenza virus
STQAAIDQING

SEQ ID NO: 539287 - protein, 11 aa, Influenza virus
STQAAIDQITG

SEQ ID NO: 539288 - protein, 11 aa, Influenza virus
STQAAIDQMTG

SEQ ID NO: 539289 - protein, 11 aa, Influenza virus
STQAAVDQITG

SEQ ID NO: 539290 - protein, 11 aa, Influenza virus
STQEAIDKITN

SEQ ID NO: 539291 - protein, 11 aa, Influenza virus
STQEAIEKITN

SEQ ID NO: 539292 - protein, 11 aa, Influenza virus
STQEAIGKITN

SEQ ID NO: 539293 - protein, 11 aa, Influenza virus
STQEAINKITN

SEQ ID NO: 539294 - protein, 11 aa, Influenza virus
STQKAIDEITT

SEQ ID NO: 539295 - protein, 11 aa, Influenza virus
STQKAIDGITN

SEQ ID NO: 539296 - protein, 11 aa, Influenza virus
STQKAIDGVTN

SEQ ID NO: 539297 - protein, 11 aa, Influenza virus
STQKAIDIMQN

SEQ ID NO: 539298 - protein, 11 aa, Influenza virus
STQKAIDNMQN

SEQ ID NO: 539299 - protein, 11 aa, Influenza virus
STQKAIDQITT

SEQ ID NO: 539300 - protein, 11 aa, Influenza virus
STQKAIDRITT

SEQ ID NO: 539301 - protein, 11 aa, Influenza virus
STQKAINEITT

SEQ ID NO: 539302 - protein, 11 aa, Influenza virus
STQKAINGVTN

SEQ ID NO: 539303 - protein, 11 aa, Influenza virus
STQKALNEITT

SEQ ID NO: 539304 - protein, 11 aa, Influenza virus
STQKAMDGVTN

SEQ ID NO: 539305 - protein, 11 aa, Influenza virus
STQKTIDQVTG

SEQ ID NO: 539306 - protein, 11 aa, Influenza virus
STQMAIDNMQN

SEQ ID NO: 539307 - protein, 11 aa, Influenza virus
STQPTFSVQRN

SEQ ID NO: 539308 - protein, 11 aa, Influenza virus
STQRAIDGVTN

SEQ ID NO: 539309 - protein, 11 aa, Influenza virus
STQRAIDNMQN

SEQ ID NO: 539310 - protein, 11 aa, Influenza virus
STQSAIDQITG

SEQ ID NO: 539311 - protein, 11 aa, Influenza virus
STQSAIDQITR

SEQ ID NO: 539312 - protein, 11 aa, Influenza virus
STQSAIDQVTG

SEQ ID NO: 539313 - protein, 11 aa, Influenza virus
STQSAINQITG

SEQ ID NO: 539314 - protein, 11 aa, Influenza virus
STQSAVDQITG

SEQ ID NO: 539315 - protein, 11 aa, Influenza virus
STQSAVNQITG

SEQ ID NO: 539316 - protein, 11 aa, Influenza virus
STRGIQIASNE

SEQ ID NO: 539317 - protein, 11 aa, Influenza virus
STRGVQIASNE

SEQ ID NO: 539318 - protein, 11 aa, Influenza virus
STRGVQVASNE

SEQ ID NO: 539319 - protein, 11 aa, Influenza virus
STRSDQISIVP

SEQ ID NO: 539320 - protein, 11 aa, Influenza virus
STRSRSGFEML

SEQ ID NO: 539321 - protein, 11 aa, Influenza virus
STSCFDGKEWM

SEQ ID NO: 539322 - protein, 11 aa, Influenza virus
STSCHDGIGRM

SEQ ID NO: 539323 - protein, 11 aa, Influenza virus
STSCHDGISRM

SEQ ID NO: 539324 - protein, 11 aa, Influenza virus
STSCHDGKARM

SEQ ID NO: 539325 - protein, 11 aa, Influenza virus
STSCHDGKFRM

SEQ ID NO: 539326 - protein, 11 aa, Influenza virus
STSCHDGKSRM

SEQ ID NO: 539327 - protein, 11 aa, Influenza virus
STSCHDGKTRM

SEQ ID NO: 539328 - protein, 11 aa, Influenza virus
STSCHDGMSRM

SEQ ID NO: 539329 - protein, 11 aa, Influenza virus
STSCHDGRARM

SEQ ID NO: 539330 - protein, 11 aa, Influenza virus
STSCHDGRSRM

SEQ ID NO: 539331 - protein, 11 aa, Influenza virus
STSCHDGVGRM

SEQ ID NO: 539332 - protein, 11 aa, Influenza virus
STSCHDGVSRM

SEQ ID NO: 539333 - protein, 11 aa, Influenza virus
STTAKAMEQMA

SEQ ID NO: 539334 - protein, 11 aa, Influenza virus
STTAKAMEQVA

SEQ ID NO: 539335 - protein, 11 aa, Influenza virus
STTCHDGIGRM

SEQ ID NO: 539336 - protein, 11 aa, Influenza virus
STTFPYTGDPP

SEQ ID NO: 539337 - protein, 11 aa, Influenza virus
STTHDRTAFRG

SEQ ID NO: 539338 - protein, 11 aa, Influenza virus
STVAASLCLAI

SEQ ID NO: 539339 - protein, 11 aa, Influenza virus
STVAASLCLAV

SEQ ID NO: 539340 - protein, 11 aa, Influenza virus
STVASSLALAI

SEQ ID NO: 539341 - protein, 11 aa, Influenza virus
STVASSLTLAI

SEQ ID NO: 539342 - protein, 11 aa, Influenza virus
STVASSLVLAI

SEQ ID NO: 539343 - protein, 11 aa, Influenza virus
STVFCGVSGEV

SEQ ID NO: 539344 - protein, 11 aa, Influenza virus
STVFCGVSSEV

SEQ ID NO: 539345 - protein, 11 aa, Influenza virus
STVLGVSILNL

SEQ ID NO: 539346 - protein, 11 aa, Influenza virus
STVLGVSVLNL

SEQ ID NO: 539347 - protein, 11 aa, Influenza virus
STVLKSDKRIG

SEQ ID NO: 539348 - protein, 11 aa, Influenza virus
STVLVGLILAF

SEQ ID NO: 539349 - protein, 11 aa, Influenza virus
STVMVGLILAF

SEQ ID NO: 539350 - protein, 11 aa, Influenza virus
STVNEEALRQK

SEQ ID NO: 539351 - protein, 11 aa, Influenza virus
STVSSFERFEI

SEQ ID NO: 539352 - protein, 11 aa, Influenza virus
STVSSGLVLVG

SEQ ID NO: 539353 - protein, 11 aa, Influenza virus
STVSSSLVLAG

SEQ ID NO: 539354 - protein, 11 aa, Influenza virus
STVSSSLVLVG

SEQ ID NO: 539355 - protein, 11 aa, Influenza virus
STVVNNITTTI

SEQ ID NO: 539356 - protein, 11 aa, Influenza virus
STVVSSLALAI

SEQ ID NO: 539357 - protein, 11 aa, Influenza virus
STWLGRTISPR

SEQ ID NO: 539358 - protein, 11 aa, Influenza virus
STYHNSFVPVV

SEQ ID NO: 539359 - protein, 11 aa, Influenza virus
STYKILSIYSS

SEQ ID NO: 539360 - protein, 11 aa, Influenza virus
STYQNNFVPVI

SEQ ID NO: 539361 - protein, 11 aa, Influenza virus
STYQNNFVPVM

SEQ ID NO: 539362 - protein, 11 aa, Influenza virus
STYQNNFVPVV

SEQ ID NO: 539363 - protein, 11 aa, Influenza virus
STYQNSFVPVV

SEQ ID NO: 539364 - protein, 11 aa, Influenza virus
SVAGWLLGNPL

SEQ ID NO: 539365 - protein, 11 aa, Influenza virus
SVAGWLLGNPM

SEQ ID NO: 539366 - protein, 11 aa, Influenza virus
SVAHKSCLPAC

SEQ ID NO: 539367 - protein, 11 aa, Influenza virus
SVAPIMFSNKM

SEQ ID NO: 539368 - protein, 11 aa, Influenza virus
SVASSLVLLFM

SEQ ID NO: 539369 - protein, 11 aa, Influenza virus
SVASSLVLLLM

SEQ ID NO: 539370 - protein, 11 aa, Influenza virus
SVAWSASACHD

SEQ ID NO: 539371 - protein, 11 aa, Influenza virus
SVAWSATACHD

SEQ ID NO: 539372 - protein, 11 aa, Influenza virus
SVAWSATACSD

SEQ ID NO: 539373 - protein, 11 aa, Influenza virus
SVCISGPNNNA

SEQ ID NO: 539374 - protein, 11 aa, Influenza virus
SVCMSGPNNNA

SEQ ID NO: 539375 - protein, 11 aa, Influenza virus
SVCYNPCFYVE

SEQ ID NO: 539376 - protein, 11 aa, Influenza virus
SVDLVETNHTG

SEQ ID NO: 539377 - protein, 11 aa, Influenza virus
SVEGWVVIAKD

SEQ ID NO: 539378 - protein, 11 aa, Influenza virus
SVENLEELRFV

SEQ ID NO: 539379 - protein, 11 aa, Influenza virus
SVENQEELRSL

SEQ ID NO: 539380 - protein, 11 aa, Influenza virus
SVEPKGLFGAI

SEQ ID NO: 539381 - protein, 11 aa, Influenza virus
SVEPRGLFGAI

SEQ ID NO: 539382 - protein, 11 aa, Influenza virus
SVESSTYQNNF

SEQ ID NO: 539383 - protein, 11 aa, Influenza virus
SVEWSATACHD

SEQ ID NO: 539384 - protein, 11 aa, Influenza virus
SVEYASKTRIS

SEQ ID NO: 539385 - protein, 11 aa, Influenza virus
SVGGIDTNKTF

SEQ ID NO: 539386 - protein, 11 aa, Influenza virus
SVGGINTNKTF

SEQ ID NO: 539387 - protein, 11 aa, Influenza virus
SVGGINTNRTF

SEQ ID NO: 539388 - protein, 11 aa, Influenza virus
SVGSGSFPDGA

SEQ ID NO: 539389 - protein, 11 aa, Influenza virus
SVGSSTYHNSF

SEQ ID NO: 539390 - protein, 11 aa, Influenza virus
SVGSSTYQNNF

SEQ ID NO: 539391 - protein, 11 aa, Influenza virus
SVGSSTYQNSF

SEQ ID NO: 539392 - protein, 11 aa, Influenza virus
SVGTSTLNLRL

SEQ ID NO: 539393 - protein, 11 aa, Influenza virus
SVGTSTLNQRL

SEQ ID NO: 539394 - protein, 11 aa, Influenza virus
SVGTSTLNQRM

SEQ ID NO: 539395 - protein, 11 aa, Influenza virus
SVGTSTLNQRS

SEQ ID NO: 539396 - protein, 11 aa, Influenza virus
SVGWSATACHD

SEQ ID NO: 539397 - protein, 11 aa, Influenza virus
SVHRNTIGDCP

SEQ ID NO: 539398 - protein, 11 aa, Influenza virus
SVIEKMNIQFT

SEQ ID NO: 539399 - protein, 11 aa, Influenza virus
SVIEKMNTQFT

SEQ ID NO: 539400 - protein, 11 aa, Influenza virus
SVIPSGPLKAE

SEQ ID NO: 539401 - protein, 11 aa, Influenza virus
SVIREPFISCS

SEQ ID NO: 539402 - protein, 11 aa, Influenza virus
SVKLSSGYKDI

SEQ ID NO: 539403 - protein, 11 aa, Influenza virus
SVKMEKIVLLL

SEQ ID NO: 539404 - protein, 11 aa, Influenza virus
SVKNGTYDYPK

SEQ ID NO: 539405 - protein, 11 aa, Influenza virus
SVKNGTYNYPK

SEQ ID NO: 539406 - protein, 11 aa, Influenza virus
SVKTLTDNHVE

SEQ ID NO: 539407 - protein, 11 aa, Influenza virus
SVLINTYQWII

SEQ ID NO: 539408 - protein, 11 aa, Influenza virus
SVLNLLIGISN

SEQ ID NO: 539409 - protein, 11 aa, Influenza virus
SVLNLLIGVSN

SEQ ID NO: 539410 - protein, 11 aa, Influenza virus
SVLVNTYQWII

SEQ ID NO: 539411 - protein, 11 aa, Influenza virus
SVLVNTYQWVI

SEQ ID NO: 539412 - protein, 11 aa, Influenza virus
SVNTNTINRSF

SEQ ID NO: 539413 - protein, 11 aa, Influenza virus
SVPASRYLIDM

SEQ ID NO: 539414 - protein, 11 aa, Influenza virus
SVPASRYLTDM

SEQ ID NO: 539415 - protein, 11 aa, Influenza virus
SVPLGSSPNAY

SEQ ID NO: 539416 - protein, 11 aa, Influenza virus
SVPLGSSSNAY

SEQ ID NO: 539417 - protein, 11 aa, Influenza virus
SVPMGSSPNAY

SEQ ID NO: 539418 - protein, 11 aa, Influenza virus
SVQPAFSVQRN

SEQ ID NO: 539419 - protein, 11 aa, Influenza virus
SVQPTFSVQRN

SEQ ID NO: 539420 - protein, 11 aa, Influenza virus
SVQPTFSVQRS

SEQ ID NO: 539421 - protein, 11 aa, Influenza virus
SVQSRGLFGAI

SEQ ID NO: 539422 - protein, 11 aa, Influenza virus
SVRIGSKGDVF

SEQ ID NO: 539423 - protein, 11 aa, Influenza virus
SVRLSAGGDIW

SEQ ID NO: 539424 - protein, 11 aa, Influenza virus
SVRLSASGDIW

SEQ ID NO: 539425 - protein, 11 aa, Influenza virus
SVRNGTYDYPK

SEQ ID NO: 539426 - protein, 11 aa, Influenza virus
SVSECRTFFLT

SEQ ID NO: 539427 - protein, 11 aa, Influenza virus
SVSGWLLGNPM

SEQ ID NO: 539428 - protein, 11 aa, Influenza virus
SVSSFEKFEIF

SEQ ID NO: 539429 - protein, 11 aa, Influenza virus
SVSSFERFEIF

SEQ ID NO: 539430 - protein, 11 aa, Influenza virus
SVSSFERFEMF

SEQ ID NO: 539431 - protein, 11 aa, Influenza virus
SVSSFKRFEIF

SEQ ID NO: 539432 - protein, 11 aa, Influenza virus
SVTELWSYNAE

SEQ ID NO: 539433 - protein, 11 aa, Influenza virus
SVTQTLVSNND

SEQ ID NO: 539434 - protein, 11 aa, Influenza virus
SVTTNTINRIF

SEQ ID NO: 539435 - protein, 11 aa, Influenza virus
SVTTNTINRNF

SEQ ID NO: 539436 - protein, 11 aa, Influenza virus
SVTTNTINRSF

SEQ ID NO: 539437 - protein, 11 aa, Influenza virus
SVVEKMNTQFT

SEQ ID NO: 539438 - protein, 11 aa, Influenza virus
SVVLVGLILAF

SEQ ID NO: 539439 - protein, 11 aa, Influenza virus
SVYIEVLHLTQ

SEQ ID NO: 539440 - protein, 11 aa, Influenza virus
SVYKALSIYSC

SEQ ID NO: 539441 - protein, 11 aa, Influenza virus
SVYVEVLHLTQ

SEQ ID NO: 539442 - protein, 11 aa, Influenza virus
SVYWTIVKPGD

SEQ ID NO: 539443 - protein, 11 aa, Influenza virus
SVYWTVVKPGD

SEQ ID NO: 539444 - protein, 11 aa, Influenza virus
SWAGNILRTQE

SEQ ID NO: 539445 - protein, 11 aa, Influenza virus
SWASNSIVTFC

SEQ ID NO: 539446 - protein, 11 aa, Influenza virus
SWAVGRCPRYV

SEQ ID NO: 539447 - protein, 11 aa, Influenza virus
SWDDGAILPFD

SEQ ID NO: 539448 - protein, 11 aa, Influenza virus
SWDDGAILPLT

SEQ ID NO: 539449 - protein, 11 aa, Influenza virus
SWEGNILRTQE

SEQ ID NO: 539450 - protein, 11 aa, Influenza virus
SWEMGLAPSPY

SEQ ID NO: 539451 - protein, 11 aa, Influenza virus
SWEMGQAPSPY

SEQ ID NO: 539452 - protein, 11 aa, Influenza virus
SWGDGAILPFD

SEQ ID NO: 539453 - protein, 11 aa, Influenza virus
SWGMGQAPSPY

SEQ ID NO: 539454 - protein, 11 aa, Influenza virus
SWHDGAEIIYF

SEQ ID NO: 539455 - protein, 11 aa, Influenza virus
SWHDGAEITYF

SEQ ID NO: 539456 - protein, 11 aa, Influenza virus
SWHIFGKDNAI

SEQ ID NO: 539457 - protein, 11 aa, Influenza virus
SWHIFGKDNAV

SEQ ID NO: 539458 - protein, 11 aa, Influenza virus
SWHIFSKDNAI

SEQ ID NO: 539459 - protein, 11 aa, Influenza virus
SWHILSKDNAI

SEQ ID NO: 539460 - protein, 11 aa, Influenza virus
SWHILSKDNAV

SEQ ID NO: 539461 - protein, 11 aa, Influenza virus
SWHIYGKDNAI

SEQ ID NO: 539462 - protein, 11 aa, Influenza virus
SWHIYGKDNAV

SEQ ID NO: 539463 - protein, 11 aa, Influenza virus
SWIPKRNRSIL

SEQ ID NO: 539464 - protein, 11 aa, Influenza virus
SWKGNIMRTQE

SEQ ID NO: 539465 - protein, 11 aa, Influenza virus
SWKKQILRTQE

SEQ ID NO: 539466 - protein, 11 aa, Influenza virus
SWLGRTISKDL

SEQ ID NO: 539467 - protein, 11 aa, Influenza virus
SWLGRTISKDS

SEQ ID NO: 539468 - protein, 11 aa, Influenza virus
SWLGRTISKDT

SEQ ID NO: 539469 - protein, 11 aa, Influenza virus
SWLGRTTSKDS

SEQ ID NO: 539470 - protein, 11 aa, Influenza virus
SWLTIGISGPD

SEQ ID NO: 539471 - protein, 11 aa, Influenza virus
SWLTIGVSGPD

SEQ ID NO: 539472 - protein, 11 aa, Influenza virus
SWMKIYWHLMH

SEQ ID NO: 539473 - protein, 11 aa, Influenza virus
SWMKLYWHLMH

SEQ ID NO: 539474 - protein, 11 aa, Influenza virus
SWMKLYWHLMR

SEQ ID NO: 539475 - protein, 11 aa, Influenza virus
SWMKLYWHLMS

SEQ ID NO: 539476 - protein, 11 aa, Influenza virus
SWPDGADINFM

SEQ ID NO: 539477 - protein, 11 aa, Influenza virus
SWPDGALFPLT

SEQ ID NO: 539478 - protein, 11 aa, Influenza virus
SWPDGALLPFD

SEQ ID NO: 539479 - protein, 11 aa, Influenza virus
SWPDGALLPLT

SEQ ID NO: 539480 - protein, 11 aa, Influenza virus
SWPDGANIDFM

SEQ ID NO: 539481 - protein, 11 aa, Influenza virus
SWPDGANIDFV

SEQ ID NO: 539482 - protein, 11 aa, Influenza virus
SWPDGANINFM

SEQ ID NO: 539483 - protein, 11 aa, Influenza virus
SWPDGANINLM

SEQ ID NO: 539484 - protein, 11 aa, Influenza virus
SWPDGANISFM

SEQ ID NO: 539485 - protein, 11 aa, Influenza virus
SWPLSSPPTVY

SEQ ID NO: 539486 - protein, 11 aa, Influenza virus
SWPQSSPPTVY

SEQ ID NO: 539487 - protein, 11 aa, Influenza virus
SWRKDILRTQE

SEQ ID NO: 539488 - protein, 11 aa, Influenza virus
SWRKKILRTQE

SEQ ID NO: 539489 - protein, 11 aa, Influenza virus
SWRKQILRTQE

SEQ ID NO: 539490 - protein, 11 aa, Influenza virus
SWRRDILRTQE

SEQ ID NO: 539491 - protein, 11 aa, Influenza virus
SWRRQILRTQE

SEQ ID NO: 539492 - protein, 11 aa, Influenza virus
SWSGYSGIFSV

SEQ ID NO: 539493 - protein, 11 aa, Influenza virus
SWSHNILRTQE

SEQ ID NO: 539494 - protein, 11 aa, Influenza virus
SWSKNILRTQE

SEQ ID NO: 539495 - protein, 11 aa, Influenza virus
SWSQNILRTQE

SEQ ID NO: 539496 - protein, 11 aa, Influenza virus
SWSWHDGAEII

SEQ ID NO: 539497 - protein, 11 aa, Influenza virus
SWSWHDGAEIT

SEQ ID NO: 539498 - protein, 11 aa, Influenza virus
SWSWHDGAILP

SEQ ID NO: 539499 - protein, 11 aa, Influenza virus
SWSWHDGAVLP

SEQ ID NO: 539500 - protein, 11 aa, Influenza virus
SWSWPDGALLP

SEQ ID NO: 539501 - protein, 11 aa, Influenza virus
SWSYIVEKLNP

SEQ ID NO: 539502 - protein, 11 aa, Influenza virus
SWSYIVEKPNP

SEQ ID NO: 539503 - protein, 11 aa, Influenza virus
SWSYIVEKTNP

SEQ ID NO: 539504 - protein, 11 aa, Influenza virus
SWSYIVERPNP

SEQ ID NO: 539505 - protein, 11 aa, Influenza virus
SWSYIVERPSA

SEQ ID NO: 539506 - protein, 11 aa, Influenza virus
SWTPKRNRSIL

SEQ ID NO: 539507 - protein, 11 aa, Influenza virus
SWTSNSIITFC

SEQ ID NO: 539508 - protein, 11 aa, Influenza virus
SWTSNSIVTFC

SEQ ID NO: 539509 - protein, 11 aa, Influenza virus
SWTSNSMVTFC

SEQ ID NO: 539510 - protein, 11 aa, Influenza virus
SWVPILNTSQR

SEQ ID NO: 539511 - protein, 11 aa, Influenza virus
SWVPKRNRSIL

SEQ ID NO: 539512 - protein, 11 aa, Influenza virus
SYCRATEYIMK

SEQ ID NO: 539513 - protein, 11 aa, Influenza virus
SYFANLKGTRT

SEQ ID NO: 539514 - protein, 11 aa, Influenza virus
SYFFGDNAEEF

SEQ ID NO: 539515 - protein, 11 aa, Influenza virus
SYFFGDNAEEY

SEQ ID NO: 539516 - protein, 11 aa, Influenza virus
SYFFGDNAKEY

SEQ ID NO: 539517 - protein, 11 aa, Influenza virus
SYFFGDSAEEY

SEQ ID NO: 539518 - protein, 11 aa, Influenza virus
SYFQLFLVCVS

SEQ ID NO: 539519 - protein, 11 aa, Influenza virus
SYGRIIQNEDI

SEQ ID NO: 539520 - protein, 11 aa, Influenza virus
SYICSGLVGDT

SEQ ID NO: 539521 - protein, 11 aa, Influenza virus
SYIIRALTLNT

SEQ ID NO: 539522 - protein, 11 aa, Influenza virus
SYINKTGTFEF

SEQ ID NO: 539523 - protein, 11 aa, Influenza virus
SYINRTGTFEF

SEQ ID NO: 539524 - protein, 11 aa, Influenza virus
SYIVERPKEIE

SEQ ID NO: 539525 - protein, 11 aa, Influenza virus
SYIVERPKEME

SEQ ID NO: 539526 - protein, 11 aa, Influenza virus
SYIVERPSAPE

SEQ ID NO: 539527 - protein, 11 aa, Influenza virus
SYIVERTKEME

SEQ ID NO: 539528 - protein, 11 aa, Influenza virus
SYKILSIYSTV

SEQ ID NO: 539529 - protein, 11 aa, Influenza virus
SYKRIRLFDYS

SEQ ID NO: 539530 - protein, 11 aa, Influenza virus
SYKRVRLFDYS

SEQ ID NO: 539531 - protein, 11 aa, Influenza virus
SYLCSGLVGDT

SEQ ID NO: 539532 - protein, 11 aa, Influenza virus
SYLECRTFFLT

SEQ ID NO: 539533 - protein, 11 aa, Influenza virus
SYLIEDPAAPH

SEQ ID NO: 539534 - protein, 11 aa, Influenza virus
SYLIEDPGAPH

SEQ ID NO: 539535 - protein, 11 aa, Influenza virus
SYLIEDPNAPH

SEQ ID NO: 539536 - protein, 11 aa, Influenza virus
SYLIEDPNAPN

SEQ ID NO: 539537 - protein, 11 aa, Influenza virus
SYLIEDPSAPH

SEQ ID NO: 539538 - protein, 11 aa, Influenza virus
SYLIEDPTAPH

SEQ ID NO: 539539 - protein, 11 aa, Influenza virus
SYLIRALTLNT

SEQ ID NO: 539540 - protein, 11 aa, Influenza virus
SYLIRTLTLNT

SEQ ID NO: 539541 - protein, 11 aa, Influenza virus
SYLLLNKSLCN

SEQ ID NO: 539542 - protein, 11 aa, Influenza virus
SYLNVRCVCRD

SEQ ID NO: 539543 - protein, 11 aa, Influenza virus
SYMCSGLVGDT

SEQ ID NO: 539544 - protein, 11 aa, Influenza virus
SYNADLLVAME

SEQ ID NO: 539545 - protein, 11 aa, Influenza virus
SYNADVLVALE

SEQ ID NO: 539546 - protein, 11 aa, Influenza virus
SYNAEFLVALE

SEQ ID NO: 539547 - protein, 11 aa, Influenza virus
SYNAEFLVAME

SEQ ID NO: 539548 - protein, 11 aa, Influenza virus
SYNAEFLVAVE

SEQ ID NO: 539549 - protein, 11 aa, Influenza virus
SYNAEILVALE

SEQ ID NO: 539550 - protein, 11 aa, Influenza virus
SYNAELLIALE

SEQ ID NO: 539551 - protein, 11 aa, Influenza virus
SYNAELLIAME

SEQ ID NO: 539552 - protein, 11 aa, Influenza virus
SYNAELLVAIE

SEQ ID NO: 539553 - protein, 11 aa, Influenza virus
SYNAELLVALE

SEQ ID NO: 539554 - protein, 11 aa, Influenza virus
SYNAELLVAME

SEQ ID NO: 539555 - protein, 11 aa, Influenza virus
SYNAELLVLME

SEQ ID NO: 539556 - protein, 11 aa, Influenza virus
SYNAGLLVALE

SEQ ID NO: 539557 - protein, 11 aa, Influenza virus
SYNAKLLVLIE

SEQ ID NO: 539558 - protein, 11 aa, Influenza virus
SYNAKLLVLLE

SEQ ID NO: 539559 - protein, 11 aa, Influenza virus
SYNAQLLVLLE

SEQ ID NO: 539560 - protein, 11 aa, Influenza virus
SYNAQLLVWLE

SEQ ID NO: 539561 - protein, 11 aa, Influenza virus
SYNARLLVLLE

SEQ ID NO: 539562 - protein, 11 aa, Influenza virus
SYNNTNGEQIL

SEQ ID NO: 539563 - protein, 11 aa, Influenza virus
SYNNTSGEQIL

SEQ ID NO: 539564 - protein, 11 aa, Influenza virus
SYNNTSGEQML

SEQ ID NO: 539565 - protein, 11 aa, Influenza virus
SYNNTSGEQVL

SEQ ID NO: 539566 - protein, 11 aa, Influenza virus
SYNNTSGKQML

SEQ ID NO: 539567 - protein, 11 aa, Influenza virus
SYPNVRCVCRD

SEQ ID NO: 539568 - protein, 11 aa, Influenza virus
SYRRPIGISSM

SEQ ID NO: 539569 - protein, 11 aa, Influenza virus
SYRRPVGISSM

SEQ ID NO: 539570 - protein, 11 aa, Influenza virus
SYRSLIRFPIG

SEQ ID NO: 539571 - protein, 11 aa, Influenza virus
SYRTLLMNELG

SEQ ID NO: 539572 - protein, 11 aa, Influenza virus
SYRTLLMSELG

SEQ ID NO: 539573 - protein, 11 aa, Influenza virus
SYSAGALASCM

SEQ ID NO: 539574 - protein, 11 aa, Influenza virus
SYSTGALASCM

SEQ ID NO: 539575 - protein, 11 aa, Influenza virus
SYVCSGLVGDT

SEQ ID NO: 539576 - protein, 11 aa, Influenza virus
SYVRLYLWGVH

SEQ ID NO: 539577 - protein, 11 aa, Influenza virus
SYWWDGLQSSD

SEQ ID NO: 539578 - protein, 11 aa, Influenza virus
TAADLKSTQAA

SEQ ID NO: 539579 - protein, 11 aa, Influenza virus
TAADLKSTQTA

SEQ ID NO: 539580 - protein, 11 aa, Influenza virus
TAADYKSTPSA

SEQ ID NO: 539581 - protein, 11 aa, Influenza virus
TAADYKSTQAA

SEQ ID NO: 539582 - protein, 11 aa, Influenza virus
TAADYKSTQSA

SEQ ID NO: 539583 - protein, 11 aa, Influenza virus
TAAQKAMMDQV

SEQ ID NO: 539584 - protein, 11 aa, Influenza virus
TAAQRAMMDQV

SEQ ID NO: 539585 - protein, 11 aa, Influenza virus
TAAQRAMVDQV

SEQ ID NO: 539586 - protein, 11 aa, Influenza virus
TACSDGPGWLT

SEQ ID NO: 539587 - protein, 11 aa, Influenza virus
TACSDGSGWLT

SEQ ID NO: 539588 - protein, 11 aa, Influenza virus
TADKDSNGVQD

SEQ ID NO: 539589 - protein, 11 aa, Influenza virus
TAEISHCRATE

SEQ ID NO: 539590 - protein, 11 aa, Influenza virus
TAEVSHCRATE

SEQ ID NO: 539591 - protein, 11 aa, Influenza virus
TAEVSYCRATE

SEQ ID NO: 539592 - protein, 11 aa, Influenza virus
TAFRGLISTPL

SEQ ID NO: 539593 - protein, 11 aa, Influenza virus
TAFRGLMSTPL

SEQ ID NO: 539594 - protein, 11 aa, Influenza virus
TAFSGMSANGD

SEQ ID NO: 539595 - protein, 11 aa, Influenza virus
TAIDQINGKLN

SEQ ID NO: 539596 - protein, 11 aa, Influenza virus
TAIDQITGKLN

SEQ ID NO: 539597 - protein, 11 aa, Influenza virus
TAKAMEQMAGS

SEQ ID NO: 539598 - protein, 11 aa, Influenza virus
TAKAMEQVAGS

SEQ ID NO: 539599 - protein, 11 aa, Influenza virus
TAKHIEECSCY

SEQ ID NO: 539600 - protein, 11 aa, Influenza virus
TAKHIEECSSY

SEQ ID NO: 539601 - protein, 11 aa, Influenza virus
TALANTIEIFR

SEQ ID NO: 539602 - protein, 11 aa, Influenza virus
TALANTIEVFR

SEQ ID NO: 539603 - protein, 11 aa, Influenza virus
TALLNASCAAM

SEQ ID NO: 539604 - protein, 11 aa, Influenza virus
TALSTIALLIG

SEQ ID NO: 539605 - protein, 11 aa, Influenza virus
TALYKNANTLS

SEQ ID NO: 539606 - protein, 11 aa, Influenza virus
TAMDDFQLIPM

SEQ ID NO: 539607 - protein, 11 aa, Influenza virus
TAMLCLGHHAV

SEQ ID NO: 539608 - protein, 11 aa, Influenza virus
TAMLNASCAAM

SEQ ID NO: 539609 - protein, 11 aa, Influenza virus
TANSIIVFCGT

SEQ ID NO: 539610 - protein, 11 aa, Influenza virus
TAPHGLCYPGE

SEQ ID NO: 539611 - protein, 11 aa, Influenza virus
TAQMALQLFIK

SEQ ID NO: 539612 - protein, 11 aa, Influenza virus
TASLSPGMMMG

SEQ ID NO: 539613 - protein, 11 aa, Influenza virus
TASRAGYEMLK

SEQ ID NO: 539614 - protein, 11 aa, Influenza virus
TASRSGYEMLK

SEQ ID NO: 539615 - protein, 11 aa, Influenza virus
TATLCLGHHAV

SEQ ID NO: 539616 - protein, 11 aa, Influenza virus
TATREGKHIVE

SEQ ID NO: 539617 - protein, 11 aa, Influenza virus
TATVYYDRRLT

SEQ ID NO: 539618 - protein, 11 aa, Influenza virus
TATVYYNGRLT

SEQ ID NO: 539619 - protein, 11 aa, Influenza virus
TATVYYNKRLT

SEQ ID NO: 539620 - protein, 11 aa, Influenza virus
TATVYYNRRLT

SEQ ID NO: 539621 - protein, 11 aa, Influenza virus
TATVYYNRRPT

SEQ ID NO: 539622 - protein, 11 aa, Influenza virus
TAVAVIKYNGI

SEQ ID NO: 539623 - protein, 11 aa, Influenza virus
TAVAVLKYNGI

SEQ ID NO: 539624 - protein, 11 aa, Influenza virus
TAVAVLKYNGV

SEQ ID NO: 539625 - protein, 11 aa, Influenza virus
TAVDTCYPFDV

SEQ ID NO: 539626 - protein, 11 aa, Influenza virus
TAYELTDSSWI

SEQ ID NO: 539627 - protein, 11 aa, Influenza virus
TAYERMCNILK

SEQ ID NO: 539628 - protein, 11 aa, Influenza virus
TAYSQITNGTT

SEQ ID NO: 539629 - protein, 11 aa, Influenza virus
TAYWWDGLQSS

SEQ ID NO: 539630 - protein, 11 aa, Influenza virus
TCAVVMTDGSA

SEQ ID NO: 539631 - protein, 11 aa, Influenza virus
TCEQIADAQHR

SEQ ID NO: 539632 - protein, 11 aa, Influenza virus
TCEQIADSHHR

SEQ ID NO: 539633 - protein, 11 aa, Influenza virus
TCEQIADSQHK

SEQ ID NO: 539634 - protein, 11 aa, Influenza virus
TCEQIADSQHR

SEQ ID NO: 539635 - protein, 11 aa, Influenza virus
TCGCRDNWQGA

SEQ ID NO: 539636 - protein, 11 aa, Influenza virus
TCHDGIGRMTI

SEQ ID NO: 539637 - protein, 11 aa, Influenza virus
TCHDGVGRMTI

SEQ ID NO: 539638 - protein, 11 aa, Influenza virus
TCIESIRNGTY

SEQ ID NO: 539639 - protein, 11 aa, Influenza virus
TCIVAVTDGPA

SEQ ID NO: 539640 - protein, 11 aa, Influenza virus
TCKLLGINMSK

SEQ ID NO: 539641 - protein, 11 aa, Influenza virus
TCKLVGINMSK

SEQ ID NO: 539642 - protein, 11 aa, Influenza virus
TCMETIRNGTY

SEQ ID NO: 539643 - protein, 11 aa, Influenza virus
TCRDNWQGSNR

SEQ ID NO: 539644 - protein, 11 aa, Influenza virus
TCSALFVYSLR

SEQ ID NO: 539645 - protein, 11 aa, Influenza virus
TCSNGSCRCTI

SEQ ID NO: 539646 - protein, 11 aa, Influenza virus
TCTCRDNWQGS

SEQ ID NO: 539647 - protein, 11 aa, Influenza virus
TCTVIMTDGSA

SEQ ID NO: 539648 - protein, 11 aa, Influenza virus
TCTVVMTDGNA

SEQ ID NO: 539649 - protein, 11 aa, Influenza virus
TCTVVMTDGSA

SEQ ID NO: 539650 - protein, 11 aa, Influenza virus
TCVCRDNWHGS

SEQ ID NO: 539651 - protein, 11 aa, Influenza virus
TCVCRDNWKSS

SEQ ID NO: 539652 - protein, 11 aa, Influenza virus
TCVCRDNWQGA

SEQ ID NO: 539653 - protein, 11 aa, Influenza virus
TCVCRDNWRGA

SEQ ID NO: 539654 - protein, 11 aa, Influenza virus
TCVCRDSWHGS

SEQ ID NO: 539655 - protein, 11 aa, Influenza virus
TCVVAVTDGPA

SEQ ID NO: 539656 - protein, 11 aa, Influenza virus
TCVVIMTDGPA

SEQ ID NO: 539657 - protein, 11 aa, Influenza virus
TCVVIMTDGSA

SEQ ID NO: 539658 - protein, 11 aa, Influenza virus
TCVVTVTDGPA

SEQ ID NO: 539659 - protein, 11 aa, Influenza virus
TCVVVMTDGSA

SEQ ID NO: 539660 - protein, 11 aa, Influenza virus
TCWEQLYTPGG

SEQ ID NO: 539661 - protein, 11 aa, Influenza virus
TCWEQMYTPGG

SEQ ID NO: 539662 - protein, 11 aa, Influenza virus
TCYPFDVPDYQ

SEQ ID NO: 539663 - protein, 11 aa, Influenza virus
TDCVLEAMAFL

SEQ ID NO: 539664 - protein, 11 aa, Influenza virus
TDCVLEAMALL

SEQ ID NO: 539665 - protein, 11 aa, Influenza virus
TDELCPSPLKL

SEQ ID NO: 539666 - protein, 11 aa, Influenza virus
TDEYKNTGDSD

SEQ ID NO: 539667 - protein, 11 aa, Influenza virus
TDEYKNTRDSD

SEQ ID NO: 539668 - protein, 11 aa, Influenza virus
TDEYKNTRDSN

SEQ ID NO: 539669 - protein, 11 aa, Influenza virus
TDGATSACKRT

SEQ ID NO: 539670 - protein, 11 aa, Influenza virus
TDGNASGKADT

SEQ ID NO: 539671 - protein, 11 aa, Influenza virus
TDGPAANNADH

SEQ ID NO: 539672 - protein, 11 aa, Influenza virus
TDGPAANSADH

SEQ ID NO: 539673 - protein, 11 aa, Influenza virus
TDGPADNKADH

SEQ ID NO: 539674 - protein, 11 aa, Influenza virus
TDGPANKQASY

SEQ ID NO: 539675 - protein, 11 aa, Influenza virus
TDGPANNQASY

SEQ ID NO: 539676 - protein, 11 aa, Influenza virus
TDGPANSQASY

SEQ ID NO: 539677 - protein, 11 aa, Influenza virus
TDGPASNQASY

SEQ ID NO: 539678 - protein, 11 aa, Influenza virus
TDGPASSQAYT

SEQ ID NO: 539679 - protein, 11 aa, Influenza virus
TDGPSDAQAFY

SEQ ID NO: 539680 - protein, 11 aa, Influenza virus
TDGPSNAQAFY

SEQ ID NO: 539681 - protein, 11 aa, Influenza virus
TDGSANSQAYT

SEQ ID NO: 539682 - protein, 11 aa, Influenza virus
TDGSASGKADT

SEQ ID NO: 539683 - protein, 11 aa, Influenza virus
TDGSASGKAET

SEQ ID NO: 539684 - protein, 11 aa, Influenza virus
TDGSASGQAYT

SEQ ID NO: 539685 - protein, 11 aa, Influenza virus
TDGSASGRADT

SEQ ID NO: 539686 - protein, 11 aa, Influenza virus
TDGSASRKADT

SEQ ID NO: 539687 - protein, 11 aa, Influenza virus
TDGSASSQAHT

SEQ ID NO: 539688 - protein, 11 aa, Influenza virus
TDGSASSQAYT

SEQ ID NO: 539689 - protein, 11 aa, Influenza virus
TDGSATGPADT

SEQ ID NO: 539690 - protein, 11 aa, Influenza virus
TDGSATGPAET

SEQ ID NO: 539691 - protein, 11 aa, Influenza virus
TDIWAYNAELI

SEQ ID NO: 539692 - protein, 11 aa, Influenza virus
TDIWAYNAELL

SEQ ID NO: 539693 - protein, 11 aa, Influenza virus
TDIWSYNAKLL

SEQ ID NO: 539694 - protein, 11 aa, Influenza virus
TDIWSYNARLL

SEQ ID NO: 539695 - protein, 11 aa, Influenza virus
TDIWTYQAELL

SEQ ID NO: 539696 - protein, 11 aa, Influenza virus
TDKDSNGVQDI

SEQ ID NO: 539697 - protein, 11 aa, Influenza virus
TDKGSIQSDKP

SEQ ID NO: 539698 - protein, 11 aa, Influenza virus
TDKIDTLTETG

SEQ ID NO: 539699 - protein, 11 aa, Influenza virus
TDKNSNGVQDI

SEQ ID NO: 539700 - protein, 11 aa, Influenza virus
TDKVDTIIENN

SEQ ID NO: 539701 - protein, 11 aa, Influenza virus
TDKVDTLTENG

SEQ ID NO: 539702 - protein, 11 aa, Influenza virus
TDKVDTLTETG

SEQ ID NO: 539703 - protein, 11 aa, Influenza virus
TDKVNTIIENN

SEQ ID NO: 539704 - protein, 11 aa, Influenza virus
TDLEALMEWIK

SEQ ID NO: 539705 - protein, 11 aa, Influenza virus
TDLEALMEWLK

SEQ ID NO: 539706 - protein, 11 aa, Influenza virus
TDLEVLMEWLK

SEQ ID NO: 539707 - protein, 11 aa, Influenza virus
TDLGAPLELRD

SEQ ID NO: 539708 - protein, 11 aa, Influenza virus
TDLGSPLELRD

SEQ ID NO: 539709 - protein, 11 aa, Influenza virus
TDLGTPLELRD

SEQ ID NO: 539710 - protein, 11 aa, Influenza virus
TDLYKVATGRV

SEQ ID NO: 539711 - protein, 11 aa, Influenza virus
TDNHVEVVSAK

SEQ ID NO: 539712 - protein, 11 aa, Influenza virus
TDNYGVKGFGF

SEQ ID NO: 539713 - protein, 11 aa, Influenza virus
TDSEMDKLFER

SEQ ID NO: 539714 - protein, 11 aa, Influenza virus
TDSEMLNLYER

SEQ ID NO: 539715 - protein, 11 aa, Influenza virus
TDSEMNKLFDR

SEQ ID NO: 539716 - protein, 11 aa, Influenza virus
TDSEMNKLFEK

SEQ ID NO: 539717 - protein, 11 aa, Influenza virus
TDSEMNKLFER

SEQ ID NO: 539718 - protein, 11 aa, Influenza virus
TDSEMNKLYEK

SEQ ID NO: 539719 - protein, 11 aa, Influenza virus
TDSEMNKLYER

SEQ ID NO: 539720 - protein, 11 aa, Influenza virus
TDSEMNRLFER

SEQ ID NO: 539721 - protein, 11 aa, Influenza virus
TDSEMSKLFEK

SEQ ID NO: 539722 - protein, 11 aa, Influenza virus
TDSEMSKLFER

SEQ ID NO: 539723 - protein, 11 aa, Influenza virus
TDSIKSWRKDI

SEQ ID NO: 539724 - protein, 11 aa, Influenza virus
TDSIKSWRRDI

SEQ ID NO: 539725 - protein, 11 aa, Influenza virus
TDSQTATKRIR

SEQ ID NO: 539726 - protein, 11 aa, Influenza virus
TDSQTATKRLR

SEQ ID NO: 539727 - protein, 11 aa, Influenza virus
TDTFKSWKGNI

SEQ ID NO: 539728 - protein, 11 aa, Influenza virus
TDTLKSWKGNI

SEQ ID NO: 539729 - protein, 11 aa, Influenza virus
TDTPRGEDSQF

SEQ ID NO: 539730 - protein, 11 aa, Influenza virus
TDTVDTILEKN

SEQ ID NO: 539731 - protein, 11 aa, Influenza virus
TDTVDTLLEKN

SEQ ID NO: 539732 - protein, 11 aa, Influenza virus
TDTVDTLTENG

SEQ ID NO: 539733 - protein, 11 aa, Influenza virus
TDTVDTVLEKN

SEQ ID NO: 539734 - protein, 11 aa, Influenza virus
TDTVDTVLERN

SEQ ID NO: 539735 - protein, 11 aa, Influenza virus
TDTVDTVREKN

SEQ ID NO: 539736 - protein, 11 aa, Influenza virus
TDTVNTLIEQN

SEQ ID NO: 539737 - protein, 11 aa, Influenza virus
TDTVNTLTEQN

SEQ ID NO: 539738 - protein, 11 aa, Influenza virus
TDVIRSWRKQI

SEQ ID NO: 539739 - protein, 11 aa, Influenza virus
TDVVNFLSMEF

SEQ ID NO: 539740 - protein, 11 aa, Influenza virus
TDVVNFVSMEF

SEQ ID NO: 539741 - protein, 11 aa, Influenza virus
TDVVNYVSMEF

SEQ ID NO: 539742 - protein, 11 aa, Influenza virus
TDVVRSWKKQI

SEQ ID NO: 539743 - protein, 11 aa, Influenza virus
TDVVRSWRKKI

SEQ ID NO: 539744 - protein, 11 aa, Influenza virus
TDVVRSWRKQI

SEQ ID NO: 539745 - protein, 11 aa, Influenza virus
TDVVRSWRRQI

SEQ ID NO: 539746 - protein, 11 aa, Influenza virus
TDVWSYNAKLL

SEQ ID NO: 539747 - protein, 11 aa, Influenza virus
TDVYCICRDNW

SEQ ID NO: 539748 - protein, 11 aa, Influenza virus
TDWSGYSGSFI

SEQ ID NO: 539749 - protein, 11 aa, Influenza virus
TDWSGYSGSFM

SEQ ID NO: 539750 - protein, 11 aa, Influenza virus
TDWSGYSGSFV

SEQ ID NO: 539751 - protein, 11 aa, Influenza virus
TECQLNEGIMN

SEQ ID NO: 539752 - protein, 11 aa, Influenza virus
TECQLNEGVIN

SEQ ID NO: 539753 - protein, 11 aa, Influenza virus
TECQLNEGVMN

SEQ ID NO: 539754 - protein, 11 aa, Influenza virus
TECRTFFLTQG

SEQ ID NO: 539755 - protein, 11 aa, Influenza virus
TEDNIYKILSI

SEQ ID NO: 539756 - protein, 11 aa, Influenza virus
TEDNVYKILSI

SEQ ID NO: 539757 - protein, 11 aa, Influenza virus
TEDNVYKVLAI

SEQ ID NO: 539758 - protein, 11 aa, Influenza virus
TEDNVYKVLSI

SEQ ID NO: 539759 - protein, 11 aa, Influenza virus
TEEQAVDICKA

SEQ ID NO: 539760 - protein, 11 aa, Influenza virus
TEEQAVEICKA

SEQ ID NO: 539761 - protein, 11 aa, Influenza virus
TEEQAVGICKA

SEQ ID NO: 539762 - protein, 11 aa, Influenza virus
TEEQAVNICKA

SEQ ID NO: 539763 - protein, 11 aa, Influenza virus
TEESECVCHNG

SEQ ID NO: 539764 - protein, 11 aa, Influenza virus
TEEVSHCRATE

SEQ ID NO: 539765 - protein, 11 aa, Influenza virus
TEFESIESEFN

SEQ ID NO: 539766 - protein, 11 aa, Influenza virus
TEFESIESEFS

SEQ ID NO: 539767 - protein, 11 aa, Influenza virus
TEFLGQWDWPD

SEQ ID NO: 539768 - protein, 11 aa, Influenza virus
TEFLGQWNWPD

SEQ ID NO: 539769 - protein, 11 aa, Influenza virus
TEGHIEECSCY

SEQ ID NO: 539770 - protein, 11 aa, Influenza virus
TEHQIGNVINW

SEQ ID NO: 539771 - protein, 11 aa, Influenza virus
TEIASWAGNIL

SEQ ID NO: 539772 - protein, 11 aa, Influenza virus
TEIEQQIGNVI

SEQ ID NO: 539773 - protein, 11 aa, Influenza virus
TEIIIRMMENA

SEQ ID NO: 539774 - protein, 11 aa, Influenza virus
TEINTWARNIL

SEQ ID NO: 539775 - protein, 11 aa, Influenza virus
TEIPSWAGNIL

SEQ ID NO: 539776 - protein, 11 aa, Influenza virus
TEIPSWAGNVL

SEQ ID NO: 539777 - protein, 11 aa, Influenza virus
TEIPSWEGNIL

SEQ ID NO: 539778 - protein, 11 aa, Influenza virus
TEISFTITGDN

SEQ ID NO: 539779 - protein, 11 aa, Influenza virus
TEIWSYNAELL

SEQ ID NO: 539780 - protein, 11 aa, Influenza virus
TEKGIEVVNAT

SEQ ID NO: 539781 - protein, 11 aa, Influenza virus
TEKGVEVVNAT

SEQ ID NO: 539782 - protein, 11 aa, Influenza virus
TEKVDTIIENN

SEQ ID NO: 539783 - protein, 11 aa, Influenza virus
TEKVDTIIESN

SEQ ID NO: 539784 - protein, 11 aa, Influenza virus
TELGAPLVLDD

SEQ ID NO: 539785 - protein, 11 aa, Influenza virus
TELGSPLVLDD

SEQ ID NO: 539786 - protein, 11 aa, Influenza virus
TELGVPFHLGT

SEQ ID NO: 539787 - protein, 11 aa, Influenza virus
TELPFQNLSPR

SEQ ID NO: 539788 - protein, 11 aa, Influenza virus
TELSFTITGDN

SEQ ID NO: 539789 - protein, 11 aa, Influenza virus
TELSFTVTGDN

SEQ ID NO: 539790 - protein, 11 aa, Influenza virus
TELWSYNAELL

SEQ ID NO: 539791 - protein, 11 aa, Influenza virus
TEMWSYNAELL

SEQ ID NO: 539792 - protein, 11 aa, Influenza virus
TENGVPVTSSI

SEQ ID NO: 539793 - protein, 11 aa, Influenza virus
TENGVPVTSSV

SEQ ID NO: 539794 - protein, 11 aa, Influenza virus
TENPVICLGHH

SEQ ID NO: 539795 - protein, 11 aa, Influenza virus
TENSFEQITFI

SEQ ID NO: 539796 - protein, 11 aa, Influenza virus
TENSFEQITFL

SEQ ID NO: 539797 - protein, 11 aa, Influenza virus
TENSFEQITFM

SEQ ID NO: 539798 - protein, 11 aa, Influenza virus
TEPLCDVSGFA

SEQ ID NO: 539799 - protein, 11 aa, Influenza virus
TEPLCEVSGFA

SEQ ID NO: 539800 - protein, 11 aa, Influenza virus
TEPLCEVSGFV

SEQ ID NO: 539801 - protein, 11 aa, Influenza virus
TEPLCNVSGFA

SEQ ID NO: 539802 - protein, 11 aa, Influenza virus
TEQNVPVTQVE

SEQ ID NO: 539803 - protein, 11 aa, Influenza virus
TEQTKLYKNTN

SEQ ID NO: 539804 - protein, 11 aa, Influenza virus
TEREVEVVNAT

SEQ ID NO: 539805 - protein, 11 aa, Influenza virus
TERGIEVVNAT

SEQ ID NO: 539806 - protein, 11 aa, Influenza virus
TERGVEVVDAT

SEQ ID NO: 539807 - protein, 11 aa, Influenza virus
TERGVEVVNAT

SEQ ID NO: 539808 - protein, 11 aa, Influenza virus
TERVDTIIESN

SEQ ID NO: 539809 - protein, 11 aa, Influenza virus
TESLQNRIQID

SEQ ID NO: 539810 - protein, 11 aa, Influenza virus
TESRGLFGAIA

SEQ ID NO: 539811 - protein, 11 aa, Influenza virus
TESSFEQITFM

SEQ ID NO: 539812 - protein, 11 aa, Influenza virus
TETGVPVTSSV

SEQ ID NO: 539813 - protein, 11 aa, Influenza virus
TETVEITGIDK

SEQ ID NO: 539814 - protein, 11 aa, Influenza virus
TETVEITGINK

SEQ ID NO: 539815 - protein, 11 aa, Influenza virus
TETVNTLIEQN

SEQ ID NO: 539816 - protein, 11 aa, Influenza virus
TETVNTLSEQN

SEQ ID NO: 539817 - protein, 11 aa, Influenza virus
TETVNTLTEQN

SEQ ID NO: 539818 - protein, 11 aa, Influenza virus
TEVEGRIQDLE

SEQ ID NO: 539819 - protein, 11 aa, Influenza virus
TEVEKQIGNVI

SEQ ID NO: 539820 - protein, 11 aa, Influenza virus
TEVEQQIGNVI

SEQ ID NO: 539821 - protein, 11 aa, Influenza virus
TEVETYVLSII

SEQ ID NO: 539822 - protein, 11 aa, Influenza virus
TEVETYVLSIV

SEQ ID NO: 539823 - protein, 11 aa, Influenza virus
TEVETYVLSVI

SEQ ID NO: 539824 - protein, 11 aa, Influenza virus
TEVSHCRATEY

SEQ ID NO: 539825 - protein, 11 aa, Influenza virus
TEVWSYNADLL

SEQ ID NO: 539826 - protein, 11 aa, Influenza virus
TEVWSYNAELL

SEQ ID NO: 539827 - protein, 11 aa, Influenza virus
TEWSGYSGSFV

SEQ ID NO: 539828 - protein, 11 aa, Influenza virus
TEYRQEALQNR

SEQ ID NO: 539829 - protein, 11 aa, Influenza virus
TFCGLDNEPGS

SEQ ID NO: 539830 - protein, 11 aa, Influenza virus
TFCGLNNEPGS

SEQ ID NO: 539831 - protein, 11 aa, Influenza virus
TFDSLNITAAS

SEQ ID NO: 539832 - protein, 11 aa, Influenza virus
TFDWTLNRNQP

SEQ ID NO: 539833 - protein, 11 aa, Influenza virus
TFEFTSFFYRY

SEQ ID NO: 539834 - protein, 11 aa, Influenza virus
TFESDGAFLAP

SEQ ID NO: 539835 - protein, 11 aa, Influenza virus
TFESNGAFIAP

SEQ ID NO: 539836 - protein, 11 aa, Influenza virus
TFESNGAFLAP

SEQ ID NO: 539837 - protein, 11 aa, Influenza virus
TFESNGALLAP

SEQ ID NO: 539838 - protein, 11 aa, Influenza virus
TFESNGGFLAP

SEQ ID NO: 539839 - protein, 11 aa, Influenza virus
TFESNGGLIAP

SEQ ID NO: 539840 - protein, 11 aa, Influenza virus
TFESNGGLLAP

SEQ ID NO: 539841 - protein, 11 aa, Influenza virus
TFESNGVFLAP

SEQ ID NO: 539842 - protein, 11 aa, Influenza virus
TFESSGGLLAP

SEQ ID NO: 539843 - protein, 11 aa, Influenza virus
TFFITQGSLLN

SEQ ID NO: 539844 - protein, 11 aa, Influenza virus
TFFLTHGALLN

SEQ ID NO: 539845 - protein, 11 aa, Influenza virus
TFFLTHGSLLN

SEQ ID NO: 539846 - protein, 11 aa, Influenza virus
TFFLTQGALLN

SEQ ID NO: 539847 - protein, 11 aa, Influenza virus
TFFLTQGSLLN

SEQ ID NO: 539848 - protein, 11 aa, Influenza virus
TFFLTQGSLPN

SEQ ID NO: 539849 - protein, 11 aa, Influenza virus
TFGDCPKYVNV

SEQ ID NO: 539850 - protein, 11 aa, Influenza virus
TFIFNGAFIAP

SEQ ID NO: 539851 - protein, 11 aa, Influenza virus
TFIQALQLLLE

SEQ ID NO: 539852 - protein, 11 aa, Influenza virus
TFKSWKGNIMR

SEQ ID NO: 539853 - protein, 11 aa, Influenza virus
TFLARSALILR

SEQ ID NO: 539854 - protein, 11 aa, Influenza virus
TFLQALQLLLE

SEQ ID NO: 539855 - protein, 11 aa, Influenza virus
TFLRSNAPSGI

SEQ ID NO: 539856 - protein, 11 aa, Influenza virus
TFLRSNAPSGV

SEQ ID NO: 539857 - protein, 11 aa, Influenza virus
TFMQALQLLFE

SEQ ID NO: 539858 - protein, 11 aa, Influenza virus
TFMQALQLLLE

SEQ ID NO: 539859 - protein, 11 aa, Influenza virus
TFNFNGAFVAP

SEQ ID NO: 539860 - protein, 11 aa, Influenza virus
TFNGAFIAPDR

SEQ ID NO: 539861 - protein, 11 aa, Influenza virus
TFNGAFIAPNR

SEQ ID NO: 539862 - protein, 11 aa, Influenza virus
TFPYTGDPPYS

SEQ ID NO: 539863 - protein, 11 aa, Influenza virus
TFQNIDKNALG

SEQ ID NO: 539864 - protein, 11 aa, Influenza virus
TFQNIDRNAIG

SEQ ID NO: 539865 - protein, 11 aa, Influenza virus
TFQNIDRNALG

SEQ ID NO: 539866 - protein, 11 aa, Influenza virus
TFQNIEKNALG

SEQ ID NO: 539867 - protein, 11 aa, Influenza virus
TFQNIERNALG

SEQ ID NO: 539868 - protein, 11 aa, Influenza virus
TFRGLISTPLG

SEQ ID NO: 539869 - protein, 11 aa, Influenza virus
TFSDNGGLIAP

SEQ ID NO: 539870 - protein, 11 aa, Influenza virus
TFSFNGAFIAP

SEQ ID NO: 539871 - protein, 11 aa, Influenza virus
TFSFNGAFVAP

SEQ ID NO: 539872 - protein, 11 aa, Influenza virus
TFSFQLINNKK

SEQ ID NO: 539873 - protein, 11 aa, Influenza virus
TFSHNGGLIAP

SEQ ID NO: 539874 - protein, 11 aa, Influenza virus
TFSHNGGLVAP

SEQ ID NO: 539875 - protein, 11 aa, Influenza virus
TFSHNGGRIAP

SEQ ID NO: 539876 - protein, 11 aa, Influenza virus
TFSPRSRSGFE

SEQ ID NO: 539877 - protein, 11 aa, Influenza virus
TFSVQRNLPFD

SEQ ID NO: 539878 - protein, 11 aa, Influenza virus
TFSVQRNLPFE

SEQ ID NO: 539879 - protein, 11 aa, Influenza virus
TFSVQRSLPFE

SEQ ID NO: 539880 - protein, 11 aa, Influenza virus
TFTFNGAFIAP

SEQ ID NO: 539881 - protein, 11 aa, Influenza virus
TFVNMTNVQNN

SEQ ID NO: 539882 - protein, 11 aa, Influenza virus
TFVNVTHVQNN

SEQ ID NO: 539883 - protein, 11 aa, Influenza virus
TFVNVTNVQND

SEQ ID NO: 539884 - protein, 11 aa, Influenza virus
TFVNVTNVQNN

SEQ ID NO: 539885 - protein, 11 aa, Influenza virus
TGALASCMGLI

SEQ ID NO: 539886 - protein, 11 aa, Influenza virus
TGALQLNPIDG

SEQ ID NO: 539887 - protein, 11 aa, Influenza virus
TGAPQLNPIDG

SEQ ID NO: 539888 - protein, 11 aa, Influenza virus
TGAPQLNPVDG

SEQ ID NO: 539889 - protein, 11 aa, Influenza virus
TGAQSFYRSIN

SEQ ID NO: 539890 - protein, 11 aa, Influenza virus
TGCFEIFHKCD

SEQ ID NO: 539891 - protein, 11 aa, Influenza virus
TGCFEIFHRCD

SEQ ID NO: 539892 - protein, 11 aa, Influenza virus
TGCFELFHKCD

SEQ ID NO: 539893 - protein, 11 aa, Influenza virus
TGCKMYALHQG

SEQ ID NO: 539894 - protein, 11 aa, Influenza virus
TGCQLNEGVMN

SEQ ID NO: 539895 - protein, 11 aa, Influenza virus
TGDDKNATASF

SEQ ID NO: 539896 - protein, 11 aa, Influenza virus
TGDDRNATASF

SEQ ID NO: 539897 - protein, 11 aa, Influenza virus
TGDDRNATASL

SEQ ID NO: 539898 - protein, 11 aa, Influenza virus
TGDGCFEILHK

SEQ ID NO: 539899 - protein, 11 aa, Influenza virus
TGDGCFEILHR

SEQ ID NO: 539900 - protein, 11 aa, Influenza virus
TGDNTKWNENQ

SEQ ID NO: 539901 - protein, 11 aa, Influenza virus
TGDPPYSHGTG

SEQ ID NO: 539902 - protein, 11 aa, Influenza virus
TGFAPFSKDNS

SEQ ID NO: 539903 - protein, 11 aa, Influenza virus
TGFHFEECSCY

SEQ ID NO: 539904 - protein, 11 aa, Influenza virus
TGFHLEECSCY

SEQ ID NO: 539905 - protein, 11 aa, Influenza virus
TGGQAFYRSIN

SEQ ID NO: 539906 - protein, 11 aa, Influenza virus
TGGQSFYRSIN

SEQ ID NO: 539907 - protein, 11 aa, Influenza virus
TGIAADKASTQ

SEQ ID NO: 539908 - protein, 11 aa, Influenza virus
TGIAADKESTQ

SEQ ID NO: 539909 - protein, 11 aa, Influenza virus
TGIAADKTSTQ

SEQ ID NO: 539910 - protein, 11 aa, Influenza virus
TGIAADKVSTQ

SEQ ID NO: 539911 - protein, 11 aa, Influenza virus
TGIAADRDSTQ

SEQ ID NO: 539912 - protein, 11 aa, Influenza virus
TGIAADRESTQ

SEQ ID NO: 539913 - protein, 11 aa, Influenza virus
TGIAADRGSTQ

SEQ ID NO: 539914 - protein, 11 aa, Influenza virus
TGIAAEKESTQ

SEQ ID NO: 539915 - protein, 11 aa, Influenza virus
TGIDKVCTKGK

SEQ ID NO: 539916 - protein, 11 aa, Influenza virus
TGILTDTSRPG

SEQ ID NO: 539917 - protein, 11 aa, Influenza virus
TGILTDTSRPS

SEQ ID NO: 539918 - protein, 11 aa, Influenza virus
TGINKVCTKGK

SEQ ID NO: 539919 - protein, 11 aa, Influenza virus
TGIVADRDSTQ

SEQ ID NO: 539920 - protein, 11 aa, Influenza virus
TGKDPKKTGGP

SEQ ID NO: 539921 - protein, 11 aa, Influenza virus
TGKGCFDILHK

SEQ ID NO: 539922 - protein, 11 aa, Influenza virus
TGKLNRFIEKT

SEQ ID NO: 539923 - protein, 11 aa, Influenza virus
TGKLNRIIEKT

SEQ ID NO: 539924 - protein, 11 aa, Influenza virus
TGKLNRLIDKT

SEQ ID NO: 539925 - protein, 11 aa, Influenza virus
TGKLNRLIDRT

SEQ ID NO: 539926 - protein, 11 aa, Influenza virus
TGKLNRLIEKT

SEQ ID NO: 539927 - protein, 11 aa, Influenza virus
TGKLNRLIERT

SEQ ID NO: 539928 - protein, 11 aa, Influenza virus
TGKLNRLIGKT

SEQ ID NO: 539929 - protein, 11 aa, Influenza virus
TGKLNRLISKT

SEQ ID NO: 539930 - protein, 11 aa, Influenza virus
TGKSHGRILKN

SEQ ID NO: 539931 - protein, 11 aa, Influenza virus
TGKSHGRVLKN

SEQ ID NO: 539932 - protein, 11 aa, Influenza virus
TGKWDTLIERE

SEQ ID NO: 539933 - protein, 11 aa, Influenza virus
TGLIDGWYGYH

SEQ ID NO: 539934 - protein, 11 aa, Influenza virus
TGLRNIPSIQS

SEQ ID NO: 539935 - protein, 11 aa, Influenza virus
TGLRNIPSVQS

SEQ ID NO: 539936 - protein, 11 aa, Influenza virus
TGLRNVPSIQS

SEQ ID NO: 539937 - protein, 11 aa, Influenza virus
TGMAADQKSTQ

SEQ ID NO: 539938 - protein, 11 aa, Influenza virus
TGMAADRDSTQ

SEQ ID NO: 539939 - protein, 11 aa, Influenza virus
TGMDPRMCSLM

SEQ ID NO: 539940 - protein, 11 aa, Influenza virus
TGMIDGWYGYH

SEQ ID NO: 539941 - protein, 11 aa, Influenza virus
TGMKNVPEIPK

SEQ ID NO: 539942 - protein, 11 aa, Influenza virus
TGMKNVPEIPR

SEQ ID NO: 539943 - protein, 11 aa, Influenza virus
TGMKNVPETPK

SEQ ID NO: 539944 - protein, 11 aa, Influenza virus
TGMRNIPEKPK

SEQ ID NO: 539945 - protein, 11 aa, Influenza virus
TGMRNIPEKQT

SEQ ID NO: 539946 - protein, 11 aa, Influenza virus
TGMRNIPENPK

SEQ ID NO: 539947 - protein, 11 aa, Influenza virus
TGMRNIPERQT

SEQ ID NO: 539948 - protein, 11 aa, Influenza virus
TGMRNIPGKQA

SEQ ID NO: 539949 - protein, 11 aa, Influenza virus
TGMRNVPEKPK

SEQ ID NO: 539950 - protein, 11 aa, Influenza virus
TGMRNVPEKQT

SEQ ID NO: 539951 - protein, 11 aa, Influenza virus
TGMRNVPENPK

SEQ ID NO: 539952 - protein, 11 aa, Influenza virus
TGMRNVPERQT

SEQ ID NO: 539953 - protein, 11 aa, Influenza virus
TGMRNVPETQT

SEQ ID NO: 539954 - protein, 11 aa, Influenza virus
TGMVDGWYGYH

SEQ ID NO: 539955 - protein, 11 aa, Influenza virus
TGMWDTLIERD

SEQ ID NO: 539956 - protein, 11 aa, Influenza virus
TGNFIAPEYAY

SEQ ID NO: 539957 - protein, 11 aa, Influenza virus
TGNGCFDILHK

SEQ ID NO: 539958 - protein, 11 aa, Influenza virus
TGNGCFEFYHK

SEQ ID NO: 539959 - protein, 11 aa, Influenza virus
TGNHGSLVLSL

SEQ ID NO: 539960 - protein, 11 aa, Influenza virus
TGNKLITVGSS

SEQ ID NO: 539961 - protein, 11 aa, Influenza virus
TGNLIAPEYGF

SEQ ID NO: 539962 - protein, 11 aa, Influenza virus
TGNLIAPRGYF

SEQ ID NO: 539963 - protein, 11 aa, Influenza virus
TGNLVAPEYGF

SEQ ID NO: 539964 - protein, 11 aa, Influenza virus
TGNPIICLGHH

SEQ ID NO: 539965 - protein, 11 aa, Influenza virus
TGNPVICLGHH

SEQ ID NO: 539966 - protein, 11 aa, Influenza virus
TGNPVICMGHH

SEQ ID NO: 539967 - protein, 11 aa, Influenza virus
TGNPVMCLGHH

SEQ ID NO: 539968 - protein, 11 aa, Influenza virus
TGPADTRIYYF

SEQ ID NO: 539969 - protein, 11 aa, Influenza virus
TGPADTRVYYF

SEQ ID NO: 539970 - protein, 11 aa, Influenza virus
TGPAETRIYYF

SEQ ID NO: 539971 - protein, 11 aa, Influenza virus
TGPAETRVYYF

SEQ ID NO: 539972 - protein, 11 aa, Influenza virus
TGPDATAVAVI

SEQ ID NO: 539973 - protein, 11 aa, Influenza virus
TGPDATAVAVL

SEQ ID NO: 539974 - protein, 11 aa, Influenza virus
TGPDSTAVAVI

SEQ ID NO: 539975 - protein, 11 aa, Influenza virus
TGPDTTAVAVL

SEQ ID NO: 539976 - protein, 11 aa, Influenza virus
TGPPQCDLFLE

SEQ ID NO: 539977 - protein, 11 aa, Influenza virus
TGPPQCDQFLE

SEQ ID NO: 539978 - protein, 11 aa, Influenza virus
TGQAADLKSTQ

SEQ ID NO: 539979 - protein, 11 aa, Influenza virus
TGQAADYESTQ

SEQ ID NO: 539980 - protein, 11 aa, Influenza virus
TGQAADYKSTQ

SEQ ID NO: 539981 - protein, 11 aa, Influenza virus
TGRDVLVIWGI

SEQ ID NO: 539982 - protein, 11 aa, Influenza virus
TGRDVLVLWGI

SEQ ID NO: 539983 - protein, 11 aa, Influenza virus
TGRDVLVMWGI

SEQ ID NO: 539984 - protein, 11 aa, Influenza virus
TGRDVLVMWGL

SEQ ID NO: 539985 - protein, 11 aa, Influenza virus
TGRGIEVVNAT

SEQ ID NO: 539986 - protein, 11 aa, Influenza virus
TGRNCTIPCFW

SEQ ID NO: 539987 - protein, 11 aa, Influenza virus
TGRNCTVPCFW

SEQ ID NO: 539988 - protein, 11 aa, Influenza virus
TGRSSFFRNVV

SEQ ID NO: 539989 - protein, 11 aa, Influenza virus
TGRVTVSTRSD

SEQ ID NO: 539990 - protein, 11 aa, Influenza virus
TGSPGAPGVKG

SEQ ID NO: 539991 - protein, 11 aa, Influenza virus
TGSPSAPGVKG

SEQ ID NO: 539992 - protein, 11 aa, Influenza virus
TGSVYIEVLHL

SEQ ID NO: 539993 - protein, 11 aa, Influenza virus
TGSWPDGADIN

SEQ ID NO: 539994 - protein, 11 aa, Influenza virus
TGSWPDGANID

SEQ ID NO: 539995 - protein, 11 aa, Influenza virus
TGSWPDGANII

SEQ ID NO: 539996 - protein, 11 aa, Influenza virus
TGSWPDGANIN

SEQ ID NO: 539997 - protein, 11 aa, Influenza virus
TGSWPDGANIS

SEQ ID NO: 539998 - protein, 11 aa, Influenza virus
TGSWPDGANTN

SEQ ID NO: 539999 - protein, 11 aa, Influenza virus
TGSYVRLYLWG

SEQ ID NO: 540000 - protein, 11 aa, Influenza virus
TGTAADLKSTQ

SEQ ID NO: 540001 - protein, 11 aa, Influenza virus
TGTAKHIEECS

SEQ ID NO: 540002 - protein, 11 aa, Influenza virus
TGTAKQNYLML

SEQ ID NO: 540003 - protein, 11 aa, Influenza virus
TGTFEFTSFFY

SEQ ID NO: 540004 - protein, 11 aa, Influenza virus
TGTGYTMDTVN

SEQ ID NO: 540005 - protein, 11 aa, Influenza virus
TGTGYTMDTVS

SEQ ID NO: 540006 - protein, 11 aa, Influenza virus
TGTWDTLIERD

SEQ ID NO: 540007 - protein, 11 aa, Influenza virus
TGTWDTLIERE

SEQ ID NO: 540008 - protein, 11 aa, Influenza virus
TGTWDTLIERG

SEQ ID NO: 540009 - protein, 11 aa, Influenza virus
TGTYCSLNGIS

SEQ ID NO: 540010 - protein, 11 aa, Influenza virus
TGTYCSLNGVS

SEQ ID NO: 540011 - protein, 11 aa, Influenza virus
TGTYDYPKYEE

SEQ ID NO: 540012 - protein, 11 aa, Influenza virus
TGVESAVLRGF

SEQ ID NO: 540013 - protein, 11 aa, Influenza virus
TGVLTDTSRPG

SEQ ID NO: 540014 - protein, 11 aa, Influenza virus
TGVLTDTSRPK

SEQ ID NO: 540015 - protein, 11 aa, Influenza virus
TGVLTDTSRPS

SEQ ID NO: 540016 - protein, 11 aa, Influenza virus
TGVPVTSSVDL

SEQ ID NO: 540017 - protein, 11 aa, Influenza virus
TGWPWPDGALL

SEQ ID NO: 540018 - protein, 11 aa, Influenza virus
TGWSWPDGALF

SEQ ID NO: 540019 - protein, 11 aa, Influenza virus
TGWSWPDGALL

SEQ ID NO: 540020 - protein, 11 aa, Influenza virus
TGYAQTDCVLE

SEQ ID NO: 540021 - protein, 11 aa, Influenza virus
TGYEKNATASF

SEQ ID NO: 540022 - protein, 11 aa, Influenza virus
TGYHFEECSCY

SEQ ID NO: 540023 - protein, 11 aa, Influenza virus
TGYICSKFHSD

SEQ ID NO: 540024 - protein, 11 aa, Influenza virus
TGYTMDTVNRT

SEQ ID NO: 540025 - protein, 11 aa, Influenza virus
TGYTMDTVSRT

SEQ ID NO: 540026 - protein, 11 aa, Influenza virus
TGYVCGKFHSD

SEQ ID NO: 540027 - protein, 11 aa, Influenza virus
TGYVCSKFHSD

SEQ ID NO: 540028 - protein, 11 aa, Influenza virus
THAKDILEKAH

SEQ ID NO: 540029 - protein, 11 aa, Influenza virus
THAKDILEKTH

SEQ ID NO: 540030 - protein, 11 aa, Influenza virus
THAKNILEKTH

SEQ ID NO: 540031 - protein, 11 aa, Influenza virus
THALRELWQCY

SEQ ID NO: 540032 - protein, 11 aa, Influenza virus
THAQDILEKTH

SEQ ID NO: 540033 - protein, 11 aa, Influenza virus
THAQDILERTH

SEQ ID NO: 540034 - protein, 11 aa, Influenza virus
THESECVCING

SEQ ID NO: 540035 - protein, 11 aa, Influenza virus
THFHRKRRVRD

SEQ ID NO: 540036 - protein, 11 aa, Influenza virus
THFQRKRRIRD

SEQ ID NO: 540037 - protein, 11 aa, Influenza virus
THFQRKRRVRD

SEQ ID NO: 540038 - protein, 11 aa, Influenza virus
THGALLNDKHS

SEQ ID NO: 540039 - protein, 11 aa, Influenza virus
THGSLLNDKHS

SEQ ID NO: 540040 - protein, 11 aa, Influenza virus
THHMRKKRGLF

SEQ ID NO: 540041 - protein, 11 aa, Influenza virus
THIHIFSFNGE

SEQ ID NO: 540042 - protein, 11 aa, Influenza virus
THIHIFSFTGE

SEQ ID NO: 540043 - protein, 11 aa, Influenza virus
THIMIWHSNLN

SEQ ID NO: 540044 - protein, 11 aa, Influenza virus
THISVGTSTLN

SEQ ID NO: 540045 - protein, 11 aa, Influenza virus
THKILTIYSTV

SEQ ID NO: 540046 - protein, 11 aa, Influenza virus
THKQLTHHMRK

SEQ ID NO: 540047 - protein, 11 aa, Influenza virus
THLEICFMYSD

SEQ ID NO: 540048 - protein, 11 aa, Influenza virus
THLEVCFMYSD

SEQ ID NO: 540049 - protein, 11 aa, Influenza virus
THLMIWHSNLN

SEQ ID NO: 540050 - protein, 11 aa, Influenza virus
THMEVCFMYSD

SEQ ID NO: 540051 - protein, 11 aa, Influenza virus
THMMIWHSNLN

SEQ ID NO: 540052 - protein, 11 aa, Influenza virus
THNGKLCKLNG

SEQ ID NO: 540053 - protein, 11 aa, Influenza virus
THNGKLCRLRG

SEQ ID NO: 540054 - protein, 11 aa, Influenza virus
THNGKLCRLSG

SEQ ID NO: 540055 - protein, 11 aa, Influenza virus
THSWIPKRNRS

SEQ ID NO: 540056 - protein, 11 aa, Influenza virus
THSWTPKRNRS

SEQ ID NO: 540057 - protein, 11 aa, Influenza virus
THSWVPILNTS

SEQ ID NO: 540058 - protein, 11 aa, Influenza virus
THSWVPKRNRS

SEQ ID NO: 540059 - protein, 11 aa, Influenza virus
THTSQYICSPI

SEQ ID NO: 540060 - protein, 11 aa, Influenza virus
THTSQYICSPV

SEQ ID NO: 540061 - protein, 11 aa, Influenza virus
TIAGFIEGGWP

SEQ ID NO: 540062 - protein, 11 aa, Influenza virus
TIALFIGVGNL

SEQ ID NO: 540063 - protein, 11 aa, Influenza virus
TIALIIGVGNL

SEQ ID NO: 540064 - protein, 11 aa, Influenza virus
TIALLIGIGNL

SEQ ID NO: 540065 - protein, 11 aa, Influenza virus
TIALLIGVGNL

SEQ ID NO: 540066 - protein, 11 aa, Influenza virus
TIASDILKRMS

SEQ ID NO: 540067 - protein, 11 aa, Influenza virus
TIASDILTRMS

SEQ ID NO: 540068 - protein, 11 aa, Influenza virus
TIASSLPFQNI

SEQ ID NO: 540069 - protein, 11 aa, Influenza virus
TICIGYHANNS

SEQ ID NO: 540070 - protein, 11 aa, Influenza virus
TICIQGNNDNA

SEQ ID NO: 540071 - protein, 11 aa, Influenza virus
TICVGYHANNS

SEQ ID NO: 540072 - protein, 11 aa, Influenza virus
TICVQGKNDNA

SEQ ID NO: 540073 - protein, 11 aa, Influenza virus
TICVQGNNDNA

SEQ ID NO: 540074 - protein, 11 aa, Influenza virus
TICVQGNNKNA

SEQ ID NO: 540075 - protein, 11 aa, Influenza virus
TICVQGNNNNA

SEQ ID NO: 540076 - protein, 11 aa, Influenza virus
TIDEESRARIK

SEQ ID NO: 540077 - protein, 11 aa, Influenza virus
TIDLADSEMDK

SEQ ID NO: 540078 - protein, 11 aa, Influenza virus
TIDLADSEMLN

SEQ ID NO: 540079 - protein, 11 aa, Influenza virus
TIDLADSEMNK

SEQ ID NO: 540080 - protein, 11 aa, Influenza virus
TIDLADSEMNN

SEQ ID NO: 540081 - protein, 11 aa, Influenza virus
TIDLAESEMNK

SEQ ID NO: 540082 - protein, 11 aa, Influenza virus
TIDLTDSEMNK

SEQ ID NO: 540083 - protein, 11 aa, Influenza virus
TIDLTDSEMSK

SEQ ID NO: 540084 - protein, 11 aa, Influenza virus
TIDMADSEMLN

SEQ ID NO: 540085 - protein, 11 aa, Influenza virus
TIDMADSTMLN

SEQ ID NO: 540086 - protein, 11 aa, Influenza virus
TIDMTDSEMNK

SEQ ID NO: 540087 - protein, 11 aa, Influenza virus
TIDQADSEMNK

SEQ ID NO: 540088 - protein, 11 aa, Influenza virus
TIDQVTGKLNR

SEQ ID NO: 540089 - protein, 11 aa, Influenza virus
TIDSTDSEMNK

SEQ ID NO: 540090 - protein, 11 aa, Influenza virus
TIDVTDSEMNK

SEQ ID NO: 540091 - protein, 11 aa, Influenza virus
TIEELRRQKSL

SEQ ID NO: 540092 - protein, 11 aa, Influenza virus
TIEELRRQKWW

SEQ ID NO: 540093 - protein, 11 aa, Influenza virus
TIEKMVLSAFD

SEQ ID NO: 540094 - protein, 11 aa, Influenza virus
TIERMVLSAFD

SEQ ID NO: 540095 - protein, 11 aa, Influenza virus
TIGDCPKYMNV

SEQ ID NO: 540096 - protein, 11 aa, Influenza virus
TIGDCPKYVNI

SEQ ID NO: 540097 - protein, 11 aa, Influenza virus
TIGDCPKYVNV

SEQ ID NO: 540098 - protein, 11 aa, Influenza virus
TIGECPKYIKS

SEQ ID NO: 540099 - protein, 11 aa, Influenza virus
TIGECPKYVKS

SEQ ID NO: 540100 - protein, 11 aa, Influenza virus
TIGECPKYVRS

SEQ ID NO: 540101 - protein, 11 aa, Influenza virus
TIGECPRYVKS

SEQ ID NO: 540102 - protein, 11 aa, Influenza virus
TIGISGPDDGA

SEQ ID NO: 540103 - protein, 11 aa, Influenza virus
TIGISGPDNEA

SEQ ID NO: 540104 - protein, 11 aa, Influenza virus
TIGISGPDNGA

SEQ ID NO: 540105 - protein, 11 aa, Influenza virus
TIGISGPDSGA

SEQ ID NO: 540106 - protein, 11 aa, Influenza virus
TIGITGPDATA

SEQ ID NO: 540107 - protein, 11 aa, Influenza virus
TIGKCPKYVKS

SEQ ID NO: 540108 - protein, 11 aa, Influenza virus
TIGKCSKYVKS

SEQ ID NO: 540109 - protein, 11 aa, Influenza virus
TIGLLLQITSL

SEQ ID NO: 540110 - protein, 11 aa, Influenza virus
TIGNLIAPRGH

SEQ ID NO: 540111 - protein, 11 aa, Influenza virus
TIGNLVAPRGH

SEQ ID NO: 540112 - protein, 11 aa, Influenza virus
TIGPLLQITSL

SEQ ID NO: 540113 - protein, 11 aa, Influenza virus
TIGSVSLIIAT

SEQ ID NO: 540114 - protein, 11 aa, Influenza virus
TIGSVSLTIAA

SEQ ID NO: 540115 - protein, 11 aa, Influenza virus
TIGSVSLTIAI

SEQ ID NO: 540116 - protein, 11 aa, Influenza virus
TIGSVSLTIAT

SEQ ID NO: 540117 - protein, 11 aa, Influenza virus
TIGSVSLTITT

SEQ ID NO: 540118 - protein, 11 aa, Influenza virus
TIGVSGPDNGA

SEQ ID NO: 540119 - protein, 11 aa, Influenza virus
TIHDRAAFRGL

SEQ ID NO: 540120 - protein, 11 aa, Influenza virus
TIHDRIPHRTL

SEQ ID NO: 540121 - protein, 11 aa, Influenza virus
TIHDRNAFRGL

SEQ ID NO: 540122 - protein, 11 aa, Influenza virus
TIHDRSPFRAL

SEQ ID NO: 540123 - protein, 11 aa, Influenza virus
TIHDRSPHRTL

SEQ ID NO: 540124 - protein, 11 aa, Influenza virus
TIHDRSPYRAL

SEQ ID NO: 540125 - protein, 11 aa, Influenza virus
TIHDRSQFRAL

SEQ ID NO: 540126 - protein, 11 aa, Influenza virus
TIHDRSQYRAL

SEQ ID NO: 540127 - protein, 11 aa, Influenza virus
TIHDRSQYRSL

SEQ ID NO: 540128 - protein, 11 aa, Influenza virus
TIHDRTAFRGL

SEQ ID NO: 540129 - protein, 11 aa, Influenza virus
TIHDRTPHRTL

SEQ ID NO: 540130 - protein, 11 aa, Influenza virus
TIHDRTTFRGL

SEQ ID NO: 540131 - protein, 11 aa, Influenza virus
TIHLTDSEMNK

SEQ ID NO: 540132 - protein, 11 aa, Influenza virus
TIIENNVTVTS

SEQ ID NO: 540133 - protein, 11 aa, Influenza virus
TIIESNITVTS

SEQ ID NO: 540134 - protein, 11 aa, Influenza virus
TIIESNVTVTS

SEQ ID NO: 540135 - protein, 11 aa, Influenza virus
TIIETGYVCSK

SEQ ID NO: 540136 - protein, 11 aa, Influenza virus
TIIGPPQCDLH

SEQ ID NO: 540137 - protein, 11 aa, Influenza virus
TIIGPPQCDSH

SEQ ID NO: 540138 - protein, 11 aa, Influenza virus
TIIKTLTNEKE

SEQ ID NO: 540139 - protein, 11 aa, Influenza virus
TIISNLPFQNI

SEQ ID NO: 540140 - protein, 11 aa, Influenza virus
TIISSLPFQNI

SEQ ID NO: 540141 - protein, 11 aa, Influenza virus
TIIYSSSMMWE

SEQ ID NO: 540142 - protein, 11 aa, Influenza virus
TIKDRSPYRTL

SEQ ID NO: 540143 - protein, 11 aa, Influenza virus
TIKNGTYDHKD

SEQ ID NO: 540144 - protein, 11 aa, Influenza virus
TIKNGTYDHKE

SEQ ID NO: 540145 - protein, 11 aa, Influenza virus
TIKNGTYNHKD

SEQ ID NO: 540146 - protein, 11 aa, Influenza virus
TIKNGTYNHKE

SEQ ID NO: 540147 - protein, 11 aa, Influenza virus
TIKNGTYNRKE

SEQ ID NO: 540148 - protein, 11 aa, Influenza virus
TIKPWARNILR

SEQ ID NO: 540149 - protein, 11 aa, Influenza virus
TIKQNGKSGAC

SEQ ID NO: 540150 - protein, 11 aa, Influenza virus
TIKTWAGKILR

SEQ ID NO: 540151 - protein, 11 aa, Influenza virus
TIKTWAGNILR

SEQ ID NO: 540152 - protein, 11 aa, Influenza virus
TIKTWAKNILR

SEQ ID NO: 540153 - protein, 11 aa, Influenza virus
TIKTWARNILR

SEQ ID NO: 540154 - protein, 11 aa, Influenza virus
TILEKNITVTH

SEQ ID NO: 540155 - protein, 11 aa, Influenza virus
TILEKNVTVTH

SEQ ID NO: 540156 - protein, 11 aa, Influenza virus
TILEQNVTVTH

SEQ ID NO: 540157 - protein, 11 aa, Influenza virus
TILERNVTVTH

SEQ ID NO: 540158 - protein, 11 aa, Influenza virus
TILETGYICSK

SEQ ID NO: 540159 - protein, 11 aa, Influenza virus
TILETGYVCGK

SEQ ID NO: 540160 - protein, 11 aa, Influenza virus
TILETGYVCSK

SEQ ID NO: 540161 - protein, 11 aa, Influenza virus
TILETRYVCSK

SEQ ID NO: 540162 - protein, 11 aa, Influenza virus
TILSTKALLIG

SEQ ID NO: 540163 - protein, 11 aa, Influenza virus
TIMEKNITVTH

SEQ ID NO: 540164 - protein, 11 aa, Influenza virus
TIMEKNVTVTH

SEQ ID NO: 540165 - protein, 11 aa, Influenza virus
TIMERNVTVTH

SEQ ID NO: 540166 - protein, 11 aa, Influenza virus
TINDRSPFRAL

SEQ ID NO: 540167 - protein, 11 aa, Influenza virus
TINDRTAFRGL

SEQ ID NO: 540168 - protein, 11 aa, Influenza virus
TINEEALRQKI

SEQ ID NO: 540169 - protein, 11 aa, Influenza virus
TINFESTGNLI

SEQ ID NO: 540170 - protein, 11 aa, Influenza virus
TINFESTGNLV

SEQ ID NO: 540171 - protein, 11 aa, Influenza virus
TINRIFQPNIG

SEQ ID NO: 540172 - protein, 11 aa, Influenza virus
TINRNFQPNIG

SEQ ID NO: 540173 - protein, 11 aa, Influenza virus
TINRSFQPNIG

SEQ ID NO: 540174 - protein, 11 aa, Influenza virus
TINRSFRPNIG

SEQ ID NO: 540175 - protein, 11 aa, Influenza virus
TINSPLPFQNI

SEQ ID NO: 540176 - protein, 11 aa, Influenza virus
TINSWHIFGKD

SEQ ID NO: 540177 - protein, 11 aa, Influenza virus
TINSWHIHGKD

SEQ ID NO: 540178 - protein, 11 aa, Influenza virus
TINSWHIYGKD

SEQ ID NO: 540179 - protein, 11 aa, Influenza virus
TINYYNETFVN

SEQ ID NO: 540180 - protein, 11 aa, Influenza virus
TIPCFWVEMIR

SEQ ID NO: 540181 - protein, 11 aa, Influenza virus
TIQNEDIPIGN

SEQ ID NO: 540182 - protein, 11 aa, Influenza virus
TIRGKHSNGTI

SEQ ID NO: 540183 - protein, 11 aa, Influenza virus
TIRGRHSNGTI

SEQ ID NO: 540184 - protein, 11 aa, Influenza virus
TIRNGTYNHED

SEQ ID NO: 540185 - protein, 11 aa, Influenza virus
TIRNKHSNGTI

SEQ ID NO: 540186 - protein, 11 aa, Influenza virus
TIRNKHSNGTT

SEQ ID NO: 540187 - protein, 11 aa, Influenza virus
TIRNKHSNSTT

SEQ ID NO: 540188 - protein, 11 aa, Influenza virus
TIRNRHSNGTI

SEQ ID NO: 540189 - protein, 11 aa, Influenza virus
TIRTWAKNILR

SEQ ID NO: 540190 - protein, 11 aa, Influenza virus
TISFESTGNLV

SEQ ID NO: 540191 - protein, 11 aa, Influenza virus
TISIASRSGYE

SEQ ID NO: 540192 - protein, 11 aa, Influenza virus
TISKDLRSGYE

SEQ ID NO: 540193 - protein, 11 aa, Influenza virus
TISKDSRSGYE

SEQ ID NO: 540194 - protein, 11 aa, Influenza virus
TISKDTRSGYE

SEQ ID NO: 540195 - protein, 11 aa, Influenza virus
TISLVKTTLFL

SEQ ID NO: 540196 - protein, 11 aa, Influenza virus
TISMDSRSGYE

SEQ ID NO: 540197 - protein, 11 aa, Influenza virus
TISPHSRSGFE

SEQ ID NO: 540198 - protein, 11 aa, Influenza virus
TISPKLRSGFE

SEQ ID NO: 540199 - protein, 11 aa, Influenza virus
TISPRLRSGFE

SEQ ID NO: 540200 - protein, 11 aa, Influenza virus
TISPRSRNGFE

SEQ ID NO: 540201 - protein, 11 aa, Influenza virus
TISPRSRSGFE

SEQ ID NO: 540202 - protein, 11 aa, Influenza virus
TISRDSRSGYE

SEQ ID NO: 540203 - protein, 11 aa, Influenza virus
TISSSLVLVGL

SEQ ID NO: 540204 - protein, 11 aa, Influenza virus
TISTASRAGYE

SEQ ID NO: 540205 - protein, 11 aa, Influenza virus
TISTASRSGYE

SEQ ID NO: 540206 - protein, 11 aa, Influenza virus
TISTASRYGYE

SEQ ID NO: 540207 - protein, 11 aa, Influenza virus
TITGDNTKWNE

SEQ ID NO: 540208 - protein, 11 aa, Influenza virus
TITLHFKQNEC

SEQ ID NO: 540209 - protein, 11 aa, Influenza virus
TITNPLIRHEN

SEQ ID NO: 540210 - protein, 11 aa, Influenza virus
TITSNLPFQNV

SEQ ID NO: 540211 - protein, 11 aa, Influenza virus
TITSPLPFQNI

SEQ ID NO: 540212 - protein, 11 aa, Influenza virus
TITYSSPMMWE

SEQ ID NO: 540213 - protein, 11 aa, Influenza virus
TITYSSSLMWE

SEQ ID NO: 540214 - protein, 11 aa, Influenza virus
TITYSSSMMWE

SEQ ID NO: 540215 - protein, 11 aa, Influenza virus
TIVETGYVCSK

SEQ ID NO: 540216 - protein, 11 aa, Influenza virus
TIVKTLTNEKE

SEQ ID NO: 540217 - protein, 11 aa, Influenza virus
TIVKTLTNEQE

SEQ ID NO: 540218 - protein, 11 aa, Influenza virus
TIVKTLTNERE

SEQ ID NO: 540219 - protein, 11 aa, Influenza virus
TIVKTLTSEKE

SEQ ID NO: 540220 - protein, 11 aa, Influenza virus
TIVLDTDWSGY

SEQ ID NO: 540221 - protein, 11 aa, Influenza virus
TIVLNTDWSGY

SEQ ID NO: 540222 - protein, 11 aa, Influenza virus
TIVLTTDWSGY

SEQ ID NO: 540223 - protein, 11 aa, Influenza virus
TIVSSLPFQNI

SEQ ID NO: 540224 - protein, 11 aa, Influenza virus
TIVSSLPFQSI

SEQ ID NO: 540225 - protein, 11 aa, Influenza virus
TIWASGSSISF

SEQ ID NO: 540226 - protein, 11 aa, Influenza virus
TIWTSASSISF

SEQ ID NO: 540227 - protein, 11 aa, Influenza virus
TIWTSGSIISF

SEQ ID NO: 540228 - protein, 11 aa, Influenza virus
TIWTSGSSIAF

SEQ ID NO: 540229 - protein, 11 aa, Influenza virus
TIWTSGSSISF

SEQ ID NO: 540230 - protein, 11 aa, Influenza virus
TIWTSSSSIVM

SEQ ID NO: 540231 - protein, 11 aa, Influenza virus
TIWTSSSSVVM

SEQ ID NO: 540232 - protein, 11 aa, Influenza virus
TIYWWDGLQSS

SEQ ID NO: 540233 - protein, 11 aa, Influenza virus
TKAPQLNPIDG

SEQ ID NO: 540234 - protein, 11 aa, Influenza virus
TKATKMEAILV

SEQ ID NO: 540235 - protein, 11 aa, Influenza virus
TKATKMKAIIV

SEQ ID NO: 540236 - protein, 11 aa, Influenza virus
TKATKMKAILV

SEQ ID NO: 540237 - protein, 11 aa, Influenza virus
TKATNGNYGPI

SEQ ID NO: 540238 - protein, 11 aa, Influenza virus
TKCQLNEGVMN

SEQ ID NO: 540239 - protein, 11 aa, Influenza virus
TKCQSPLGAIN

SEQ ID NO: 540240 - protein, 11 aa, Influenza virus
TKCQTPLGAIN

SEQ ID NO: 540241 - protein, 11 aa, Influenza virus
TKCQTPLGALN

SEQ ID NO: 540242 - protein, 11 aa, Influenza virus
TKCQTSVGGID

SEQ ID NO: 540243 - protein, 11 aa, Influenza virus
TKCQTSVGGIN

SEQ ID NO: 540244 - protein, 11 aa, Influenza virus
TKCQTYAGAIN

SEQ ID NO: 540245 - protein, 11 aa, Influenza virus
TKCQTYAGAVN

SEQ ID NO: 540246 - protein, 11 aa, Influenza virus
TKCQTYTGAIN

SEQ ID NO: 540247 - protein, 11 aa, Influenza virus
TKDAERGKLKR

SEQ ID NO: 540248 - protein, 11 aa, Influenza virus
TKDNSIRIGSK

SEQ ID NO: 540249 - protein, 11 aa, Influenza virus
TKDSITDIWTY

SEQ ID NO: 540250 - protein, 11 aa, Influenza virus
TKEAQDVIMEV

SEQ ID NO: 540251 - protein, 11 aa, Influenza virus
TKEGRRKTNLY

SEQ ID NO: 540252 - protein, 11 aa, Influenza virus
TKEGRRRTNLY

SEQ ID NO: 540253 - protein, 11 aa, Influenza virus
TKEMEGICYPG

SEQ ID NO: 540254 - protein, 11 aa, Influenza virus
TKENTGSYVRL

SEQ ID NO: 540255 - protein, 11 aa, Influenza virus
TKEQTALYKNA

SEQ ID NO: 540256 - protein, 11 aa, Influenza virus
TKEQTTLYKNA

SEQ ID NO: 540257 - protein, 11 aa, Influenza virus
TKETNGNYGPI

SEQ ID NO: 540258 - protein, 11 aa, Influenza virus
TKEWSKRYELE

SEQ ID NO: 540259 - protein, 11 aa, Influenza virus
TKEWSRRYELE

SEQ ID NO: 540260 - protein, 11 aa, Influenza virus
TKGDKICLGHH

SEQ ID NO: 540261 - protein, 11 aa, Influenza virus
TKGEKANVLIG

SEQ ID NO: 540262 - protein, 11 aa, Influenza virus
TKGILGFVFTL

SEQ ID NO: 540263 - protein, 11 aa, Influenza virus
TKGKKAVDLGS

SEQ ID NO: 540264 - protein, 11 aa, Influenza virus
TKGLCIINSWH

SEQ ID NO: 540265 - protein, 11 aa, Influenza virus
TKGLCTINSWH

SEQ ID NO: 540266 - protein, 11 aa, Influenza virus
TKGMLGFVFTL

SEQ ID NO: 540267 - protein, 11 aa, Influenza virus
TKGVLGFVFTL

SEQ ID NO: 540268 - protein, 11 aa, Influenza virus
TKHDRIPHRTL

SEQ ID NO: 540269 - protein, 11 aa, Influenza virus
TKIDLWSYNAE

SEQ ID NO: 540270 - protein, 11 aa, Influenza virus
TKIDLWSYNAG

SEQ ID NO: 540271 - protein, 11 aa, Influenza virus
TKINNIIDKMN

SEQ ID NO: 540272 - protein, 11 aa, Influenza virus
TKINNIIEKMN

SEQ ID NO: 540273 - protein, 11 aa, Influenza virus
TKINTLTERGV

SEQ ID NO: 540274 - protein, 11 aa, Influenza virus
TKITVDHMAII

SEQ ID NO: 540275 - protein, 11 aa, Influenza virus
TKKEPDTYDFN

SEQ ID NO: 540276 - protein, 11 aa, Influenza virus
TKKKNPEAYNF

SEQ ID NO: 540277 - protein, 11 aa, Influenza virus
TKKKPDIYDFN

SEQ ID NO: 540278 - protein, 11 aa, Influenza virus
TKKKPDTYDFN

SEQ ID NO: 540279 - protein, 11 aa, Influenza virus
TKKMTITFLIL

SEQ ID NO: 540280 - protein, 11 aa, Influenza virus
TKKQLRENAED

SEQ ID NO: 540281 - protein, 11 aa, Influenza virus
TKLGSPLVLDD

SEQ ID NO: 540282 - protein, 11 aa, Influenza virus
TKLPFQNLSPR

SEQ ID NO: 540283 - protein, 11 aa, Influenza virus
TKLYGNGNKLI

SEQ ID NO: 540284 - protein, 11 aa, Influenza virus
TKLYGNGNKLV

SEQ ID NO: 540285 - protein, 11 aa, Influenza virus
TKLYGSGNKLI

SEQ ID NO: 540286 - protein, 11 aa, Influenza virus
TKLYGSGNKLV

SEQ ID NO: 540287 - protein, 11 aa, Influenza virus
TKLYGSGSKLI

SEQ ID NO: 540288 - protein, 11 aa, Influenza virus
TKLYKNTNTLS

SEQ ID NO: 540289 - protein, 11 aa, Influenza virus
TKLYVNKNPYT

SEQ ID NO: 540290 - protein, 11 aa, Influenza virus
TKMEAILVVLL

SEQ ID NO: 540291 - protein, 11 aa, Influenza virus
TKMKAIIVVLL

SEQ ID NO: 540292 - protein, 11 aa, Influenza virus
TKMKAILVVLL

SEQ ID NO: 540293 - protein, 11 aa, Influenza virus
TKNLESRSGFE

SEQ ID NO: 540294 - protein, 11 aa, Influenza virus
TKPRPRRGLFG

SEQ ID NO: 540295 - protein, 11 aa, Influenza virus
TKQVCAAWSSS

SEQ ID NO: 540296 - protein, 11 aa, Influenza virus
TKQVCIAWSSS

SEQ ID NO: 540297 - protein, 11 aa, Influenza virus
TKQVCMAWSSS

SEQ ID NO: 540298 - protein, 11 aa, Influenza virus
TKQVCVAWSSS

SEQ ID NO: 540299 - protein, 11 aa, Influenza virus
TKRIRMAINLV

SEQ ID NO: 540300 - protein, 11 aa, Influenza virus
TKRIRMAINQC

SEQ ID NO: 540301 - protein, 11 aa, Influenza virus
TKRIRMAINWG

SEQ ID NO: 540302 - protein, 11 aa, Influenza virus
TKRIRMAINYS

SEQ ID NO: 540303 - protein, 11 aa, Influenza virus
TKRLCTINSWH

SEQ ID NO: 540304 - protein, 11 aa, Influenza virus
TKRQLRENAED

SEQ ID NO: 540305 - protein, 11 aa, Influenza virus
TKRSHEQMETG

SEQ ID NO: 540306 - protein, 11 aa, Influenza virus
TKRSYEQMETD

SEQ ID NO: 540307 - protein, 11 aa, Influenza virus
TKRSYEQMETG

SEQ ID NO: 540308 - protein, 11 aa, Influenza virus
TKRSYEQMETS

SEQ ID NO: 540309 - protein, 11 aa, Influenza virus
TKSLESRSGFE

SEQ ID NO: 540310 - protein, 11 aa, Influenza virus
TKSTVLKSDKR

SEQ ID NO: 540311 - protein, 11 aa, Influenza virus
TKSYFANLKGT

SEQ ID NO: 540312 - protein, 11 aa, Influenza virus
TKTMTITFLIL

SEQ ID NO: 540313 - protein, 11 aa, Influenza virus
TKTTVDHMAII

SEQ ID NO: 540314 - protein, 11 aa, Influenza virus
TKTTVDHMAVI

SEQ ID NO: 540315 - protein, 11 aa, Influenza virus
TKVDLWSYNAE

SEQ ID NO: 540316 - protein, 11 aa, Influenza virus
TKVNTLTEKGI

SEQ ID NO: 540317 - protein, 11 aa, Influenza virus
TKVNTLTEKGV

SEQ ID NO: 540318 - protein, 11 aa, Influenza virus
TKVNTLTERGI

SEQ ID NO: 540319 - protein, 11 aa, Influenza virus
TKVNTLTERGV

SEQ ID NO: 540320 - protein, 11 aa, Influenza virus
TKWNENQNPRI

SEQ ID NO: 540321 - protein, 11 aa, Influenza virus
TKWNENQNPRM

SEQ ID NO: 540322 - protein, 11 aa, Influenza virus
TKWNENQNPRV

SEQ ID NO: 540323 - protein, 11 aa, Influenza virus
TKWNVTHTGTS

SEQ ID NO: 540324 - protein, 11 aa, Influenza virus
TKWNVTYTGIS

SEQ ID NO: 540325 - protein, 11 aa, Influenza virus
TKWNVTYTGTS

SEQ ID NO: 540326 - protein, 11 aa, Influenza virus
TLCICYHANNS

SEQ ID NO: 540327 - protein, 11 aa, Influenza virus
TLCIGYHANNS

SEQ ID NO: 540328 - protein, 11 aa, Influenza virus
TLCLGHHAVAN

SEQ ID NO: 540329 - protein, 11 aa, Influenza virus
TLCLGHHAVPN

SEQ ID NO: 540330 - protein, 11 aa, Influenza virus
TLCLGHHAVQN

SEQ ID NO: 540331 - protein, 11 aa, Influenza virus
TLCLGHHAVSN

SEQ ID NO: 540332 - protein, 11 aa, Influenza virus
TLDEESRARIK

SEQ ID NO: 540333 - protein, 11 aa, Influenza virus
TLDEHDANVRN

SEQ ID NO: 540334 - protein, 11 aa, Influenza virus
TLDEHDSNVEN

SEQ ID NO: 540335 - protein, 11 aa, Influenza virus
TLDEHDSNVKN

SEQ ID NO: 540336 - protein, 11 aa, Influenza virus
TLDFHDSNVKN

SEQ ID NO: 540337 - protein, 11 aa, Influenza virus
TLDFHDSNVKS

SEQ ID NO: 540338 - protein, 11 aa, Influenza virus
TLDFHDSNVRN

SEQ ID NO: 540339 - protein, 11 aa, Influenza virus
TLDFHDSSVKN

SEQ ID NO: 540340 - protein, 11 aa, Influenza virus
TLDKHDSNVKN

SEQ ID NO: 540341 - protein, 11 aa, Influenza virus
TLDLHDANVKN

SEQ ID NO: 540342 - protein, 11 aa, Influenza virus
TLDLHDANVRN

SEQ ID NO: 540343 - protein, 11 aa, Influenza virus
TLDLHDSNVKN

SEQ ID NO: 540344 - protein, 11 aa, Influenza virus
TLDLHDSNVRN

SEQ ID NO: 540345 - protein, 11 aa, Influenza virus
TLDLHDSNVRS

SEQ ID NO: 540346 - protein, 11 aa, Influenza virus
TLDMHDANVKN

SEQ ID NO: 540347 - protein, 11 aa, Influenza virus
TLDMHDANVRN

SEQ ID NO: 540348 - protein, 11 aa, Influenza virus
TLDNKHSNDTI

SEQ ID NO: 540349 - protein, 11 aa, Influenza virus
TLDNKHSNDTV

SEQ ID NO: 540350 - protein, 11 aa, Influenza virus
TLDNKHSNGTI

SEQ ID NO: 540351 - protein, 11 aa, Influenza virus
TLEHTSRYVCT

SEQ ID NO: 540352 - protein, 11 aa, Influenza virus
TLELRSGYWAI

SEQ ID NO: 540353 - protein, 11 aa, Influenza virus
TLELRSKYWAI

SEQ ID NO: 540354 - protein, 11 aa, Influenza virus
TLELRSRYWAI

SEQ ID NO: 540355 - protein, 11 aa, Influenza virus
TLENKHSNGTK

SEQ ID NO: 540356 - protein, 11 aa, Influenza virus
TLFEKFFPSSS

SEQ ID NO: 540357 - protein, 11 aa, Influenza virus
TLFQQMRDILG

SEQ ID NO: 540358 - protein, 11 aa, Influenza virus
TLFQQMRDVIG

SEQ ID NO: 540359 - protein, 11 aa, Influenza virus
TLFQQMRDVLG

SEQ ID NO: 540360 - protein, 11 aa, Influenza virus
TLGITGPDATA

SEQ ID NO: 540361 - protein, 11 aa, Influenza virus
TLGITGPDSTA

SEQ ID NO: 540362 - protein, 11 aa, Influenza virus
TLGITGPDTTA

SEQ ID NO: 540363 - protein, 11 aa, Influenza virus
TLGLDIRTATR

SEQ ID NO: 540364 - protein, 11 aa, Influenza virus
TLGLHDANVRN

SEQ ID NO: 540365 - protein, 11 aa, Influenza virus
TLIDALLGDPH

SEQ ID NO: 540366 - protein, 11 aa, Influenza virus
TLIDALLGDPQ

SEQ ID NO: 540367 - protein, 11 aa, Influenza virus
TLIDSLLGDPH

SEQ ID NO: 540368 - protein, 11 aa, Influenza virus
TLIENTYVNNT

SEQ ID NO: 540369 - protein, 11 aa, Influenza virus
TLIEQKVPVTQ

SEQ ID NO: 540370 - protein, 11 aa, Influenza virus
TLIEQNIPVTQ

SEQ ID NO: 540371 - protein, 11 aa, Influenza virus
TLIEQNVPVTQ

SEQ ID NO: 540372 - protein, 11 aa, Influenza virus
TLISWEMGQAP

SEQ ID NO: 540373 - protein, 11 aa, Influenza virus
TLITDGPSDAQ

SEQ ID NO: 540374 - protein, 11 aa, Influenza virus
TLITDGPSNAQ

SEQ ID NO: 540375 - protein, 11 aa, Influenza virus
TLKGRHANGTI

SEQ ID NO: 540376 - protein, 11 aa, Influenza virus
TLKIRTNGNLI

SEQ ID NO: 540377 - protein, 11 aa, Influenza virus
TLKLATGMRNI

SEQ ID NO: 540378 - protein, 11 aa, Influenza virus
TLKLATGMRNV

SEQ ID NO: 540379 - protein, 11 aa, Influenza virus
TLKLGQFPVQT

SEQ ID NO: 540380 - protein, 11 aa, Influenza virus
TLKSEQFPVQT

SEQ ID NO: 540381 - protein, 11 aa, Influenza virus
TLKSGQFPVQT

SEQ ID NO: 540382 - protein, 11 aa, Influenza virus
TLKSWKGNIMR

SEQ ID NO: 540383 - protein, 11 aa, Influenza virus
TLKVESNGNLI

SEQ ID NO: 540384 - protein, 11 aa, Influenza virus
TLLAKSVFNCL

SEQ ID NO: 540385 - protein, 11 aa, Influenza virus
TLLAKSVFNNL

SEQ ID NO: 540386 - protein, 11 aa, Influenza virus
TLLAKSVFNSI

SEQ ID NO: 540387 - protein, 11 aa, Influenza virus
TLLAKSVFNSL

SEQ ID NO: 540388 - protein, 11 aa, Influenza virus
TLLEKNVTVTH

SEQ ID NO: 540389 - protein, 11 aa, Influenza virus
TLLENDVPVTS

SEQ ID NO: 540390 - protein, 11 aa, Influenza virus
TLLENGVPVTS

SEQ ID NO: 540391 - protein, 11 aa, Influenza virus
TLLENNVPVTS

SEQ ID NO: 540392 - protein, 11 aa, Influenza virus
TLLESDVPVTS

SEQ ID NO: 540393 - protein, 11 aa, Influenza virus
TLLKHRFEIIE

SEQ ID NO: 540394 - protein, 11 aa, Influenza virus
TLLMNELGIPF

SEQ ID NO: 540395 - protein, 11 aa, Influenza virus
TLLMNELGVPF

SEQ ID NO: 540396 - protein, 11 aa, Influenza virus
TLLMNELGVPL

SEQ ID NO: 540397 - protein, 11 aa, Influenza virus
TLLMNELGVSF

SEQ ID NO: 540398 - protein, 11 aa, Influenza virus
TLLMSELGVPF

SEQ ID NO: 540399 - protein, 11 aa, Influenza virus
TLMDALLGDPH

SEQ ID NO: 540400 - protein, 11 aa, Influenza virus
TLMEQNVPVTQ

SEQ ID NO: 540401 - protein, 11 aa, Influenza virus
TLMSCHIGVAP

SEQ ID NO: 540402 - protein, 11 aa, Influenza virus
TLMSCPIGVAP

SEQ ID NO: 540403 - protein, 11 aa, Influenza virus
TLMSCPMGVAP

SEQ ID NO: 540404 - protein, 11 aa, Influenza virus
TLMSCPVGVAP

SEQ ID NO: 540405 - protein, 11 aa, Influenza virus
TLMTDGPSDAQ

SEQ ID NO: 540406 - protein, 11 aa, Influenza virus
TLNIESNGNLI

SEQ ID NO: 540407 - protein, 11 aa, Influenza virus
TLNMHDANVRN

SEQ ID NO: 540408 - protein, 11 aa, Influenza virus
TLNNKHSNGTI

SEQ ID NO: 540409 - protein, 11 aa, Influenza virus
TLNRNQPAATA

SEQ ID NO: 540410 - protein, 11 aa, Influenza virus
TLNTASRSGYE

SEQ ID NO: 540411 - protein, 11 aa, Influenza virus
TLNTMTKDAER

SEQ ID NO: 540412 - protein, 11 aa, Influenza virus
TLNVESNGNLI

SEQ ID NO: 540413 - protein, 11 aa, Influenza virus
TLNVESNGNLV

SEQ ID NO: 540414 - protein, 11 aa, Influenza virus
TLPFHNIHPLA

SEQ ID NO: 540415 - protein, 11 aa, Influenza virus
TLPFHNIHPLT

SEQ ID NO: 540416 - protein, 11 aa, Influenza virus
TLPFHNVHPLT

SEQ ID NO: 540417 - protein, 11 aa, Influenza virus
TLPRRSGAAGA

SEQ ID NO: 540418 - protein, 11 aa, Influenza virus
TLRGQHANGTI

SEQ ID NO: 540419 - protein, 11 aa, Influenza virus
TLRGRHANGTI

SEQ ID NO: 540420 - protein, 11 aa, Influenza virus
TLRGRHANGTM

SEQ ID NO: 540421 - protein, 11 aa, Influenza virus
TLRSLVASSGN

SEQ ID NO: 540422 - protein, 11 aa, Influenza virus
TLRTQESECAC

SEQ ID NO: 540423 - protein, 11 aa, Influenza virus
TLSEQNVPVTQ

SEQ ID NO: 540424 - protein, 11 aa, Influenza virus
TLSGVAIALSV

SEQ ID NO: 540425 - protein, 11 aa, Influenza virus
TLSSGYKDIIL

SEQ ID NO: 540426 - protein, 11 aa, Influenza virus
TLSSVNTNTIN

SEQ ID NO: 540427 - protein, 11 aa, Influenza virus
TLSSVTTNTIN

SEQ ID NO: 540428 - protein, 11 aa, Influenza virus
TLTDNHVEVVS

SEQ ID NO: 540429 - protein, 11 aa, Influenza virus
TLTEKGIEVVN

SEQ ID NO: 540430 - protein, 11 aa, Influenza virus
TLTEKGVEVVN

SEQ ID NO: 540431 - protein, 11 aa, Influenza virus
TLTENGVPVTS

SEQ ID NO: 540432 - protein, 11 aa, Influenza virus
TLTEQNVPVTQ

SEQ ID NO: 540433 - protein, 11 aa, Influenza virus
TLTEREVEVVN

SEQ ID NO: 540434 - protein, 11 aa, Influenza virus
TLTERGIEVVN

SEQ ID NO: 540435 - protein, 11 aa, Influenza virus
TLTERGVEVVD

SEQ ID NO: 540436 - protein, 11 aa, Influenza virus
TLTERGVEVVN

SEQ ID NO: 540437 - protein, 11 aa, Influenza virus
TLTETGVPVTS

SEQ ID NO: 540438 - protein, 11 aa, Influenza virus
TLTGRGIEVVN

SEQ ID NO: 540439 - protein, 11 aa, Influenza virus
TLTLNTMTKDA

SEQ ID NO: 540440 - protein, 11 aa, Influenza virus
TLTMGYKDIIL

SEQ ID NO: 540441 - protein, 11 aa, Influenza virus
TLTSVTTNTIN

SEQ ID NO: 540442 - protein, 11 aa, Influenza virus
TLTVPSERGLQ

SEQ ID NO: 540443 - protein, 11 aa, Influenza virus
TLVANNDWSGY

SEQ ID NO: 540444 - protein, 11 aa, Influenza virus
TLVDALLGDPH

SEQ ID NO: 540445 - protein, 11 aa, Influenza virus
TLVNPGDSIIF

SEQ ID NO: 540446 - protein, 11 aa, Influenza virus
TLVSNNDWSGY

SEQ ID NO: 540447 - protein, 11 aa, Influenza virus
TLVSNSDWSGY

SEQ ID NO: 540448 - protein, 11 aa, Influenza virus
TLVSTKEWSKR

SEQ ID NO: 540449 - protein, 11 aa, Influenza virus
TLVSTKEWSRR

SEQ ID NO: 540450 - protein, 11 aa, Influenza virus
TLVTDGPSDAQ

SEQ ID NO: 540451 - protein, 11 aa, Influenza virus
TLYFHDSNVKN

SEQ ID NO: 540452 - protein, 11 aa, Influenza virus
TLYKNANTLSS

SEQ ID NO: 540453 - protein, 11 aa, Influenza virus
TLYKNANTLTS

SEQ ID NO: 540454 - protein, 11 aa, Influenza virus
TMDTVNRTHQY

SEQ ID NO: 540455 - protein, 11 aa, Influenza virus
TMDTVSRTHQY

SEQ ID NO: 540456 - protein, 11 aa, Influenza virus
TMDYYWGILKR

SEQ ID NO: 540457 - protein, 11 aa, Influenza virus
TMGYKDIILWI

SEQ ID NO: 540458 - protein, 11 aa, Influenza virus
TMHDRSPFRAL

SEQ ID NO: 540459 - protein, 11 aa, Influenza virus
TMHQLLRHFQK

SEQ ID NO: 540460 - protein, 11 aa, Influenza virus
TMKDRSPYRTL

SEQ ID NO: 540461 - protein, 11 aa, Influenza virus
TMLNLYERVRK

SEQ ID NO: 540462 - protein, 11 aa, Influenza virus
TMTHTSQYICS

SEQ ID NO: 540463 - protein, 11 aa, Influenza virus
TMTITFLILLF

SEQ ID NO: 540464 - protein, 11 aa, Influenza virus
TMTKDAERGKL

SEQ ID NO: 540465 - protein, 11 aa, Influenza virus
TNADKICLGHH

SEQ ID NO: 540466 - protein, 11 aa, Influenza virus
TNAHDRICIGY

SEQ ID NO: 540467 - protein, 11 aa, Influenza virus
TNAYDRICIGY

SEQ ID NO: 540468 - protein, 11 aa, Influenza virus
TNDKYHQIEKE

SEQ ID NO: 540469 - protein, 11 aa, Influenza virus
TNEEALRQIIR

SEQ ID NO: 540470 - protein, 11 aa, Influenza virus
TNEKFHQIEKE

SEQ ID NO: 540471 - protein, 11 aa, Influenza virus
TNEKYHQIEKE

SEQ ID NO: 540472 - protein, 11 aa, Influenza virus
TNGEQILIIWG

SEQ ID NO: 540473 - protein, 11 aa, Influenza virus
TNGNLIAPEFG

SEQ ID NO: 540474 - protein, 11 aa, Influenza virus
TNGNLIAPEYG

SEQ ID NO: 540475 - protein, 11 aa, Influenza virus
TNGNYGPINVT

SEQ ID NO: 540476 - protein, 11 aa, Influenza virus
TNGTSKIKMKW

SEQ ID NO: 540477 - protein, 11 aa, Influenza virus
TNGTSKVKMKW

SEQ ID NO: 540478 - protein, 11 aa, Influenza virus
TNGTTGNPIIC

SEQ ID NO: 540479 - protein, 11 aa, Influenza virus
TNHQFELIDNE

SEQ ID NO: 540480 - protein, 11 aa, Influenza virus
TNHTDELCPSP

SEQ ID NO: 540481 - protein, 11 aa, Influenza virus
TNHTGTYCSLN

SEQ ID NO: 540482 - protein, 11 aa, Influenza virus
TNINIREWSYL

SEQ ID NO: 540483 - protein, 11 aa, Influenza virus
TNKFAAICTHL

SEQ ID NO: 540484 - protein, 11 aa, Influenza virus
TNKFAAICTHM

SEQ ID NO: 540485 - protein, 11 aa, Influenza virus
TNKFAAVCTHL

SEQ ID NO: 540486 - protein, 11 aa, Influenza virus
TNKFASICTHL

SEQ ID NO: 540487 - protein, 11 aa, Influenza virus
TNKINNIVDKM

SEQ ID NO: 540488 - protein, 11 aa, Influenza virus
TNKINSIIDKM

SEQ ID NO: 540489 - protein, 11 aa, Influenza virus
TNKLAAICTHL

SEQ ID NO: 540490 - protein, 11 aa, Influenza virus
TNKQFELIDNE

SEQ ID NO: 540491 - protein, 11 aa, Influenza virus
TNKTFQNIDKN

SEQ ID NO: 540492 - protein, 11 aa, Influenza virus
TNKTFQNIDRN

SEQ ID NO: 540493 - protein, 11 aa, Influenza virus
TNKTFQNIEKN

SEQ ID NO: 540494 - protein, 11 aa, Influenza virus
TNKTFQNIERN

SEQ ID NO: 540495 - protein, 11 aa, Influenza virus
TNKVNNIVDKM

SEQ ID NO: 540496 - protein, 11 aa, Influenza virus
TNKVNSIIDKM

SEQ ID NO: 540497 - protein, 11 aa, Influenza virus
TNKVNSIIGKM

SEQ ID NO: 540498 - protein, 11 aa, Influenza virus
TNKVNSIINKM

SEQ ID NO: 540499 - protein, 11 aa, Influenza virus
TNLGLNIGLHL

SEQ ID NO: 540500 - protein, 11 aa, Influenza virus
TNLYGFIIKGR

SEQ ID NO: 540501 - protein, 11 aa, Influenza virus
TNLYGFIVKGR

SEQ ID NO: 540502 - protein, 11 aa, Influenza virus
TNLYVNKNPYT

SEQ ID NO: 540503 - protein, 11 aa, Influenza virus
TNMINDKIDDQ

SEQ ID NO: 540504 - protein, 11 aa, Influenza virus
TNNSTDTVNTL

SEQ ID NO: 540505 - protein, 11 aa, Influenza virus
TNNSTETVNTL

SEQ ID NO: 540506 - protein, 11 aa, Influenza virus
TNNYGVKGFGF

SEQ ID NO: 540507 - protein, 11 aa, Influenza virus
TNPLIKHENRM

SEQ ID NO: 540508 - protein, 11 aa, Influenza virus
TNPLIRHENRM

SEQ ID NO: 540509 - protein, 11 aa, Influenza virus
TNQQFELIDNE

SEQ ID NO: 540510 - protein, 11 aa, Influenza virus
TNQQFELIDNK

SEQ ID NO: 540511 - protein, 11 aa, Influenza virus
TNQQFELIGNE

SEQ ID NO: 540512 - protein, 11 aa, Influenza virus
TNQQFELINNE

SEQ ID NO: 540513 - protein, 11 aa, Influenza virus
TNQQFEMIDNE

SEQ ID NO: 540514 - protein, 11 aa, Influenza virus
TNQQFGLIDNE

SEQ ID NO: 540515 - protein, 11 aa, Influenza virus
TNQQFKLIDNE

SEQ ID NO: 540516 - protein, 11 aa, Influenza virus
TNQRGILEDEQ

SEQ ID NO: 540517 - protein, 11 aa, Influenza virus
TNRTFQNIDKN

SEQ ID NO: 540518 - protein, 11 aa, Influenza virus
TNRTFQNIDRN

SEQ ID NO: 540519 - protein, 11 aa, Influenza virus
TNSIVVFCGTS

SEQ ID NO: 540520 - protein, 11 aa, Influenza virus
TNSSDKVDTLL

SEQ ID NO: 540521 - protein, 11 aa, Influenza virus
TNSSEKVDTLL

SEQ ID NO: 540522 - protein, 11 aa, Influenza virus
TNSSEKVNTLL

SEQ ID NO: 540523 - protein, 11 aa, Influenza virus
TNSSERVDTLL

SEQ ID NO: 540524 - protein, 11 aa, Influenza virus
TNSTEKVDTLL

SEQ ID NO: 540525 - protein, 11 aa, Influenza virus
TNTEFESIESE

SEQ ID NO: 540526 - protein, 11 aa, Influenza virus
TNTINRIFQPN

SEQ ID NO: 540527 - protein, 11 aa, Influenza virus
TNTINRNFQPN

SEQ ID NO: 540528 - protein, 11 aa, Influenza virus
TNTINRSFQPN

SEQ ID NO: 540529 - protein, 11 aa, Influenza virus
TNTINRSFRPN

SEQ ID NO: 540530 - protein, 11 aa, Influenza virus
TNTLSSVTTNT

SEQ ID NO: 540531 - protein, 11 aa, Influenza virus
TNTQFELIDNE

SEQ ID NO: 540532 - protein, 11 aa, Influenza virus
TNTTLIENTYV

SEQ ID NO: 540533 - protein, 11 aa, Influenza virus
TNWSGYSGSFV

SEQ ID NO: 540534 - protein, 11 aa, Influenza virus
TNYYNETFVNM

SEQ ID NO: 540535 - protein, 11 aa, Influenza virus
TNYYNETFVNV

SEQ ID NO: 540536 - protein, 11 aa, Influenza virus
TPDPGVKGFAF

SEQ ID NO: 540537 - protein, 11 aa, Influenza virus
TPGMQIRGFVH

SEQ ID NO: 540538 - protein, 11 aa, Influenza virus
TPGMQIRGFVY

SEQ ID NO: 540539 - protein, 11 aa, Influenza virus
TPHRTLLMNEL

SEQ ID NO: 540540 - protein, 11 aa, Influenza virus
TPIAFLTSSIV

SEQ ID NO: 540541 - protein, 11 aa, Influenza virus
TPKRNRSILNT

SEQ ID NO: 540542 - protein, 11 aa, Influenza virus
TPLELRDCKIE

SEQ ID NO: 540543 - protein, 11 aa, Influenza virus
TPLGAINTTLP

SEQ ID NO: 540544 - protein, 11 aa, Influenza virus
TPLGALNTTLP

SEQ ID NO: 540545 - protein, 11 aa, Influenza virus
TPLGSPPIVSN

SEQ ID NO: 540546 - protein, 11 aa, Influenza virus
TPLGSPPMVSN

SEQ ID NO: 540547 - protein, 11 aa, Influenza virus
TPLGSPPVVSN

SEQ ID NO: 540548 - protein, 11 aa, Influenza virus
TPLGTPPTVSN

SEQ ID NO: 540549 - protein, 11 aa, Influenza virus
TPNGSIPNDKP

SEQ ID NO: 540550 - protein, 11 aa, Influenza virus
TPNGSIPNEKP

SEQ ID NO: 540551 - protein, 11 aa, Influenza virus
TPNGSIPNGKP

SEQ ID NO: 540552 - protein, 11 aa, Influenza virus
TPNGSIPNNKP

SEQ ID NO: 540553 - protein, 11 aa, Influenza virus
TPNGSISNDKP

SEQ ID NO: 540554 - protein, 11 aa, Influenza virus
TPRNDDSSSNS

SEQ ID NO: 540555 - protein, 11 aa, Influenza virus
TPRNDDSSSSS

SEQ ID NO: 540556 - protein, 11 aa, Influenza virus
TPRNEDGSSSS

SEQ ID NO: 540557 - protein, 11 aa, Influenza virus
TPRNEDSSSNS

SEQ ID NO: 540558 - protein, 11 aa, Influenza virus
TPRNEDSSSSS

SEQ ID NO: 540559 - protein, 11 aa, Influenza virus
TPSAIDQITGK

SEQ ID NO: 540560 - protein, 11 aa, Influenza virus
TPSIDPKGLFG

SEQ ID NO: 540561 - protein, 11 aa, Influenza virus
TPSIEPKGLFG

SEQ ID NO: 540562 - protein, 11 aa, Influenza virus
TPSIEPRGLFG

SEQ ID NO: 540563 - protein, 11 aa, Influenza virus
TPSVEPKGLFG

SEQ ID NO: 540564 - protein, 11 aa, Influenza virus
TPSVEPRGLFG

SEQ ID NO: 540565 - protein, 11 aa, Influenza virus
TPTKSYFANLK

SEQ ID NO: 540566 - protein, 11 aa, Influenza virus
TPYRSLIQFPI

SEQ ID NO: 540567 - protein, 11 aa, Influenza virus
TPYRSLIQFPM

SEQ ID NO: 540568 - protein, 11 aa, Influenza virus
TPYRSLIRFPI

SEQ ID NO: 540569 - protein, 11 aa, Influenza virus
TPYRSLIRFPV

SEQ ID NO: 540570 - protein, 11 aa, Influenza virus
TPYRTLLMNEL

SEQ ID NO: 540571 - protein, 11 aa, Influenza virus
TQAAIDQINGK

SEQ ID NO: 540572 - protein, 11 aa, Influenza virus
TQAAIDQITGK

SEQ ID NO: 540573 - protein, 11 aa, Influenza virus
TQAAIDQVNGK

SEQ ID NO: 540574 - protein, 11 aa, Influenza virus
TQAAINQINGK

SEQ ID NO: 540575 - protein, 11 aa, Influenza virus
TQAAVDQITGK

SEQ ID NO: 540576 - protein, 11 aa, Influenza virus
TQAMELVEAEK

SEQ ID NO: 540577 - protein, 11 aa, Influenza virus
TQATIDQITGK

SEQ ID NO: 540578 - protein, 11 aa, Influenza virus
TQCQITGFAPF

SEQ ID NO: 540579 - protein, 11 aa, Influenza virus
TQCQTPLGAIN

SEQ ID NO: 540580 - protein, 11 aa, Influenza virus
TQDAMTEVWSY

SEQ ID NO: 540581 - protein, 11 aa, Influenza virus
TQDSECVSHNG

SEQ ID NO: 540582 - protein, 11 aa, Influenza virus
TQEAIDKITNK

SEQ ID NO: 540583 - protein, 11 aa, Influenza virus
TQEAIEKITNK

SEQ ID NO: 540584 - protein, 11 aa, Influenza virus
TQEAIGKITNK

SEQ ID NO: 540585 - protein, 11 aa, Influenza virus
TQEAINKITNK

SEQ ID NO: 540586 - protein, 11 aa, Influenza virus
TQESECACANG

SEQ ID NO: 540587 - protein, 11 aa, Influenza virus
TQESECACING

SEQ ID NO: 540588 - protein, 11 aa, Influenza virus
TQESECACVNG

SEQ ID NO: 540589 - protein, 11 aa, Influenza virus
TQESECICING

SEQ ID NO: 540590 - protein, 11 aa, Influenza virus
TQESECLCIDG

SEQ ID NO: 540591 - protein, 11 aa, Influenza virus
TQESECQCIDG

SEQ ID NO: 540592 - protein, 11 aa, Influenza virus
TQESECQCIGG

SEQ ID NO: 540593 - protein, 11 aa, Influenza virus
TQESECQCISG

SEQ ID NO: 540594 - protein, 11 aa, Influenza virus
TQESECQCLYG

SEQ ID NO: 540595 - protein, 11 aa, Influenza virus
TQESECVCHKG

SEQ ID NO: 540596 - protein, 11 aa, Influenza virus
TQESECVCHNG

SEQ ID NO: 540597 - protein, 11 aa, Influenza virus
TQESECVCHNS

SEQ ID NO: 540598 - protein, 11 aa, Influenza virus
TQESECVCHSG

SEQ ID NO: 540599 - protein, 11 aa, Influenza virus
TQESECVCING

SEQ ID NO: 540600 - protein, 11 aa, Influenza virus
TQESECVCISG

SEQ ID NO: 540601 - protein, 11 aa, Influenza virus
TQESECVCQDE

SEQ ID NO: 540602 - protein, 11 aa, Influenza virus
TQESECVCVNG

SEQ ID NO: 540603 - protein, 11 aa, Influenza virus
TQESECVRHNG

SEQ ID NO: 540604 - protein, 11 aa, Influenza virus
TQESSCTCIKG

SEQ ID NO: 540605 - protein, 11 aa, Influenza virus
TQESSCTCILG

SEQ ID NO: 540606 - protein, 11 aa, Influenza virus
TQESSCTCIQG

SEQ ID NO: 540607 - protein, 11 aa, Influenza virus
TQESSCTCIRG

SEQ ID NO: 540608 - protein, 11 aa, Influenza virus
TQESSCVCIKG

SEQ ID NO: 540609 - protein, 11 aa, Influenza virus
TQESSCVCMKG

SEQ ID NO: 540610 - protein, 11 aa, Influenza virus
TQESSCVCMNG

SEQ ID NO: 540611 - protein, 11 aa, Influenza virus
TQESSCVCVKG

SEQ ID NO: 540612 - protein, 11 aa, Influenza virus
TQFELIDNEFT

SEQ ID NO: 540613 - protein, 11 aa, Influenza virus
TQGACWEQLYT

SEQ ID NO: 540614 - protein, 11 aa, Influenza virus
TQGALLNDKHS

SEQ ID NO: 540615 - protein, 11 aa, Influenza virus
TQGALLNDRHS

SEQ ID NO: 540616 - protein, 11 aa, Influenza virus
TQGEGTAADYK

SEQ ID NO: 540617 - protein, 11 aa, Influenza virus
TQGRQTFDWTL

SEQ ID NO: 540618 - protein, 11 aa, Influenza virus
TQGRQTYDWTL

SEQ ID NO: 540619 - protein, 11 aa, Influenza virus
TQGSLLNDKHF

SEQ ID NO: 540620 - protein, 11 aa, Influenza virus
TQGSLLNDKHS

SEQ ID NO: 540621 - protein, 11 aa, Influenza virus
TQGSLLNDRHS

SEQ ID NO: 540622 - protein, 11 aa, Influenza virus
TQGTCWEQLYT

SEQ ID NO: 540623 - protein, 11 aa, Influenza virus
TQGTCWEQMYT

SEQ ID NO: 540624 - protein, 11 aa, Influenza virus
TQIIVILVLGL

SEQ ID NO: 540625 - protein, 11 aa, Influenza virus
TQKAIDEITTK

SEQ ID NO: 540626 - protein, 11 aa, Influenza virus
TQKAIDGITNK

SEQ ID NO: 540627 - protein, 11 aa, Influenza virus
TQKAIDGVTNK

SEQ ID NO: 540628 - protein, 11 aa, Influenza virus
TQKAIDIMQNK

SEQ ID NO: 540629 - protein, 11 aa, Influenza virus
TQKAIDNMQNK

SEQ ID NO: 540630 - protein, 11 aa, Influenza virus
TQKAIDNMQNR

SEQ ID NO: 540631 - protein, 11 aa, Influenza virus
TQKAIDQITTK

SEQ ID NO: 540632 - protein, 11 aa, Influenza virus
TQKAIDRITTK

SEQ ID NO: 540633 - protein, 11 aa, Influenza virus
TQKAINEITTK

SEQ ID NO: 540634 - protein, 11 aa, Influenza virus
TQKAINGVTNK

SEQ ID NO: 540635 - protein, 11 aa, Influenza virus
TQKALNEITTK

SEQ ID NO: 540636 - protein, 11 aa, Influenza virus
TQKAMDGVTNK

SEQ ID NO: 540637 - protein, 11 aa, Influenza virus
TQKTIDQVTGK

SEQ ID NO: 540638 - protein, 11 aa, Influenza virus
TQMAIDNMQNK

SEQ ID NO: 540639 - protein, 11 aa, Influenza virus
TQNNTTLIENT

SEQ ID NO: 540640 - protein, 11 aa, Influenza virus
TQNNTTVVENT

SEQ ID NO: 540641 - protein, 11 aa, Influenza virus
TQPLSISVGSS

SEQ ID NO: 540642 - protein, 11 aa, Influenza virus
TQPTFSVQRNL

SEQ ID NO: 540643 - protein, 11 aa, Influenza virus
TQRAIDGVTNK

SEQ ID NO: 540644 - protein, 11 aa, Influenza virus
TQRAIDNMQNK

SEQ ID NO: 540645 - protein, 11 aa, Influenza virus
TQSAIDQITGK

SEQ ID NO: 540646 - protein, 11 aa, Influenza virus
TQSAIDQITGT

SEQ ID NO: 540647 - protein, 11 aa, Influenza virus
TQSAIDQVTGK

SEQ ID NO: 540648 - protein, 11 aa, Influenza virus
TQSAINQITGK

SEQ ID NO: 540649 - protein, 11 aa, Influenza virus
TQSAVDQITGK

SEQ ID NO: 540650 - protein, 11 aa, Influenza virus
TQSAVNQITGK

SEQ ID NO: 540651 - protein, 11 aa, Influenza virus
TQSLSISIGSS

SEQ ID NO: 540652 - protein, 11 aa, Influenza virus
TQSLSISVESS

SEQ ID NO: 540653 - protein, 11 aa, Influenza virus
TQSLSISVGSS

SEQ ID NO: 540654 - protein, 11 aa, Influenza virus
TQTAIDQINGK

SEQ ID NO: 540655 - protein, 11 aa, Influenza virus
TQTAIDQITGK

SEQ ID NO: 540656 - protein, 11 aa, Influenza virus
TQTLVANNDWS

SEQ ID NO: 540657 - protein, 11 aa, Influenza virus
TQTLVSNNDWS

SEQ ID NO: 540658 - protein, 11 aa, Influenza virus
TQTLVSNSDWS

SEQ ID NO: 540659 - protein, 11 aa, Influenza virus
TQTMELVEAEK

SEQ ID NO: 540660 - protein, 11 aa, Influenza virus
TQTMELVETEK

SEQ ID NO: 540661 - protein, 11 aa, Influenza virus
TQTMELVETKK

SEQ ID NO: 540662 - protein, 11 aa, Influenza virus
TQTRGIFGAIA

SEQ ID NO: 540663 - protein, 11 aa, Influenza virus
TQVEELVHGGI

SEQ ID NO: 540664 - protein, 11 aa, Influenza virus
TQVEELVHGGV

SEQ ID NO: 540665 - protein, 11 aa, Influenza virus
TQVEELVHGQV

SEQ ID NO: 540666 - protein, 11 aa, Influenza virus
TQVEELVHRGI

SEQ ID NO: 540667 - protein, 11 aa, Influenza virus
TQYREEALLNR

SEQ ID NO: 540668 - protein, 11 aa, Influenza virus
TRALVRSGMDP

SEQ ID NO: 540669 - protein, 11 aa, Influenza virus
TRALVRTGMDP

SEQ ID NO: 540670 - protein, 11 aa, Influenza virus
TRCQTPLGAIN

SEQ ID NO: 540671 - protein, 11 aa, Influenza virus
TRCQTSVGGIN

SEQ ID NO: 540672 - protein, 11 aa, Influenza virus
TRDAMTEIWSY

SEQ ID NO: 540673 - protein, 11 aa, Influenza virus
TRDAMTEVWSY

SEQ ID NO: 540674 - protein, 11 aa, Influenza virus
TRDSITEVWSY

SEQ ID NO: 540675 - protein, 11 aa, Influenza virus
TRDSLTEIWSY

SEQ ID NO: 540676 - protein, 11 aa, Influenza virus
TRDSMTEIWSY

SEQ ID NO: 540677 - protein, 11 aa, Influenza virus
TRDSMTEVWSY

SEQ ID NO: 540678 - protein, 11 aa, Influenza virus
TRDSVTELWSY

SEQ ID NO: 540679 - protein, 11 aa, Influenza virus
TREGKHIVERI

SEQ ID NO: 540680 - protein, 11 aa, Influenza virus
TREGRRKTNLY

SEQ ID NO: 540681 - protein, 11 aa, Influenza virus
TREILTKITVD

SEQ ID NO: 540682 - protein, 11 aa, Influenza virus
TREILTKTTVD

SEQ ID NO: 540683 - protein, 11 aa, Influenza virus
TREILTRTTVD

SEQ ID NO: 540684 - protein, 11 aa, Influenza virus
TRELCTINSWH

SEQ ID NO: 540685 - protein, 11 aa, Influenza virus
TREPYVSCDPD

SEQ ID NO: 540686 - protein, 11 aa, Influenza virus
TREPYVSCDPI

SEQ ID NO: 540687 - protein, 11 aa, Influenza virus
TREPYVSCDPK

SEQ ID NO: 540688 - protein, 11 aa, Influenza virus
TREPYVSCDPL

SEQ ID NO: 540689 - protein, 11 aa, Influenza virus
TREPYVSCDPN

SEQ ID NO: 540690 - protein, 11 aa, Influenza virus
TREPYVSCDPS

SEQ ID NO: 540691 - protein, 11 aa, Influenza virus
TREPYVSCDPT

SEQ ID NO: 540692 - protein, 11 aa, Influenza virus
TREPYVSCEPD

SEQ ID NO: 540693 - protein, 11 aa, Influenza virus
TREWSYLIEDP

SEQ ID NO: 540694 - protein, 11 aa, Influenza virus
TRFLPVAGGTG

SEQ ID NO: 540695 - protein, 11 aa, Influenza virus
TRFLPVAGGTS

SEQ ID NO: 540696 - protein, 11 aa, Influenza virus
TRFLPVSGGTS

SEQ ID NO: 540697 - protein, 11 aa, Influenza virus
TRFLPVTGGTS

SEQ ID NO: 540698 - protein, 11 aa, Influenza virus
TRFLPVVGGTS

SEQ ID NO: 540699 - protein, 11 aa, Influenza virus
TRGAYERMCNI

SEQ ID NO: 540700 - protein, 11 aa, Influenza virus
TRGIFGAIAGF

SEQ ID NO: 540701 - protein, 11 aa, Influenza virus
TRGILTKTTVD

SEQ ID NO: 540702 - protein, 11 aa, Influenza virus
TRGIQIASNEN

SEQ ID NO: 540703 - protein, 11 aa, Influenza virus
TRGLCTINSWH

SEQ ID NO: 540704 - protein, 11 aa, Influenza virus
TRGLFGAIAGF

SEQ ID NO: 540705 - protein, 11 aa, Influenza virus
TRGVQIASNEN

SEQ ID NO: 540706 - protein, 11 aa, Influenza virus
TRGVQVASNEN

SEQ ID NO: 540707 - protein, 11 aa, Influenza virus
TRIAYERMCNI

SEQ ID NO: 540708 - protein, 11 aa, Influenza virus
TRIGDGQRSWM

SEQ ID NO: 540709 - protein, 11 aa, Influenza virus
TRKEPALIVWG

SEQ ID NO: 540710 - protein, 11 aa, Influenza virus
TRKLNRLIEKT

SEQ ID NO: 540711 - protein, 11 aa, Influenza virus
TRKQLRENAED

SEQ ID NO: 540712 - protein, 11 aa, Influenza virus
TRLFTIRQELA

SEQ ID NO: 540713 - protein, 11 aa, Influenza virus
TRLFTIRQEMA

SEQ ID NO: 540714 - protein, 11 aa, Influenza virus
TRLPFQNLSPR

SEQ ID NO: 540715 - protein, 11 aa, Influenza virus
TRLYIWGVHHP

SEQ ID NO: 540716 - protein, 11 aa, Influenza virus
TRLYVNKNPYT

SEQ ID NO: 540717 - protein, 11 aa, Influenza virus
TRPGYNGQKSW

SEQ ID NO: 540718 - protein, 11 aa, Influenza virus
TRPILSPLTKG

SEQ ID NO: 540719 - protein, 11 aa, Influenza virus
TRQASPSCLVV

SEQ ID NO: 540720 - protein, 11 aa, Influenza virus
TRQVCIAWSSS

SEQ ID NO: 540721 - protein, 11 aa, Influenza virus
TRQVCMAWSSS

SEQ ID NO: 540722 - protein, 11 aa, Influenza virus
TRQVCVAWSSS

SEQ ID NO: 540723 - protein, 11 aa, Influenza virus
TRREIHIYYLE

SEQ ID NO: 540724 - protein, 11 aa, Influenza virus
TRREVHIYYLE

SEQ ID NO: 540725 - protein, 11 aa, Influenza virus
TRREVHMYYLE

SEQ ID NO: 540726 - protein, 11 aa, Influenza virus
TRREVHTYYLE

SEQ ID NO: 540727 - protein, 11 aa, Influenza virus
TRREVHVYYLE

SEQ ID NO: 540728 - protein, 11 aa, Influenza virus
TRRIDFHWLLL

SEQ ID NO: 540729 - protein, 11 aa, Influenza virus
TRRQKRGLFGA

SEQ ID NO: 540730 - protein, 11 aa, Influenza virus
TRRQLRENAED

SEQ ID NO: 540731 - protein, 11 aa, Influenza virus
TRSAYERMCNI

SEQ ID NO: 540732 - protein, 11 aa, Influenza virus
TRSDQISIVPN

SEQ ID NO: 540733 - protein, 11 aa, Influenza virus
TRSGQNHGICA

SEQ ID NO: 540734 - protein, 11 aa, Influenza virus
TRSGTSKACNA

SEQ ID NO: 540735 - protein, 11 aa, Influenza virus
TRSGYEMLKVP

SEQ ID NO: 540736 - protein, 11 aa, Influenza virus
TRTAYERMCNI

SEQ ID NO: 540737 - protein, 11 aa, Influenza virus
TRTTVDHMAII

SEQ ID NO: 540738 - protein, 11 aa, Influenza virus
TRVAYERMCNI

SEQ ID NO: 540739 - protein, 11 aa, Influenza virus
TRVDKLTQGRQ

SEQ ID NO: 540740 - protein, 11 aa, Influenza virus
TRVDRLTQGRQ

SEQ ID NO: 540741 - protein, 11 aa, Influenza virus
TRVKRQLRENA

SEQ ID NO: 540742 - protein, 11 aa, Influenza virus
TRVWWTSNSIA

SEQ ID NO: 540743 - protein, 11 aa, Influenza virus
TRVWWTSNSIV

SEQ ID NO: 540744 - protein, 11 aa, Influenza virus
TRWMKIIRVGC

SEQ ID NO: 540745 - protein, 11 aa, Influenza virus
TRYVCSKFHSD

SEQ ID NO: 540746 - protein, 11 aa, Influenza virus
TSACKRTVSSF

SEQ ID NO: 540747 - protein, 11 aa, Influenza virus
TSARQEKNPAL

SEQ ID NO: 540748 - protein, 11 aa, Influenza virus
TSASSISFCGV

SEQ ID NO: 540749 - protein, 11 aa, Influenza virus
TSCFDGKEWMH

SEQ ID NO: 540750 - protein, 11 aa, Influenza virus
TSCHDGIGRMT

SEQ ID NO: 540751 - protein, 11 aa, Influenza virus
TSCHDGISRMS

SEQ ID NO: 540752 - protein, 11 aa, Influenza virus
TSCHDGKARMS

SEQ ID NO: 540753 - protein, 11 aa, Influenza virus
TSCHDGKFRMS

SEQ ID NO: 540754 - protein, 11 aa, Influenza virus
TSCHDGKSRMS

SEQ ID NO: 540755 - protein, 11 aa, Influenza virus
TSCHDGKTRMS

SEQ ID NO: 540756 - protein, 11 aa, Influenza virus
TSCHDGMSRMS

SEQ ID NO: 540757 - protein, 11 aa, Influenza virus
TSCHDGRARMS

SEQ ID NO: 540758 - protein, 11 aa, Influenza virus
TSCHDGRSRMS

SEQ ID NO: 540759 - protein, 11 aa, Influenza virus
TSCHDGVGRMT

SEQ ID NO: 540760 - protein, 11 aa, Influenza virus
TSCHDGVSRMS

SEQ ID NO: 540761 - protein, 11 aa, Influenza virus
TSFFYRYGFVA

SEQ ID NO: 540762 - protein, 11 aa, Influenza virus
TSGEQMLIIWG

SEQ ID NO: 540763 - protein, 11 aa, Influenza virus
TSGEQMLVIWG

SEQ ID NO: 540764 - protein, 11 aa, Influenza virus
TSGKQMLIIWG

SEQ ID NO: 540765 - protein, 11 aa, Influenza virus
TSGNLIAPEYG

SEQ ID NO: 540766 - protein, 11 aa, Influenza virus
TSGRQEKNPAL

SEQ ID NO: 540767 - protein, 11 aa, Influenza virus
TSGRQEKNPSL

SEQ ID NO: 540768 - protein, 11 aa, Influenza virus
TSGSIISFCGV

SEQ ID NO: 540769 - protein, 11 aa, Influenza virus
TSGSSIAFCGV

SEQ ID NO: 540770 - protein, 11 aa, Influenza virus
TSGSSISFCGV

SEQ ID NO: 540771 - protein, 11 aa, Influenza virus
TSGTYGAGSWP

SEQ ID NO: 540772 - protein, 11 aa, Influenza virus
TSGTYGKGSWP

SEQ ID NO: 540773 - protein, 11 aa, Influenza virus
TSGTYGSGSWP

SEQ ID NO: 540774 - protein, 11 aa, Influenza virus
TSGTYGTGSWP

SEQ ID NO: 540775 - protein, 11 aa, Influenza virus
TSGTYGTGTWP

SEQ ID NO: 540776 - protein, 11 aa, Influenza virus
TSHRTLLMNEL

SEQ ID NO: 540777 - protein, 11 aa, Influenza virus
TSISCLYKLSQ

SEQ ID NO: 540778 - protein, 11 aa, Influenza virus
TSIWTSSSSTV

SEQ ID NO: 540779 - protein, 11 aa, Influenza virus
TSKACNALTGG

SEQ ID NO: 540780 - protein, 11 aa, Influenza virus
TSKACNASTGA

SEQ ID NO: 540781 - protein, 11 aa, Influenza virus
TSKACNASTGG

SEQ ID NO: 540782 - protein, 11 aa, Influenza virus
TSKACSASTGG

SEQ ID NO: 540783 - protein, 11 aa, Influenza virus
TSKHYIGKCPK

SEQ ID NO: 540784 - protein, 11 aa, Influenza virus
TSKHYIGKCPR

SEQ ID NO: 540785 - protein, 11 aa, Influenza virus
TSKIKMKWGME

SEQ ID NO: 540786 - protein, 11 aa, Influenza virus
TSKPFQNICKP

SEQ ID NO: 540787 - protein, 11 aa, Influenza virus
TSKPFQNTSKH

SEQ ID NO: 540788 - protein, 11 aa, Influenza virus
TSKPFQNTSRH

SEQ ID NO: 540789 - protein, 11 aa, Influenza virus
TSKPLQNTSKH

SEQ ID NO: 540790 - protein, 11 aa, Influenza virus
TSKVKMKWGME

SEQ ID NO: 540791 - protein, 11 aa, Influenza virus
TSLCSIWFSHY

SEQ ID NO: 540792 - protein, 11 aa, Influenza virus
TSLLLATGMRN

SEQ ID NO: 540793 - protein, 11 aa, Influenza virus
TSLTSLPFQNI

SEQ ID NO: 540794 - protein, 11 aa, Influenza virus
TSMPFHNIHPL

SEQ ID NO: 540795 - protein, 11 aa, Influenza virus
TSNSIAVFCGT

SEQ ID NO: 540796 - protein, 11 aa, Influenza virus
TSNSIIAFCGT

SEQ ID NO: 540797 - protein, 11 aa, Influenza virus
TSNSIIVFCGT

SEQ ID NO: 540798 - protein, 11 aa, Influenza virus
TSNSIVAFCGT

SEQ ID NO: 540799 - protein, 11 aa, Influenza virus
TSNSIVALCGS

SEQ ID NO: 540800 - protein, 11 aa, Influenza virus
TSNSIVSMCSS

SEQ ID NO: 540801 - protein, 11 aa, Influenza virus
TSNSIVTFCGL

SEQ ID NO: 540802 - protein, 11 aa, Influenza virus
TSNSIVVFCAT

SEQ ID NO: 540803 - protein, 11 aa, Influenza virus
TSNSIVVFCGA

SEQ ID NO: 540804 - protein, 11 aa, Influenza virus
TSNSIVVFCGT

SEQ ID NO: 540805 - protein, 11 aa, Influenza virus
TSNSIVVFCST

SEQ ID NO: 540806 - protein, 11 aa, Influenza virus
TSNSLIALCGS

SEQ ID NO: 540807 - protein, 11 aa, Influenza virus
TSNSLVALCGS

SEQ ID NO: 540808 - protein, 11 aa, Influenza virus
TSNSMVTFCGL

SEQ ID NO: 540809 - protein, 11 aa, Influenza virus
TSNSVVVFCGT

SEQ ID NO: 540810 - protein, 11 aa, Influenza virus
TSPCLTDKGSI

SEQ ID NO: 540811 - protein, 11 aa, Influenza virus
TSQKGILEDEQ

SEQ ID NO: 540812 - protein, 11 aa, Influenza virus
TSQRGILEDEQ

SEQ ID NO: 540813 - protein, 11 aa, Influenza virus
TSQRGVLEDEQ

SEQ ID NO: 540814 - protein, 11 aa, Influenza virus
TSQYICSPVLT

SEQ ID NO: 540815 - protein, 11 aa, Influenza virus
TSQYLCTGILT

SEQ ID NO: 540816 - protein, 11 aa, Influenza virus
TSQYLCTGVLT

SEQ ID NO: 540817 - protein, 11 aa, Influenza virus
TSRHYIGKCPK

SEQ ID NO: 540818 - protein, 11 aa, Influenza virus
TSRYVCTGILT

SEQ ID NO: 540819 - protein, 11 aa, Influenza virus
TSSGTSKACNA

SEQ ID NO: 540820 - protein, 11 aa, Influenza virus
TSSGTSKACSA

SEQ ID NO: 540821 - protein, 11 aa, Influenza virus
TSSIDLVETNH

SEQ ID NO: 540822 - protein, 11 aa, Influenza virus
TSSIYIEVLHL

SEQ ID NO: 540823 - protein, 11 aa, Influenza virus
TSSMYIEVLHL

SEQ ID NO: 540824 - protein, 11 aa, Influenza virus
TSSSIVVFCGT

SEQ ID NO: 540825 - protein, 11 aa, Influenza virus
TSSSSIVMCGV

SEQ ID NO: 540826 - protein, 11 aa, Influenza virus
TSSSSTVFCGV

SEQ ID NO: 540827 - protein, 11 aa, Influenza virus
TSSSSVVMCGV

SEQ ID NO: 540828 - protein, 11 aa, Influenza virus
TSSVDLVETNH

SEQ ID NO: 540829 - protein, 11 aa, Influenza virus
TSSVYIEVLHL

SEQ ID NO: 540830 - protein, 11 aa, Influenza virus
TSSVYVEVLHL

SEQ ID NO: 540831 - protein, 11 aa, Influenza virus
TSTQKAINEIT

SEQ ID NO: 540832 - protein, 11 aa, Influenza virus
TSVGGIDTNKT

SEQ ID NO: 540833 - protein, 11 aa, Influenza virus
TSVGGINTNKT

SEQ ID NO: 540834 - protein, 11 aa, Influenza virus
TSVGGINTNRT

SEQ ID NO: 540835 - protein, 11 aa, Influenza virus
TSVKTLTDNHV

SEQ ID NO: 540836 - protein, 11 aa, Influenza virus
TSVTTNTINRN

SEQ ID NO: 540837 - protein, 11 aa, Influenza virus
TSWSWPDGALL

SEQ ID NO: 540838 - protein, 11 aa, Influenza virus
TSWSYIVEKPN

SEQ ID NO: 540839 - protein, 11 aa, Influenza virus
TSWSYIVEKSN

SEQ ID NO: 540840 - protein, 11 aa, Influenza virus
TSWSYIVEKTN

SEQ ID NO: 540841 - protein, 11 aa, Influenza virus
TSWSYIVERPN

SEQ ID NO: 540842 - protein, 11 aa, Influenza virus
TSYKILSIYST

SEQ ID NO: 540843 - protein, 11 aa, Influenza virus
TSYRSLIRFPI

SEQ ID NO: 540844 - protein, 11 aa, Influenza virus
TSYWWDGLQSS

SEQ ID NO: 540845 - protein, 11 aa, Influenza virus
TTAKAMEQMAG

SEQ ID NO: 540846 - protein, 11 aa, Influenza virus
TTAKAMEQVAG

SEQ ID NO: 540847 - protein, 11 aa, Influenza virus
TTAVAVLKYNG

SEQ ID NO: 540848 - protein, 11 aa, Influenza virus
TTCHDGIGRMT

SEQ ID NO: 540849 - protein, 11 aa, Influenza virus
TTCHDGVGRMT

SEQ ID NO: 540850 - protein, 11 aa, Influenza virus
TTCWSWPDGAL

SEQ ID NO: 540851 - protein, 11 aa, Influenza virus
TTDWSGYSGSF

SEQ ID NO: 540852 - protein, 11 aa, Influenza virus
TTEINTWARNI

SEQ ID NO: 540853 - protein, 11 aa, Influenza virus
TTEVSHCRATE

SEQ ID NO: 540854 - protein, 11 aa, Influenza virus
TTFPYTGDPPY

SEQ ID NO: 540855 - protein, 11 aa, Influenza virus
TTGKSHGRILK

SEQ ID NO: 540856 - protein, 11 aa, Influenza virus
TTGNPIICLGH

SEQ ID NO: 540857 - protein, 11 aa, Influenza virus
TTGRDVLVIWG

SEQ ID NO: 540858 - protein, 11 aa, Influenza virus
TTGRDVLVLWG

SEQ ID NO: 540859 - protein, 11 aa, Influenza virus
TTGRDVLVMWG

SEQ ID NO: 540860 - protein, 11 aa, Influenza virus
TTGRNCTIPCF

SEQ ID NO: 540861 - protein, 11 aa, Influenza virus
TTGRNCTVPCF

SEQ ID NO: 540862 - protein, 11 aa, Influenza virus
TTGWSWPDGAL

SEQ ID NO: 540863 - protein, 11 aa, Influenza virus
TTHDRTAFRGL

SEQ ID NO: 540864 - protein, 11 aa, Influenza virus
TTHSWIPKRNR

SEQ ID NO: 540865 - protein, 11 aa, Influenza virus
TTHSWTPKRNR

SEQ ID NO: 540866 - protein, 11 aa, Influenza virus
TTHSWVPILNT

SEQ ID NO: 540867 - protein, 11 aa, Influenza virus
TTHSWVPKRNR

SEQ ID NO: 540868 - protein, 11 aa, Influenza virus
TTIGLLLQIIS

SEQ ID NO: 540869 - protein, 11 aa, Influenza virus
TTIGLLLQITS

SEQ ID NO: 540870 - protein, 11 aa, Influenza virus
TTIKPWARNIL

SEQ ID NO: 540871 - protein, 11 aa, Influenza virus
TTIKTWAGKIL

SEQ ID NO: 540872 - protein, 11 aa, Influenza virus
TTIKTWAGNIL

SEQ ID NO: 540873 - protein, 11 aa, Influenza virus
TTIKTWAKNIL

SEQ ID NO: 540874 - protein, 11 aa, Influenza virus
TTIKTWARNIL

SEQ ID NO: 540875 - protein, 11 aa, Influenza virus
TTINNITNVVL

SEQ ID NO: 540876 - protein, 11 aa, Influenza virus
TTIRGKHSNGT

SEQ ID NO: 540877 - protein, 11 aa, Influenza virus
TTIRGRHSNGT

SEQ ID NO: 540878 - protein, 11 aa, Influenza virus
TTIRNKHSNGT

SEQ ID NO: 540879 - protein, 11 aa, Influenza virus
TTIRNKHSNST

SEQ ID NO: 540880 - protein, 11 aa, Influenza virus
TTIRNRHSNGT

SEQ ID NO: 540881 - protein, 11 aa, Influenza virus
TTIRTWAKNIL

SEQ ID NO: 540882 - protein, 11 aa, Influenza virus
TTIWTSGSSIS

SEQ ID NO: 540883 - protein, 11 aa, Influenza virus
TTKINNIIDKM

SEQ ID NO: 540884 - protein, 11 aa, Influenza virus
TTKINNIIEKM

SEQ ID NO: 540885 - protein, 11 aa, Influenza virus
TTLDNEHSNGT

SEQ ID NO: 540886 - protein, 11 aa, Influenza virus
TTLDNKHSNDT

SEQ ID NO: 540887 - protein, 11 aa, Influenza virus
TTLDNKHSNGT

SEQ ID NO: 540888 - protein, 11 aa, Influenza virus
TTLENKHSNGT

SEQ ID NO: 540889 - protein, 11 aa, Influenza virus
TTLIENTYVNK

SEQ ID NO: 540890 - protein, 11 aa, Influenza virus
TTLIENTYVNN

SEQ ID NO: 540891 - protein, 11 aa, Influenza virus
TTLKGRHANGT

SEQ ID NO: 540892 - protein, 11 aa, Influenza virus
TTLNNKHSNGT

SEQ ID NO: 540893 - protein, 11 aa, Influenza virus
TTLPFHNIHPL

SEQ ID NO: 540894 - protein, 11 aa, Influenza virus
TTLPFHNVHPL

SEQ ID NO: 540895 - protein, 11 aa, Influenza virus
TTLRGQHANGT

SEQ ID NO: 540896 - protein, 11 aa, Influenza virus
TTLRGRHANGT

SEQ ID NO: 540897 - protein, 11 aa, Influenza virus
TTLSTIALFIG

SEQ ID NO: 540898 - protein, 11 aa, Influenza virus
TTLSTIALIIG

SEQ ID NO: 540899 - protein, 11 aa, Influenza virus
TTLSTIALLIG

SEQ ID NO: 540900 - protein, 11 aa, Influenza virus
TTLYKNANTLS

SEQ ID NO: 540901 - protein, 11 aa, Influenza virus
TTLYKNANTLT

SEQ ID NO: 540902 - protein, 11 aa, Influenza virus
TTLYNKHSNGT

SEQ ID NO: 540903 - protein, 11 aa, Influenza virus
TTNPLIKHENR

SEQ ID NO: 540904 - protein, 11 aa, Influenza virus
TTNPLIRHENR

SEQ ID NO: 540905 - protein, 11 aa, Influenza virus
TTNSIVVFCGT

SEQ ID NO: 540906 - protein, 11 aa, Influenza virus
TTNTINRIFQP

SEQ ID NO: 540907 - protein, 11 aa, Influenza virus
TTNTINRNFQP

SEQ ID NO: 540908 - protein, 11 aa, Influenza virus
TTNTINRSFQP

SEQ ID NO: 540909 - protein, 11 aa, Influenza virus
TTNTINRSFRP

SEQ ID NO: 540910 - protein, 11 aa, Influenza virus
TTNYYNETFVN

SEQ ID NO: 540911 - protein, 11 aa, Influenza virus
TTPTKSYFANL

SEQ ID NO: 540912 - protein, 11 aa, Influenza virus
TTRGVQIASNE

SEQ ID NO: 540913 - protein, 11 aa, Influenza virus
TTRQASPSCLV

SEQ ID NO: 540914 - protein, 11 aa, Influenza virus
TTSKDSRSGYE

SEQ ID NO: 540915 - protein, 11 aa, Influenza virus
TTSWSWPDGAL

SEQ ID NO: 540916 - protein, 11 aa, Influenza virus
TTTIKPWARNI

SEQ ID NO: 540917 - protein, 11 aa, Influenza virus
TTTIKTWAGKI

SEQ ID NO: 540918 - protein, 11 aa, Influenza virus
TTTIKTWAGNI

SEQ ID NO: 540919 - protein, 11 aa, Influenza virus
TTTIKTWAKNI

SEQ ID NO: 540920 - protein, 11 aa, Influenza virus
TTTIKTWARNI

SEQ ID NO: 540921 - protein, 11 aa, Influenza virus
TTTIRTWAKNI

SEQ ID NO: 540922 - protein, 11 aa, Influenza virus
TTTNPLIRHEN

SEQ ID NO: 540923 - protein, 11 aa, Influenza virus
TTTPTKSYFAN

SEQ ID NO: 540924 - protein, 11 aa, Influenza virus
TTTTIINNNTQ

SEQ ID NO: 540925 - protein, 11 aa, Influenza virus
TTTVKTWAGNI

SEQ ID NO: 540926 - protein, 11 aa, Influenza virus
TTVDHMAIIKK

SEQ ID NO: 540927 - protein, 11 aa, Influenza virus
TTVDHMAIIKR

SEQ ID NO: 540928 - protein, 11 aa, Influenza virus
TTVGLLLQIIS

SEQ ID NO: 540929 - protein, 11 aa, Influenza virus
TTVGLLLQITS

SEQ ID NO: 540930 - protein, 11 aa, Influenza virus
TTVGLLLQVTS

SEQ ID NO: 540931 - protein, 11 aa, Influenza virus
TTVGWSWPDGA

SEQ ID NO: 540932 - protein, 11 aa, Influenza virus
TTVKTWAGNIL

SEQ ID NO: 540933 - protein, 11 aa, Influenza virus
TTVNEEALRQK

SEQ ID NO: 540934 - protein, 11 aa, Influenza virus
TTVVENTYVNN

SEQ ID NO: 540935 - protein, 11 aa, Influenza virus
TTWDVFIERPT

SEQ ID NO: 540936 - protein, 11 aa, Influenza virus
TTYKILSIYST

SEQ ID NO: 540937 - protein, 11 aa, Influenza virus
TTYQRTRALVR

SEQ ID NO: 540938 - protein, 11 aa, Influenza virus
TTYRILSIYST

SEQ ID NO: 540939 - protein, 11 aa, Influenza virus
TTYWWDGLQSS

SEQ ID NO: 540940 - protein, 11 aa, Influenza virus
TVAASLCLAIL

SEQ ID NO: 540941 - protein, 11 aa, Influenza virus
TVAASLCLAVL

SEQ ID NO: 540942 - protein, 11 aa, Influenza virus
TVAGSLSLAIM

SEQ ID NO: 540943 - protein, 11 aa, Influenza virus
TVDHMAIIKKY

SEQ ID NO: 540944 - protein, 11 aa, Influenza virus
TVDHMAIIKRY

SEQ ID NO: 540945 - protein, 11 aa, Influenza virus
TVDTILEKNVT

SEQ ID NO: 540946 - protein, 11 aa, Influenza virus
TVDTILERNVT

SEQ ID NO: 540947 - protein, 11 aa, Influenza virus
TVDTLLEKNVT

SEQ ID NO: 540948 - protein, 11 aa, Influenza virus
TVDTLTENGVP

SEQ ID NO: 540949 - protein, 11 aa, Influenza virus
TVDTVLEKNVT

SEQ ID NO: 540950 - protein, 11 aa, Influenza virus
TVDTVLERNVT

SEQ ID NO: 540951 - protein, 11 aa, Influenza virus
TVDTVREKNVT

SEQ ID NO: 540952 - protein, 11 aa, Influenza virus
TVEITGIDKVC

SEQ ID NO: 540953 - protein, 11 aa, Influenza virus
TVEITGINKVC

SEQ ID NO: 540954 - protein, 11 aa, Influenza virus
TVERMVLSAFD

SEQ ID NO: 540955 - protein, 11 aa, Influenza virus
TVFCGVSGEVP

SEQ ID NO: 540956 - protein, 11 aa, Influenza virus
TVFCGVSSEVP

SEQ ID NO: 540957 - protein, 11 aa, Influenza virus
TVGKCPRYIKQ

SEQ ID NO: 540958 - protein, 11 aa, Influenza virus
TVGKCPRYVKQ

SEQ ID NO: 540959 - protein, 11 aa, Influenza virus
TVGLLLQIISL

SEQ ID NO: 540960 - protein, 11 aa, Influenza virus
TVGLLLQITSL

SEQ ID NO: 540961 - protein, 11 aa, Influenza virus
TVGLLLQVTSL

SEQ ID NO: 540962 - protein, 11 aa, Influenza virus
TVGQCPKYVNK

SEQ ID NO: 540963 - protein, 11 aa, Influenza virus
TVGQCPKYVNQ

SEQ ID NO: 540964 - protein, 11 aa, Influenza virus
TVGQCPKYVSK

SEQ ID NO: 540965 - protein, 11 aa, Influenza virus
TVGQCPKYVSQ

SEQ ID NO: 540966 - protein, 11 aa, Influenza virus
TVGRCPRYVKQ

SEQ ID NO: 540967 - protein, 11 aa, Influenza virus
TVGSSKYQQSF

SEQ ID NO: 540968 - protein, 11 aa, Influenza virus
TVGSSKYRQSF

SEQ ID NO: 540969 - protein, 11 aa, Influenza virus
TVHDRIPHRTL

SEQ ID NO: 540970 - protein, 11 aa, Influenza virus
TVIKNNMINND

SEQ ID NO: 540971 - protein, 11 aa, Influenza virus
TVIKNNMVNND

SEQ ID NO: 540972 - protein, 11 aa, Influenza virus
TVINNITTTII

SEQ ID NO: 540973 - protein, 11 aa, Influenza virus
TVINNITTTIT

SEQ ID NO: 540974 - protein, 11 aa, Influenza virus
TVIRNNMINND

SEQ ID NO: 540975 - protein, 11 aa, Influenza virus
TVKDRSPFRTL

SEQ ID NO: 540976 - protein, 11 aa, Influenza virus
TVKDRSPYRAL

SEQ ID NO: 540977 - protein, 11 aa, Influenza virus
TVKDRSPYRTL

SEQ ID NO: 540978 - protein, 11 aa, Influenza virus
TVKIKTNGNLI

SEQ ID NO: 540979 - protein, 11 aa, Influenza virus
TVKIQTNGNLI

SEQ ID NO: 540980 - protein, 11 aa, Influenza virus
TVKIQTSGNLI

SEQ ID NO: 540981 - protein, 11 aa, Influenza virus
TVKQDGKSSAC

SEQ ID NO: 540982 - protein, 11 aa, Influenza virus
TVKQNGKSGAC

SEQ ID NO: 540983 - protein, 11 aa, Influenza virus
TVKQNGKSSAC

SEQ ID NO: 540984 - protein, 11 aa, Influenza virus
TVKTWAGNILR

SEQ ID NO: 540985 - protein, 11 aa, Influenza virus
TVLEKNVTVTH

SEQ ID NO: 540986 - protein, 11 aa, Influenza virus
TVLERNVTVTH

SEQ ID NO: 540987 - protein, 11 aa, Influenza virus
TVLGVSILNLG

SEQ ID NO: 540988 - protein, 11 aa, Influenza virus
TVLGVSVLNLG

SEQ ID NO: 540989 - protein, 11 aa, Influenza virus
TVLKSDKRIGS

SEQ ID NO: 540990 - protein, 11 aa, Influenza virus
TVLVGLILAFI

SEQ ID NO: 540991 - protein, 11 aa, Influenza virus
TVMVGLILAFI

SEQ ID NO: 540992 - protein, 11 aa, Influenza virus
TVNEEALRQKI

SEQ ID NO: 540993 - protein, 11 aa, Influenza virus
TVNEGALRQKI

SEQ ID NO: 540994 - protein, 11 aa, Influenza virus
TVNRTHQYSEK

SEQ ID NO: 540995 - protein, 11 aa, Influenza virus
TVNRTHQYSER

SEQ ID NO: 540996 - protein, 11 aa, Influenza virus
TVNTLIEQNIP

SEQ ID NO: 540997 - protein, 11 aa, Influenza virus
TVNTLIEQNVP

SEQ ID NO: 540998 - protein, 11 aa, Influenza virus
TVNTLSEQNVP

SEQ ID NO: 540999 - protein, 11 aa, Influenza virus
TVNTLTEQNVP

SEQ ID NO: 541000 - protein, 11 aa, Influenza virus
TVNVRGSGLRI

SEQ ID NO: 541001 - protein, 11 aa, Influenza virus
TVNVRGSGMRI

SEQ ID NO: 541002 - protein, 11 aa, Influenza virus
TVNVRGSGMRV

SEQ ID NO: 541003 - protein, 11 aa, Influenza virus
TVNVRGTGMRI

SEQ ID NO: 541004 - protein, 11 aa, Influenza virus
TVPCFWVEMIR

SEQ ID NO: 541005 - protein, 11 aa, Influenza virus
TVPSERGLQRR

SEQ ID NO: 541006 - protein, 11 aa, Influenza virus
TVREKNVTVTH

SEQ ID NO: 541007 - protein, 11 aa, Influenza virus
TVSLSPGMMMG

SEQ ID NO: 541008 - protein, 11 aa, Influenza virus
TVSRTHQYSEK

SEQ ID NO: 541009 - protein, 11 aa, Influenza virus
TVSSFERFEIF

SEQ ID NO: 541010 - protein, 11 aa, Influenza virus
TVSSFYSEMKW

SEQ ID NO: 541011 - protein, 11 aa, Influenza virus
TVSSGLVLVGL

SEQ ID NO: 541012 - protein, 11 aa, Influenza virus
TVSSSLVLAGL

SEQ ID NO: 541013 - protein, 11 aa, Influenza virus
TVSSSLVLVGL

SEQ ID NO: 541014 - protein, 11 aa, Influenza virus
TVSTRSDQISI

SEQ ID NO: 541015 - protein, 11 aa, Influenza virus
TVSVRGSGMRI

SEQ ID NO: 541016 - protein, 11 aa, Influenza virus
TVTDGPAANSA

SEQ ID NO: 541017 - protein, 11 aa, Influenza virus
TVTFIFNGAFI

SEQ ID NO: 541018 - protein, 11 aa, Influenza virus
TVTFNFNGAFI

SEQ ID NO: 541019 - protein, 11 aa, Influenza virus
TVTFSFNGAFI

SEQ ID NO: 541020 - protein, 11 aa, Influenza virus
TVTFTFNGAFI

SEQ ID NO: 541021 - protein, 11 aa, Influenza virus
TVTHAKDILEK

SEQ ID NO: 541022 - protein, 11 aa, Influenza virus
TVTHAKDILER

SEQ ID NO: 541023 - protein, 11 aa, Influenza virus
TVTHAKNILEK

SEQ ID NO: 541024 - protein, 11 aa, Influenza virus
TVTHAQDILEK

SEQ ID NO: 541025 - protein, 11 aa, Influenza virus
TVTHAQDILER

SEQ ID NO: 541026 - protein, 11 aa, Influenza virus
TVTHAQNILEK

SEQ ID NO: 541027 - protein, 11 aa, Influenza virus
TVTHSIELLEN

SEQ ID NO: 541028 - protein, 11 aa, Influenza virus
TVTHSIELLES

SEQ ID NO: 541029 - protein, 11 aa, Influenza virus
TVTHSVELLED

SEQ ID NO: 541030 - protein, 11 aa, Influenza virus
TVTHSVELLEN

SEQ ID NO: 541031 - protein, 11 aa, Influenza virus
TVTHSVELLES

SEQ ID NO: 541032 - protein, 11 aa, Influenza virus
TVTLHFKQHDC

SEQ ID NO: 541033 - protein, 11 aa, Influenza virus
TVTLHFKQHEC

SEQ ID NO: 541034 - protein, 11 aa, Influenza virus
TVTLHFKQHKC

SEQ ID NO: 541035 - protein, 11 aa, Influenza virus
TVTLHFKQNEC

SEQ ID NO: 541036 - protein, 11 aa, Influenza virus
TVTSSIELVEN

SEQ ID NO: 541037 - protein, 11 aa, Influenza virus
TVTSSVELVEN

SEQ ID NO: 541038 - protein, 11 aa, Influenza virus
TVTSSVELVET

SEQ ID NO: 541039 - protein, 11 aa, Influenza virus
TVVENKYVNNT

SEQ ID NO: 541040 - protein, 11 aa, Influenza virus
TVVENTYVNNT

SEQ ID NO: 541041 - protein, 11 aa, Influenza virus
TVVLNTDWSGY

SEQ ID NO: 541042 - protein, 11 aa, Influenza virus
TVVMTDGNASG

SEQ ID NO: 541043 - protein, 11 aa, Influenza virus
TVVMTDGSASD

SEQ ID NO: 541044 - protein, 11 aa, Influenza virus
TVVMTDGSASE

SEQ ID NO: 541045 - protein, 11 aa, Influenza virus
TVVMTDGSASG

SEQ ID NO: 541046 - protein, 11 aa, Influenza virus
TVVNNITTTII

SEQ ID NO: 541047 - protein, 11 aa, Influenza virus
TVVNNITTTIV

SEQ ID NO: 541048 - protein, 11 aa, Influenza virus
TVWTSGSSISF

SEQ ID NO: 541049 - protein, 11 aa, Influenza virus
TVWTSSSSIVM

SEQ ID NO: 541050 - protein, 11 aa, Influenza virus
TVYWWDGLQSS

SEQ ID NO: 541051 - protein, 11 aa, Influenza virus
TVYYDRRLTTT

SEQ ID NO: 541052 - protein, 11 aa, Influenza virus
TVYYERRLTTT

SEQ ID NO: 541053 - protein, 11 aa, Influenza virus
TVYYNGRLTTT

SEQ ID NO: 541054 - protein, 11 aa, Influenza virus
TVYYNKRLTTT

SEQ ID NO: 541055 - protein, 11 aa, Influenza virus
TVYYNRRLTTT

SEQ ID NO: 541056 - protein, 11 aa, Influenza virus
TWAGKILRTQE

SEQ ID NO: 541057 - protein, 11 aa, Influenza virus
TWAGNILRTQE

SEQ ID NO: 541058 - protein, 11 aa, Influenza virus
TWAKNILRTQE

SEQ ID NO: 541059 - protein, 11 aa, Influenza virus
TWARNILRTQD

SEQ ID NO: 541060 - protein, 11 aa, Influenza virus
TWARNILRTQE

SEQ ID NO: 541061 - protein, 11 aa, Influenza virus
TWDVFIERPTA

SEQ ID NO: 541062 - protein, 11 aa, Influenza virus
TWLGRTFSPRS

SEQ ID NO: 541063 - protein, 11 aa, Influenza virus
TWLGRTISIAS

SEQ ID NO: 541064 - protein, 11 aa, Influenza virus
TWLGRTISPHS

SEQ ID NO: 541065 - protein, 11 aa, Influenza virus
TWLGRTISPKL

SEQ ID NO: 541066 - protein, 11 aa, Influenza virus
TWLGRTISPRL

SEQ ID NO: 541067 - protein, 11 aa, Influenza virus
TWLGRTISPRS

SEQ ID NO: 541068 - protein, 11 aa, Influenza virus
TWLGRTISTAS

SEQ ID NO: 541069 - protein, 11 aa, Influenza virus
TWLGRTLNTAS

SEQ ID NO: 541070 - protein, 11 aa, Influenza virus
TWLGRTTSTAS

SEQ ID NO: 541071 - protein, 11 aa, Influenza virus
TWNGVKVDGSS

SEQ ID NO: 541072 - protein, 11 aa, Influenza virus
TWSQNILRTQE

SEQ ID NO: 541073 - protein, 11 aa, Influenza virus
TYAGAINSSKP

SEQ ID NO: 541074 - protein, 11 aa, Influenza virus
TYAGAINSSRP

SEQ ID NO: 541075 - protein, 11 aa, Influenza virus
TYAGAVNSSKP

SEQ ID NO: 541076 - protein, 11 aa, Influenza virus
TYCSLNGISPI

SEQ ID NO: 541077 - protein, 11 aa, Influenza virus
TYCSLNGISPV

SEQ ID NO: 541078 - protein, 11 aa, Influenza virus
TYCSLNGVSPI

SEQ ID NO: 541079 - protein, 11 aa, Influenza virus
TYCSLNGVSPV

SEQ ID NO: 541080 - protein, 11 aa, Influenza virus
TYDHAQYREEA

SEQ ID NO: 541081 - protein, 11 aa, Influenza virus
TYDHKDYEEEA

SEQ ID NO: 541082 - protein, 11 aa, Influenza virus
TYDHKEFEEES

SEQ ID NO: 541083 - protein, 11 aa, Influenza virus
TYDHKEFEKES

SEQ ID NO: 541084 - protein, 11 aa, Influenza virus
TYDHKEFKEES

SEQ ID NO: 541085 - protein, 11 aa, Influenza virus
TYDHKEYEEEA

SEQ ID NO: 541086 - protein, 11 aa, Influenza virus
TYDHNIYRDEA

SEQ ID NO: 541087 - protein, 11 aa, Influenza virus
TYDHSQYREEA

SEQ ID NO: 541088 - protein, 11 aa, Influenza virus
TYDHTQYREEA

SEQ ID NO: 541089 - protein, 11 aa, Influenza virus
TYDWTLNRNQP

SEQ ID NO: 541090 - protein, 11 aa, Influenza virus
TYDYPKYEEES

SEQ ID NO: 541091 - protein, 11 aa, Influenza virus
TYDYPKYSEEA

SEQ ID NO: 541092 - protein, 11 aa, Influenza virus
TYDYPKYSEES

SEQ ID NO: 541093 - protein, 11 aa, Influenza virus
TYDYPKYSKES

SEQ ID NO: 541094 - protein, 11 aa, Influenza virus
TYDYSKYEEES

SEQ ID NO: 541095 - protein, 11 aa, Influenza virus
TYGAGSWPDGA

SEQ ID NO: 541096 - protein, 11 aa, Influenza virus
TYGSGSWPDGA

SEQ ID NO: 541097 - protein, 11 aa, Influenza virus
TYGTGSWPDGA

SEQ ID NO: 541098 - protein, 11 aa, Influenza virus
TYGTGSWPDGG

SEQ ID NO: 541099 - protein, 11 aa, Influenza virus
TYGTGTWPDGA

SEQ ID NO: 541100 - protein, 11 aa, Influenza virus
TYHNSFVPVVG

SEQ ID NO: 541101 - protein, 11 aa, Influenza virus
TYISIGTSTLN

SEQ ID NO: 541102 - protein, 11 aa, Influenza virus
TYISVGTSTLN

SEQ ID NO: 541103 - protein, 11 aa, Influenza virus
TYIWTYQAELL

SEQ ID NO: 541104 - protein, 11 aa, Influenza virus
TYKILSIYSSV

SEQ ID NO: 541105 - protein, 11 aa, Influenza virus
TYKILSIYSTV

SEQ ID NO: 541106 - protein, 11 aa, Influenza virus
TYKILTIYSTA

SEQ ID NO: 541107 - protein, 11 aa, Influenza virus
TYKILTIYSTV

SEQ ID NO: 541108 - protein, 11 aa, Influenza virus
TYNAEILVLME

SEQ ID NO: 541109 - protein, 11 aa, Influenza virus
TYNAELFVLME

SEQ ID NO: 541110 - protein, 11 aa, Influenza virus
TYNAELLILLE

SEQ ID NO: 541111 - protein, 11 aa, Influenza virus
TYNAELLVLIE

SEQ ID NO: 541112 - protein, 11 aa, Influenza virus
TYNAELLVLLE

SEQ ID NO: 541113 - protein, 11 aa, Influenza virus
TYNAELLVLME

SEQ ID NO: 541114 - protein, 11 aa, Influenza virus
TYNAEVLVLME

SEQ ID NO: 541115 - protein, 11 aa, Influenza virus
TYNHEDYKEES

SEQ ID NO: 541116 - protein, 11 aa, Influenza virus
TYNHEDYREES

SEQ ID NO: 541117 - protein, 11 aa, Influenza virus
TYNHKDYEEEA

SEQ ID NO: 541118 - protein, 11 aa, Influenza virus
TYNHKEYEEEA

SEQ ID NO: 541119 - protein, 11 aa, Influenza virus
TYNHTEYRQEA

SEQ ID NO: 541120 - protein, 11 aa, Influenza virus
TYNKTVINNIT

SEQ ID NO: 541121 - protein, 11 aa, Influenza virus
TYNNTTGRDVL

SEQ ID NO: 541122 - protein, 11 aa, Influenza virus
TYNNTVINNIT

SEQ ID NO: 541123 - protein, 11 aa, Influenza virus
TYNNTVINNMT

SEQ ID NO: 541124 - protein, 11 aa, Influenza virus
TYNNTVVNNIT

SEQ ID NO: 541125 - protein, 11 aa, Influenza virus
TYNRKEYEEEA

SEQ ID NO: 541126 - protein, 11 aa, Influenza virus
TYNSTVVNNIT

SEQ ID NO: 541127 - protein, 11 aa, Influenza virus
TYNTELLVLME

SEQ ID NO: 541128 - protein, 11 aa, Influenza virus
TYNVELLVLME

SEQ ID NO: 541129 - protein, 11 aa, Influenza virus
TYNYPKYEEES

SEQ ID NO: 541130 - protein, 11 aa, Influenza virus
TYNYPKYSEES

SEQ ID NO: 541131 - protein, 11 aa, Influenza virus
TYNYSKYEEES

SEQ ID NO: 541132 - protein, 11 aa, Influenza virus
TYQAELLIAME

SEQ ID NO: 541133 - protein, 11 aa, Influenza virus
TYQAELLVAME

SEQ ID NO: 541134 - protein, 11 aa, Influenza virus
TYQEELLVAME

SEQ ID NO: 541135 - protein, 11 aa, Influenza virus
TYQNNFVPVIG

SEQ ID NO: 541136 - protein, 11 aa, Influenza virus
TYQNNFVPVVG

SEQ ID NO: 541137 - protein, 11 aa, Influenza virus
TYQNSFVPVVG

SEQ ID NO: 541138 - protein, 11 aa, Influenza virus
TYQRTRALVRS

SEQ ID NO: 541139 - protein, 11 aa, Influenza virus
TYQRTRALVRT

SEQ ID NO: 541140 - protein, 11 aa, Influenza virus
TYREEAMQNRL

SEQ ID NO: 541141 - protein, 11 aa, Influenza virus
TYRILSIYSTV

SEQ ID NO: 541142 - protein, 11 aa, Influenza virus
TYRNNRKEPAL

SEQ ID NO: 541143 - protein, 11 aa, Influenza virus
TYRNTRKEPAL

SEQ ID NO: 541144 - protein, 11 aa, Influenza virus
TYSSPMMWEIN

SEQ ID NO: 541145 - protein, 11 aa, Influenza virus
TYSSSLMWEIN

SEQ ID NO: 541146 - protein, 11 aa, Influenza virus
TYSSSMMWEIN

SEQ ID NO: 541147 - protein, 11 aa, Influenza virus
TYSSSMMWEVN

SEQ ID NO: 541148 - protein, 11 aa, Influenza virus
TYTGAINSSKP

SEQ ID NO: 541149 - protein, 11 aa, Influenza virus
TYTGAINSSRP

SEQ ID NO: 541150 - protein, 11 aa, Influenza virus
TYVLSIIPSGP

SEQ ID NO: 541151 - protein, 11 aa, Influenza virus
TYVLSIVPSGP

SEQ ID NO: 541152 - protein, 11 aa, Influenza virus
TYVLSVIPSGP

SEQ ID NO: 541153 - protein, 11 aa, Influenza virus
TYVSIGTSTLN

SEQ ID NO: 541154 - protein, 11 aa, Influenza virus
TYVSVGTSTLN

SEQ ID NO: 541155 - protein, 11 aa, Influenza virus
TYWWDGLQSSD

SEQ ID NO: 541156 - protein, 11 aa, Influenza virus
TYYYPKYEEES

SEQ ID NO: 541157 - protein, 11 aa, Influenza virus
VAASLCLAILI

SEQ ID NO: 541158 - protein, 11 aa, Influenza virus
VAASLCLAILV

SEQ ID NO: 541159 - protein, 11 aa, Influenza virus
VAASLCLAVLI

SEQ ID NO: 541160 - protein, 11 aa, Influenza virus
VACGPAECRTF

SEQ ID NO: 541161 - protein, 11 aa, Influenza virus
VACGPSECRTF

SEQ ID NO: 541162 - protein, 11 aa, Influenza virus
VACGPTECRTF

SEQ ID NO: 541163 - protein, 11 aa, Influenza virus
VACSPSECRTF

SEQ ID NO: 541164 - protein, 11 aa, Influenza virus
VADGGPNLYNI

SEQ ID NO: 541165 - protein, 11 aa, Influenza virus
VADRDSTQKAI

SEQ ID NO: 541166 - protein, 11 aa, Influenza virus
VAEINTWARNI

SEQ ID NO: 541167 - protein, 11 aa, Influenza virus
VAFCGTSGTYG

SEQ ID NO: 541168 - protein, 11 aa, Influenza virus
VAGGLILGMQN

SEQ ID NO: 541169 - protein, 11 aa, Influenza virus
VAGLSFWMCSN

SEQ ID NO: 541170 - protein, 11 aa, Influenza virus
VAGLSLWMCSN

SEQ ID NO: 541171 - protein, 11 aa, Influenza virus
VAGSLSLAIMI

SEQ ID NO: 541172 - protein, 11 aa, Influenza virus
VAGSLSLAIMM

SEQ ID NO: 541173 - protein, 11 aa, Influenza virus
VAGSLSLAIMV

SEQ ID NO: 541174 - protein, 11 aa, Influenza virus
VAGSSEQAAEA

SEQ ID NO: 541175 - protein, 11 aa, Influenza virus
VAGWILGNPEC

SEQ ID NO: 541176 - protein, 11 aa, Influenza virus
VAGWILGNPKC

SEQ ID NO: 541177 - protein, 11 aa, Influenza virus
VAGWLLGNPEC

SEQ ID NO: 541178 - protein, 11 aa, Influenza virus
VAGWLLGNPLC

SEQ ID NO: 541179 - protein, 11 aa, Influenza virus
VAGWLLGNPMC

SEQ ID NO: 541180 - protein, 11 aa, Influenza virus
VAGWYGFQHQN

SEQ ID NO: 541181 - protein, 11 aa, Influenza virus
VAGWYGFQHSN

SEQ ID NO: 541182 - protein, 11 aa, Influenza virus
VAGWYGFQHTN

SEQ ID NO: 541183 - protein, 11 aa, Influenza virus
VAHKSCLPACA

SEQ ID NO: 541184 - protein, 11 aa, Influenza virus
VAHKSCLPACI

SEQ ID NO: 541185 - protein, 11 aa, Influenza virus
VAHKSCLPACV

SEQ ID NO: 541186 - protein, 11 aa, Influenza virus
VAIALSILNLL

SEQ ID NO: 541187 - protein, 11 aa, Influenza virus
VAIALSVLNLL

SEQ ID NO: 541188 - protein, 11 aa, Influenza virus
VAIENQHTIDL

SEQ ID NO: 541189 - protein, 11 aa, Influenza virus
VAIVFSQEDCM

SEQ ID NO: 541190 - protein, 11 aa, Influenza virus
VAKAGFIENGW

SEQ ID NO: 541191 - protein, 11 aa, Influenza virus
VAKDNAIRFGE

SEQ ID NO: 541192 - protein, 11 aa, Influenza virus
VALALSHTAYS

SEQ ID NO: 541193 - protein, 11 aa, Influenza virus
VALCGSKEQLG

SEQ ID NO: 541194 - protein, 11 aa, Influenza virus
VALCGSKERLG

SEQ ID NO: 541195 - protein, 11 aa, Influenza virus
VALCGSKKRLG

SEQ ID NO: 541196 - protein, 11 aa, Influenza virus
VALCGSPISVG

SEQ ID NO: 541197 - protein, 11 aa, Influenza virus
VALCGSPVPVG

SEQ ID NO: 541198 - protein, 11 aa, Influenza virus
VALCGSPVSVG

SEQ ID NO: 541199 - protein, 11 aa, Influenza virus
VALCGSRERLG

SEQ ID NO: 541200 - protein, 11 aa, Influenza virus
VALENQHTIDL

SEQ ID NO: 541201 - protein, 11 aa, Influenza virus
VALENQHTIDM

SEQ ID NO: 541202 - protein, 11 aa, Influenza virus
VALENQHTIDV

SEQ ID NO: 541203 - protein, 11 aa, Influenza virus
VALENQHTIHL

SEQ ID NO: 541204 - protein, 11 aa, Influenza virus
VALENQNTIDL

SEQ ID NO: 541205 - protein, 11 aa, Influenza virus
VALILGFVLWA

SEQ ID NO: 541206 - protein, 11 aa, Influenza virus
VAMENQHIIDL

SEQ ID NO: 541207 - protein, 11 aa, Influenza virus
VAMENQHTIDL

SEQ ID NO: 541208 - protein, 11 aa, Influenza virus
VAMENQHTIDM

SEQ ID NO: 541209 - protein, 11 aa, Influenza virus
VAMVFSQEDCM

SEQ ID NO: 541210 - protein, 11 aa, Influenza virus
VAMVFSQEDCV

SEQ ID NO: 541211 - protein, 11 aa, Influenza virus
VAMVFSQEDRM

SEQ ID NO: 541212 - protein, 11 aa, Influenza virus
VAMVFSQEECM

SEQ ID NO: 541213 - protein, 11 aa, Influenza virus
VANFSMELPSF

SEQ ID NO: 541214 - protein, 11 aa, Influenza virus
VANGTKVNTLT

SEQ ID NO: 541215 - protein, 11 aa, Influenza virus
VAPEYGFKISK

SEQ ID NO: 541216 - protein, 11 aa, Influenza virus
VAPIMFSNKMA

SEQ ID NO: 541217 - protein, 11 aa, Influenza virus
VAPSPSNSRFE

SEQ ID NO: 541218 - protein, 11 aa, Influenza virus
VAPSPYNSRFE

SEQ ID NO: 541219 - protein, 11 aa, Influenza virus
VARCNTKCQTS

SEQ ID NO: 541220 - protein, 11 aa, Influenza virus
VARLGKGYMFE

SEQ ID NO: 541221 - protein, 11 aa, Influenza virus
VASSLVLLFMI

SEQ ID NO: 541222 - protein, 11 aa, Influenza virus
VASSLVLLLMI

SEQ ID NO: 541223 - protein, 11 aa, Influenza virus
VATGRVTVSTR

SEQ ID NO: 541224 - protein, 11 aa, Influenza virus
VATTHSWIPKR

SEQ ID NO: 541225 - protein, 11 aa, Influenza virus
VATTHSWTPKR

SEQ ID NO: 541226 - protein, 11 aa, Influenza virus
VATTHSWVPIL

SEQ ID NO: 541227 - protein, 11 aa, Influenza virus
VATTHSWVPKR

SEQ ID NO: 541228 - protein, 11 aa, Influenza virus
VAVAKDNAIRF

SEQ ID NO: 541229 - protein, 11 aa, Influenza virus
VAVENQHTIDL

SEQ ID NO: 541230 - protein, 11 aa, Influenza virus
VAVIKYNGIIT

SEQ ID NO: 541231 - protein, 11 aa, Influenza virus
VAVLKYKGIIT

SEQ ID NO: 541232 - protein, 11 aa, Influenza virus
VAVLKYNDIIT

SEQ ID NO: 541233 - protein, 11 aa, Influenza virus
VAVLKYNGIIT

SEQ ID NO: 541234 - protein, 11 aa, Influenza virus
VAVLKYNGVIT

SEQ ID NO: 541235 - protein, 11 aa, Influenza virus
VAVTDGPAANN

SEQ ID NO: 541236 - protein, 11 aa, Influenza virus
VAVTDGPAANS

SEQ ID NO: 541237 - protein, 11 aa, Influenza virus
VAVTHSVNLLE

SEQ ID NO: 541238 - protein, 11 aa, Influenza virus
VAWSASACHDG

SEQ ID NO: 541239 - protein, 11 aa, Influenza virus
VAWSATACHDG

SEQ ID NO: 541240 - protein, 11 aa, Influenza virus
VAWSATACSDG

SEQ ID NO: 541241 - protein, 11 aa, Influenza virus
VAWSSSSCFDG

SEQ ID NO: 541242 - protein, 11 aa, Influenza virus
VAWSSSSCHDG

SEQ ID NO: 541243 - protein, 11 aa, Influenza virus
VAWSSTSCFDG

SEQ ID NO: 541244 - protein, 11 aa, Influenza virus
VAYDKICIGYQ

SEQ ID NO: 541245 - protein, 11 aa, Influenza virus
VAYERMCNILK

SEQ ID NO: 541246 - protein, 11 aa, Influenza virus
VAYMLERELVR

SEQ ID NO: 541247 - protein, 11 aa, Influenza virus
VCAAWSSSSCH

SEQ ID NO: 541248 - protein, 11 aa, Influenza virus
VCATCEQIADA

SEQ ID NO: 541249 - protein, 11 aa, Influenza virus
VCATCEQIADS

SEQ ID NO: 541250 - protein, 11 aa, Influenza virus
VCFMYSDFHFI

SEQ ID NO: 541251 - protein, 11 aa, Influenza virus
VCHNGICPVVF

SEQ ID NO: 541252 - protein, 11 aa, Influenza virus
VCHNGTCAVVM

SEQ ID NO: 541253 - protein, 11 aa, Influenza virus
VCHNGTCVVIM

SEQ ID NO: 541254 - protein, 11 aa, Influenza virus
VCHNGTCVVVM

SEQ ID NO: 541255 - protein, 11 aa, Influenza virus
VCHNGVCPVVF

SEQ ID NO: 541256 - protein, 11 aa, Influenza virus
VCHSGICPVVF

SEQ ID NO: 541257 - protein, 11 aa, Influenza virus
VCHSGVCPVVF

SEQ ID NO: 541258 - protein, 11 aa, Influenza virus
VCIAWSRSSCH

SEQ ID NO: 541259 - protein, 11 aa, Influenza virus
VCIAWSSASCH

SEQ ID NO: 541260 - protein, 11 aa, Influenza virus
VCIAWSSSSCH

SEQ ID NO: 541261 - protein, 11 aa, Influenza virus
VCIAWSSSSCY

SEQ ID NO: 541262 - protein, 11 aa, Influenza virus
VCIKFVSSDCS

SEQ ID NO: 541263 - protein, 11 aa, Influenza virus
VCINGICTVVM

SEQ ID NO: 541264 - protein, 11 aa, Influenza virus
VCINGSCAVVM

SEQ ID NO: 541265 - protein, 11 aa, Influenza virus
VCINGSCIVVM

SEQ ID NO: 541266 - protein, 11 aa, Influenza virus
VCINGSCTVVM

SEQ ID NO: 541267 - protein, 11 aa, Influenza virus
VCINGTCAVVM

SEQ ID NO: 541268 - protein, 11 aa, Influenza virus
VCINGTCTVVM

SEQ ID NO: 541269 - protein, 11 aa, Influenza virus
VCISGPNNNAS

SEQ ID NO: 541270 - protein, 11 aa, Influenza virus
VCISGTCAVVM

SEQ ID NO: 541271 - protein, 11 aa, Influenza virus
VCITGDDRNAT

SEQ ID NO: 541272 - protein, 11 aa, Influenza virus
VCMAWSSSSCH

SEQ ID NO: 541273 - protein, 11 aa, Influenza virus
VCMESVRNGTY

SEQ ID NO: 541274 - protein, 11 aa, Influenza virus
VCMSGPNNNAS

SEQ ID NO: 541275 - protein, 11 aa, Influenza virus
VCPVIMTDGPA

SEQ ID NO: 541276 - protein, 11 aa, Influenza virus
VCPVVFTDGSA

SEQ ID NO: 541277 - protein, 11 aa, Influenza virus
VCPVVMTDGPA

SEQ ID NO: 541278 - protein, 11 aa, Influenza virus
VCQDEFCYTLI

SEQ ID NO: 541279 - protein, 11 aa, Influenza virus
VCQDEFCYTLM

SEQ ID NO: 541280 - protein, 11 aa, Influenza virus
VCQDEFCYTLV

SEQ ID NO: 541281 - protein, 11 aa, Influenza virus
VCQNGVCPVVF

SEQ ID NO: 541282 - protein, 11 aa, Influenza virus
VCRALLAKSVF

SEQ ID NO: 541283 - protein, 11 aa, Influenza virus
VCRDNWHASNR

SEQ ID NO: 541284 - protein, 11 aa, Influenza virus
VCRDNWHGSNR

SEQ ID NO: 541285 - protein, 11 aa, Influenza virus
VCRDNWKGANR

SEQ ID NO: 541286 - protein, 11 aa, Influenza virus
VCRDNWKGSNR

SEQ ID NO: 541287 - protein, 11 aa, Influenza virus
VCRDNWMGSNR

SEQ ID NO: 541288 - protein, 11 aa, Influenza virus
VCRDNWNGMNR

SEQ ID NO: 541289 - protein, 11 aa, Influenza virus
VCRDNWQGANR

SEQ ID NO: 541290 - protein, 11 aa, Influenza virus
VCRDNWRGANR

SEQ ID NO: 541291 - protein, 11 aa, Influenza virus
VCRDNWRGFNR

SEQ ID NO: 541292 - protein, 11 aa, Influenza virus
VCRDNWRGSNR

SEQ ID NO: 541293 - protein, 11 aa, Influenza virus
VCRDNWTGTNR

SEQ ID NO: 541294 - protein, 11 aa, Influenza virus
VCRDSWHGSNR

SEQ ID NO: 541295 - protein, 11 aa, Influenza virus
VCRTLLAKSVF

SEQ ID NO: 541296 - protein, 11 aa, Influenza virus
VCSGIFGDNPR

SEQ ID NO: 541297 - protein, 11 aa, Influenza virus
VCSGLVGDTPR

SEQ ID NO: 541298 - protein, 11 aa, Influenza virus
VCSGVFGDNPR

SEQ ID NO: 541299 - protein, 11 aa, Influenza virus
VCSKFHSDTPR

SEQ ID NO: 541300 - protein, 11 aa, Influenza virus
VCSNGSCRCTI

SEQ ID NO: 541301 - protein, 11 aa, Influenza virus
VCTGILTDTSR

SEQ ID NO: 541302 - protein, 11 aa, Influenza virus
VCTGVLTDTSR

SEQ ID NO: 541303 - protein, 11 aa, Influenza virus
VCTKGKKAVDL

SEQ ID NO: 541304 - protein, 11 aa, Influenza virus
VCVAWSSSSCH

SEQ ID NO: 541305 - protein, 11 aa, Influenza virus
VCVSLLQSAIL

SEQ ID NO: 541306 - protein, 11 aa, Influenza virus
VCVTGDDGNAT

SEQ ID NO: 541307 - protein, 11 aa, Influenza virus
VCVTGDDKNAT

SEQ ID NO: 541308 - protein, 11 aa, Influenza virus
VCVTGDDRNAT

SEQ ID NO: 541309 - protein, 11 aa, Influenza virus
VCWDNWRGSNR

SEQ ID NO: 541310 - protein, 11 aa, Influenza virus
VCYNPCFYVEL

SEQ ID NO: 541311 - protein, 11 aa, Influenza virus
VCYPGSIENQE

SEQ ID NO: 541312 - protein, 11 aa, Influenza virus
VCYPGSIKNQE

SEQ ID NO: 541313 - protein, 11 aa, Influenza virus
VDALLGDPHCD

SEQ ID NO: 541314 - protein, 11 aa, Influenza virus
VDCFLWHVRKR

SEQ ID NO: 541315 - protein, 11 aa, Influenza virus
VDDAVTDIWSY

SEQ ID NO: 541316 - protein, 11 aa, Influenza virus
VDDAVTDVWSY

SEQ ID NO: 541317 - protein, 11 aa, Influenza virus
VDEGNGCFELL

SEQ ID NO: 541318 - protein, 11 aa, Influenza virus
VDGFEPNGCIE

SEQ ID NO: 541319 - protein, 11 aa, Influenza virus
VDGFEPNGSIE

SEQ ID NO: 541320 - protein, 11 aa, Influenza virus
VDGFEPNGYIE

SEQ ID NO: 541321 - protein, 11 aa, Influenza virus
VDGFKPNGCIE

SEQ ID NO: 541322 - protein, 11 aa, Influenza virus
VDGQDCDLING

SEQ ID NO: 541323 - protein, 11 aa, Influenza virus
VDGQSGRIDFH

SEQ ID NO: 541324 - protein, 11 aa, Influenza virus
VDGSSSACLRG

SEQ ID NO: 541325 - protein, 11 aa, Influenza virus
VDGTIAGFIEG

SEQ ID NO: 541326 - protein, 11 aa, Influenza virus
VDGWYGFHHSN

SEQ ID NO: 541327 - protein, 11 aa, Influenza virus
VDGWYGFRHHN

SEQ ID NO: 541328 - protein, 11 aa, Influenza virus
VDGWYGFRHQN

SEQ ID NO: 541329 - protein, 11 aa, Influenza virus
VDGWYGYHHEN

SEQ ID NO: 541330 - protein, 11 aa, Influenza virus
VDGWYGYHHIN

SEQ ID NO: 541331 - protein, 11 aa, Influenza virus
VDGWYGYHHNN

SEQ ID NO: 541332 - protein, 11 aa, Influenza virus
VDGWYGYHHQN

SEQ ID NO: 541333 - protein, 11 aa, Influenza virus
VDGWYGYHHSK

SEQ ID NO: 541334 - protein, 11 aa, Influenza virus
VDGWYGYHHSN

SEQ ID NO: 541335 - protein, 11 aa, Influenza virus
VDGWYGYHHTN

SEQ ID NO: 541336 - protein, 11 aa, Influenza virus
VDHMAIIKKYT

SEQ ID NO: 541337 - protein, 11 aa, Influenza virus
VDHMAIIKRYT

SEQ ID NO: 541338 - protein, 11 aa, Influenza virus
VDKLTQGRQTF

SEQ ID NO: 541339 - protein, 11 aa, Influenza virus
VDKLTQGRQTY

SEQ ID NO: 541340 - protein, 11 aa, Influenza virus
VDKMNREFEVM

SEQ ID NO: 541341 - protein, 11 aa, Influenza virus
VDKMNREFEVV

SEQ ID NO: 541342 - protein, 11 aa, Influenza virus
VDKMNREFGVV

SEQ ID NO: 541343 - protein, 11 aa, Influenza virus
VDLGSCGILGT

SEQ ID NO: 541344 - protein, 11 aa, Influenza virus
VDLVETNHTGT

SEQ ID NO: 541345 - protein, 11 aa, Influenza virus
VDLWSYNAELL

SEQ ID NO: 541346 - protein, 11 aa, Influenza virus
VDNHSMSDIEA

SEQ ID NO: 541347 - protein, 11 aa, Influenza virus
VDNKNWSGYSG

SEQ ID NO: 541348 - protein, 11 aa, Influenza virus
VDNNGELRHLF

SEQ ID NO: 541349 - protein, 11 aa, Influenza virus
VDNNNWFGYFG

SEQ ID NO: 541350 - protein, 11 aa, Influenza virus
VDNNNWSGYSG

SEQ ID NO: 541351 - protein, 11 aa, Influenza virus
VDNNSWSGYSG

SEQ ID NO: 541352 - protein, 11 aa, Influenza virus
VDNSNWSGYSG

SEQ ID NO: 541353 - protein, 11 aa, Influenza virus
VDQITGKLNRL

SEQ ID NO: 541354 - protein, 11 aa, Influenza virus
VDQSLIIAARN

SEQ ID NO: 541355 - protein, 11 aa, Influenza virus
VDQSLIIAARS

SEQ ID NO: 541356 - protein, 11 aa, Influenza virus
VDQSLVIAARN

SEQ ID NO: 541357 - protein, 11 aa, Influenza virus
VDQVRESRNPG

SEQ ID NO: 541358 - protein, 11 aa, Influenza virus
VDRLTQGRQTY

SEQ ID NO: 541359 - protein, 11 aa, Influenza virus
VDSIGSWSQNI

SEQ ID NO: 541360 - protein, 11 aa, Influenza virus
VDSIVSWSQNI

SEQ ID NO: 541361 - protein, 11 aa, Influenza virus
VDTCYPFDVPD

SEQ ID NO: 541362 - protein, 11 aa, Influenza virus
VDTGDGCFEIL

SEQ ID NO: 541363 - protein, 11 aa, Influenza virus
VDTGNGCFDIL

SEQ ID NO: 541364 - protein, 11 aa, Influenza virus
VDTIIENNVTV

SEQ ID NO: 541365 - protein, 11 aa, Influenza virus
VDTIIESNITV

SEQ ID NO: 541366 - protein, 11 aa, Influenza virus
VDTIIESNVTV

SEQ ID NO: 541367 - protein, 11 aa, Influenza virus
VDTILEKNITV

SEQ ID NO: 541368 - protein, 11 aa, Influenza virus
VDTILEKNVTV

SEQ ID NO: 541369 - protein, 11 aa, Influenza virus
VDTILERNVTV

SEQ ID NO: 541370 - protein, 11 aa, Influenza virus
VDTIMEKNITV

SEQ ID NO: 541371 - protein, 11 aa, Influenza virus
VDTIMEKNVTV

SEQ ID NO: 541372 - protein, 11 aa, Influenza virus
VDTIMERNVTV

SEQ ID NO: 541373 - protein, 11 aa, Influenza virus
VDTLLEKNVTV

SEQ ID NO: 541374 - protein, 11 aa, Influenza virus
VDTLLENDVPV

SEQ ID NO: 541375 - protein, 11 aa, Influenza virus
VDTLLENGVPV

SEQ ID NO: 541376 - protein, 11 aa, Influenza virus
VDTLLENNVPV

SEQ ID NO: 541377 - protein, 11 aa, Influenza virus
VDTLLESDVPV

SEQ ID NO: 541378 - protein, 11 aa, Influenza virus
VDTLTEKGIEV

SEQ ID NO: 541379 - protein, 11 aa, Influenza virus
VDTLTENGVPV

SEQ ID NO: 541380 - protein, 11 aa, Influenza virus
VDTLTETGVPV

SEQ ID NO: 541381 - protein, 11 aa, Influenza virus
VDTNLERNVTV

SEQ ID NO: 541382 - protein, 11 aa, Influenza virus
VDTVLEKNVTV

SEQ ID NO: 541383 - protein, 11 aa, Influenza virus
VDTVLERNVTV

SEQ ID NO: 541384 - protein, 11 aa, Influenza virus
VDTVREKNVTV

SEQ ID NO: 541385 - protein, 11 aa, Influenza virus
VDVYCICRDNW

SEQ ID NO: 541386 - protein, 11 aa, Influenza virus
VEAESSVKEKD

SEQ ID NO: 541387 - protein, 11 aa, Influenza virus
VEAMISRARID

SEQ ID NO: 541388 - protein, 11 aa, Influenza virus
VEAMMSRARID

SEQ ID NO: 541389 - protein, 11 aa, Influenza virus
VEAMVSRARID

SEQ ID NO: 541390 - protein, 11 aa, Influenza virus
VEAVIYGNPKC

SEQ ID NO: 541391 - protein, 11 aa, Influenza virus
VECICRDNWTG

SEQ ID NO: 541392 - protein, 11 aa, Influenza virus
VECIGWSSTSC

SEQ ID NO: 541393 - protein, 11 aa, Influenza virus
VECVCRDNWNG

SEQ ID NO: 541394 - protein, 11 aa, Influenza virus
VECVCRDNWRG

SEQ ID NO: 541395 - protein, 11 aa, Influenza virus
VECVCRDNWTG

SEQ ID NO: 541396 - protein, 11 aa, Influenza virus
VECVGWSSTSC

SEQ ID NO: 541397 - protein, 11 aa, Influenza virus
VEDGFLDVWTY

SEQ ID NO: 541398 - protein, 11 aa, Influenza virus
VEDGSIGKVCR

SEQ ID NO: 541399 - protein, 11 aa, Influenza virus
VEDTKIDLWSY

SEQ ID NO: 541400 - protein, 11 aa, Influenza virus
VEDTKVDLWSY

SEQ ID NO: 541401 - protein, 11 aa, Influenza virus
VEECLINDPWV

SEQ ID NO: 541402 - protein, 11 aa, Influenza virus
VEECSCYPRFP

SEQ ID NO: 541403 - protein, 11 aa, Influenza virus
VEECSCYPRSP

SEQ ID NO: 541404 - protein, 11 aa, Influenza virus
VEECSCYPRYP

SEQ ID NO: 541405 - protein, 11 aa, Influenza virus
VEECSCYPRYS

SEQ ID NO: 541406 - protein, 11 aa, Influenza virus
VEEGSIGKVCR

SEQ ID NO: 541407 - protein, 11 aa, Influenza virus
VEELVHGGIDP

SEQ ID NO: 541408 - protein, 11 aa, Influenza virus
VEELVHGGINP

SEQ ID NO: 541409 - protein, 11 aa, Influenza virus
VEELVHGGVDP

SEQ ID NO: 541410 - protein, 11 aa, Influenza virus
VEELVHGQVNP

SEQ ID NO: 541411 - protein, 11 aa, Influenza virus
VEELVHRGIDP

SEQ ID NO: 541412 - protein, 11 aa, Influenza virus
VEESSIGKVCR

SEQ ID NO: 541413 - protein, 11 aa, Influenza virus
VEFCGTSGTYG

SEQ ID NO: 541414 - protein, 11 aa, Influenza virus
VEFEPFQSLVP

SEQ ID NO: 541415 - protein, 11 aa, Influenza virus
VEGRIQDLEKY

SEQ ID NO: 541416 - protein, 11 aa, Influenza virus
VEGRIQDLERY

SEQ ID NO: 541417 - protein, 11 aa, Influenza virus
VEGWVVIAKDN

SEQ ID NO: 541418 - protein, 11 aa, Influenza virus
VEGWVVIAQDN

SEQ ID NO: 541419 - protein, 11 aa, Influenza virus
VEGWVVIEKDN

SEQ ID NO: 541420 - protein, 11 aa, Influenza virus
VEGWVVVAKDN

SEQ ID NO: 541421 - protein, 11 aa, Influenza virus
VEITGIDKVCT

SEQ ID NO: 541422 - protein, 11 aa, Influenza virus
VEITGINKVCT

SEQ ID NO: 541423 - protein, 11 aa, Influenza virus
VEKQIGNVINW

SEQ ID NO: 541424 - protein, 11 aa, Influenza virus
VEKQLGNVINW

SEQ ID NO: 541425 - protein, 11 aa, Influenza virus
VEKRINMIADR

SEQ ID NO: 541426 - protein, 11 aa, Influenza virus
VEKRINMLADR

SEQ ID NO: 541427 - protein, 11 aa, Influenza virus
VEKRINMLADW

SEQ ID NO: 541428 - protein, 11 aa, Influenza virus
VEKTNEKFHQI

SEQ ID NO: 541429 - protein, 11 aa, Influenza virus
VELIRGRPEEA

SEQ ID NO: 541430 - protein, 11 aa, Influenza virus
VELIRGRPEEV

SEQ ID NO: 541431 - protein, 11 aa, Influenza virus
VELIRGRPKED

SEQ ID NO: 541432 - protein, 11 aa, Influenza virus
VELIRGRPKEE

SEQ ID NO: 541433 - protein, 11 aa, Influenza virus
VELLVLMENER

SEQ ID NO: 541434 - protein, 11 aa, Influenza virus
VELSSGYKDVI

SEQ ID NO: 541435 - protein, 11 aa, Influenza virus
VELSSMGVYQI

SEQ ID NO: 541436 - protein, 11 aa, Influenza virus
VEMIRGQPKEK

SEQ ID NO: 541437 - protein, 11 aa, Influenza virus
VEMIRGQPNER

SEQ ID NO: 541438 - protein, 11 aa, Influenza virus
VENGTSVKTLT

SEQ ID NO: 541439 - protein, 11 aa, Influenza virus
VENLEELRFVF

SEQ ID NO: 541440 - protein, 11 aa, Influenza virus
VENLFDEVRRR

SEQ ID NO: 541441 - protein, 11 aa, Influenza virus
VENLNKKMEDG

SEQ ID NO: 541442 - protein, 11 aa, Influenza virus
VENQEELRSLF

SEQ ID NO: 541443 - protein, 11 aa, Influenza virus
VENRINMLADR

SEQ ID NO: 541444 - protein, 11 aa, Influenza virus
VENTYVNNTTI

SEQ ID NO: 541445 - protein, 11 aa, Influenza virus
VEPKGLFGAIA

SEQ ID NO: 541446 - protein, 11 aa, Influenza virus
VEPRGLFGAIA

SEQ ID NO: 541447 - protein, 11 aa, Influenza virus
VEQQIGNVINW

SEQ ID NO: 541448 - protein, 11 aa, Influenza virus
VEQRINMLADR

SEQ ID NO: 541449 - protein, 11 aa, Influenza virus
VERGLFGAIAG

SEQ ID NO: 541450 - protein, 11 aa, Influenza virus
VERILEEESDE

SEQ ID NO: 541451 - protein, 11 aa, Influenza virus
VERMVLSAFDE

SEQ ID NO: 541452 - protein, 11 aa, Influenza virus
VERPKEIEGIC

SEQ ID NO: 541453 - protein, 11 aa, Influenza virus
VERPKEMEGIC

SEQ ID NO: 541454 - protein, 11 aa, Influenza virus
VERPKEMEGVC

SEQ ID NO: 541455 - protein, 11 aa, Influenza virus
VERPSAPEGMC

SEQ ID NO: 541456 - protein, 11 aa, Influenza virus
VERQIGNVINW

SEQ ID NO: 541457 - protein, 11 aa, Influenza virus
VERRINMLADR

SEQ ID NO: 541458 - protein, 11 aa, Influenza virus
VERTKEMEGIC

SEQ ID NO: 541459 - protein, 11 aa, Influenza virus
VESAVLRGFLI

SEQ ID NO: 541460 - protein, 11 aa, Influenza virus
VESMIEAESSV

SEQ ID NO: 541461 - protein, 11 aa, Influenza virus
VESNGNLIAPW

SEQ ID NO: 541462 - protein, 11 aa, Influenza virus
VESNGNLVAPW

SEQ ID NO: 541463 - protein, 11 aa, Influenza virus
VESSTYQNNFV

SEQ ID NO: 541464 - protein, 11 aa, Influenza virus
VETGYVCSKFH

SEQ ID NO: 541465 - protein, 11 aa, Influenza virus
VETNHTDELCP

SEQ ID NO: 541466 - protein, 11 aa, Influenza virus
VETNHTGTYCS

SEQ ID NO: 541467 - protein, 11 aa, Influenza virus
VETSHTGTYCS

SEQ ID NO: 541468 - protein, 11 aa, Influenza virus
VETYVLSIIPS

SEQ ID NO: 541469 - protein, 11 aa, Influenza virus
VETYVLSIVPS

SEQ ID NO: 541470 - protein, 11 aa, Influenza virus
VETYVLSVIPS

SEQ ID NO: 541471 - protein, 11 aa, Influenza virus
VEVITAQELVE

SEQ ID NO: 541472 - protein, 11 aa, Influenza virus
VEVLHLTQGTC

SEQ ID NO: 541473 - protein, 11 aa, Influenza virus
VEVTNATELVQ

SEQ ID NO: 541474 - protein, 11 aa, Influenza virus
VEVVAAQELVE

SEQ ID NO: 541475 - protein, 11 aa, Influenza virus
VEVVDATETVE

SEQ ID NO: 541476 - protein, 11 aa, Influenza virus
VEVVNATETVE

SEQ ID NO: 541477 - protein, 11 aa, Influenza virus
VEVVSAKELVE

SEQ ID NO: 541478 - protein, 11 aa, Influenza virus
VEVVTAQELVE

SEQ ID NO: 541479 - protein, 11 aa, Influenza virus
VEWSATACHDG

SEQ ID NO: 541480 - protein, 11 aa, Influenza virus
VEWTSNSLIAL

SEQ ID NO: 541481 - protein, 11 aa, Influenza virus
VEYASKTRISE

SEQ ID NO: 541482 - protein, 11 aa, Influenza virus
VEYDAVATTHS

SEQ ID NO: 541483 - protein, 11 aa, Influenza virus
VEYNGKSLGIQ

SEQ ID NO: 541484 - protein, 11 aa, Influenza virus
VFAGKNADLEA

SEQ ID NO: 541485 - protein, 11 aa, Influenza virus
VFAGKNSDLEA

SEQ ID NO: 541486 - protein, 11 aa, Influenza virus
VFAGKNTDLEA

SEQ ID NO: 541487 - protein, 11 aa, Influenza virus
VFAGKNTDLEV

SEQ ID NO: 541488 - protein, 11 aa, Influenza virus
VFCGTSGTYGA

SEQ ID NO: 541489 - protein, 11 aa, Influenza virus
VFCGTSGTYGK

SEQ ID NO: 541490 - protein, 11 aa, Influenza virus
VFCGTSGTYGS

SEQ ID NO: 541491 - protein, 11 aa, Influenza virus
VFCGTSGTYGT

SEQ ID NO: 541492 - protein, 11 aa, Influenza virus
VFCGVSGEVPG

SEQ ID NO: 541493 - protein, 11 aa, Influenza virus
VFCGVSSEAPG

SEQ ID NO: 541494 - protein, 11 aa, Influenza virus
VFCGVSSEVPG

SEQ ID NO: 541495 - protein, 11 aa, Influenza virus
VFFCLKNGNMR

SEQ ID NO: 541496 - protein, 11 aa, Influenza virus
VFFCLRNGNMR

SEQ ID NO: 541497 - protein, 11 aa, Influenza virus
VFICIKNGNMQ

SEQ ID NO: 541498 - protein, 11 aa, Influenza virus
VFICIKNGNMR

SEQ ID NO: 541499 - protein, 11 aa, Influenza virus
VFICMKNGNMQ

SEQ ID NO: 541500 - protein, 11 aa, Influenza virus
VFICVKNGNMR

SEQ ID NO: 541501 - protein, 11 aa, Influenza virus
VFIERPTAVDT

SEQ ID NO: 541502 - protein, 11 aa, Influenza virus
VFIIREPFVSC

SEQ ID NO: 541503 - protein, 11 aa, Influenza virus
VFMCVKNGNMR

SEQ ID NO: 541504 - protein, 11 aa, Influenza virus
VFNTIGNLIAP

SEQ ID NO: 541505 - protein, 11 aa, Influenza virus
VFNTIGNLVAP

SEQ ID NO: 541506 - protein, 11 aa, Influenza virus
VFPNEVGAKIL

SEQ ID NO: 541507 - protein, 11 aa, Influenza virus
VFPNEVGARII

SEQ ID NO: 541508 - protein, 11 aa, Influenza virus
VFPNEVGARIL

SEQ ID NO: 541509 - protein, 11 aa, Influenza virus
VFPQLNQTYRN

SEQ ID NO: 541510 - protein, 11 aa, Influenza virus
VFREQKQEFKM

SEQ ID NO: 541511 - protein, 11 aa, Influenza virus
VFSGKNTDLEA

SEQ ID NO: 541512 - protein, 11 aa, Influenza virus
VFSIAASYKRI

SEQ ID NO: 541513 - protein, 11 aa, Influenza virus
VFSNAASYKRI

SEQ ID NO: 541514 - protein, 11 aa, Influenza virus
VFSSAASYKRI

SEQ ID NO: 541515 - protein, 11 aa, Influenza virus
VFSSAASYKRV

SEQ ID NO: 541516 - protein, 11 aa, Influenza virus
VFTDGSATGPA

SEQ ID NO: 541517 - protein, 11 aa, Influenza virus
VFTLTVPSERG

SEQ ID NO: 541518 - protein, 11 aa, Influenza virus
VFVALILGFVL

SEQ ID NO: 541519 - protein, 11 aa, Influenza virus
VFVIREPCISC

SEQ ID NO: 541520 - protein, 11 aa, Influenza virus
VFVIREPFISC

SEQ ID NO: 541521 - protein, 11 aa, Influenza virus
VFVIREPFVAC

SEQ ID NO: 541522 - protein, 11 aa, Influenza virus
VFVIREPFVSC

SEQ ID NO: 541523 - protein, 11 aa, Influenza virus
VFWGTSGTYGT

SEQ ID NO: 541524 - protein, 11 aa, Influenza virus
VFWTSNSIVAL

SEQ ID NO: 541525 - protein, 11 aa, Influenza virus
VGAKILTSESQ

SEQ ID NO: 541526 - protein, 11 aa, Influenza virus
VGARIITSESQ

SEQ ID NO: 541527 - protein, 11 aa, Influenza virus
VGARILASESQ

SEQ ID NO: 541528 - protein, 11 aa, Influenza virus
VGARILTSESQ

SEQ ID NO: 541529 - protein, 11 aa, Influenza virus
VGARPQVNGQS

SEQ ID NO: 541530 - protein, 11 aa, Influenza virus
VGCVILLNPFV

SEQ ID NO: 541531 - protein, 11 aa, Influenza virus
VGDTPRNDDRF

SEQ ID NO: 541532 - protein, 11 aa, Influenza virus
VGDTPRNDDRS

SEQ ID NO: 541533 - protein, 11 aa, Influenza virus
VGDTPRNDDSS

SEQ ID NO: 541534 - protein, 11 aa, Influenza virus
VGDTPRNEDGS

SEQ ID NO: 541535 - protein, 11 aa, Influenza virus
VGDTPRNEDSS

SEQ ID NO: 541536 - protein, 11 aa, Influenza virus
VGDTPRNGDSS

SEQ ID NO: 541537 - protein, 11 aa, Influenza virus
VGDTPRNNDGS

SEQ ID NO: 541538 - protein, 11 aa, Influenza virus
VGGIDTNKTFQ

SEQ ID NO: 541539 - protein, 11 aa, Influenza virus
VGGINTNKTFQ

SEQ ID NO: 541540 - protein, 11 aa, Influenza virus
VGGINTNRTFQ

SEQ ID NO: 541541 - protein, 11 aa, Influenza virus
VGGNEKKAKLA

SEQ ID NO: 541542 - protein, 11 aa, Influenza virus
VGGSGTDNYGV

SEQ ID NO: 541543 - protein, 11 aa, Influenza virus
VGGSGTNNYGV

SEQ ID NO: 541544 - protein, 11 aa, Influenza virus
VGIAADKESTQ

SEQ ID NO: 541545 - protein, 11 aa, Influenza virus
VGINMSKKKSY

SEQ ID NO: 541546 - protein, 11 aa, Influenza virus
VGINMSKRKSY

SEQ ID NO: 541547 - protein, 11 aa, Influenza virus
VGKCNDPYPGN

SEQ ID NO: 541548 - protein, 11 aa, Influenza virus
VGKCNEPYPGN

SEQ ID NO: 541549 - protein, 11 aa, Influenza virus
VGKCPRYVKQS

SEQ ID NO: 541550 - protein, 11 aa, Influenza virus
VGLILAFILWA

SEQ ID NO: 541551 - protein, 11 aa, Influenza virus
VGLILAFIMWA

SEQ ID NO: 541552 - protein, 11 aa, Influenza virus
VGLILAFIMWT

SEQ ID NO: 541553 - protein, 11 aa, Influenza virus
VGLILSFIMWA

SEQ ID NO: 541554 - protein, 11 aa, Influenza virus
VGLILTFIMWA

SEQ ID NO: 541555 - protein, 11 aa, Influenza virus
VGLLLQIISLC

SEQ ID NO: 541556 - protein, 11 aa, Influenza virus
VGLLLQITSLC

SEQ ID NO: 541557 - protein, 11 aa, Influenza virus
VGLLLQVTSLC

SEQ ID NO: 541558 - protein, 11 aa, Influenza virus
VGLRNTPSIDP

SEQ ID NO: 541559 - protein, 11 aa, Influenza virus
VGLRNTPSIEP

SEQ ID NO: 541560 - protein, 11 aa, Influenza virus
VGLRNTPSVEP

SEQ ID NO: 541561 - protein, 11 aa, Influenza virus
VGLVFFCLKNG

SEQ ID NO: 541562 - protein, 11 aa, Influenza virus
VGMAADKESTQ

SEQ ID NO: 541563 - protein, 11 aa, Influenza virus
VGNDNWSGYSG

SEQ ID NO: 541564 - protein, 11 aa, Influenza virus
VGNGCFEFYHK

SEQ ID NO: 541565 - protein, 11 aa, Influenza virus
VGNLAFNTVIH

SEQ ID NO: 541566 - protein, 11 aa, Influenza virus
VGNLIFNTVIH

SEQ ID NO: 541567 - protein, 11 aa, Influenza virus
VGNLVFNTVIH

SEQ ID NO: 541568 - protein, 11 aa, Influenza virus
VGNPSCASNIN

SEQ ID NO: 541569 - protein, 11 aa, Influenza virus
VGNPSCATNIN

SEQ ID NO: 541570 - protein, 11 aa, Influenza virus
VGPGSFPDGAQ

SEQ ID NO: 541571 - protein, 11 aa, Influenza virus
VGPILSFIMWA

SEQ ID NO: 541572 - protein, 11 aa, Influenza virus
VGRCPRYVKQS

SEQ ID NO: 541573 - protein, 11 aa, Influenza virus
VGRMTICIQGN

SEQ ID NO: 541574 - protein, 11 aa, Influenza virus
VGRMTICVQGN

SEQ ID NO: 541575 - protein, 11 aa, Influenza virus
VGSGSFPDGAK

SEQ ID NO: 541576 - protein, 11 aa, Influenza virus
VGSGSFPDGAQ

SEQ ID NO: 541577 - protein, 11 aa, Influenza virus
VGSGSFPDGAR

SEQ ID NO: 541578 - protein, 11 aa, Influenza virus
VGSGSFPNGAQ

SEQ ID NO: 541579 - protein, 11 aa, Influenza virus
VGSRGHVFVIR

SEQ ID NO: 541580 - protein, 11 aa, Influenza virus
VGSSIYQNSFV

SEQ ID NO: 541581 - protein, 11 aa, Influenza virus
VGSSKYQQSFS

SEQ ID NO: 541582 - protein, 11 aa, Influenza virus
VGSSKYRQSFS

SEQ ID NO: 541583 - protein, 11 aa, Influenza virus
VGSSTYHNSFV

SEQ ID NO: 541584 - protein, 11 aa, Influenza virus
VGSSTYQNNFV

SEQ ID NO: 541585 - protein, 11 aa, Influenza virus
VGSSTYQNSFV

SEQ ID NO: 541586 - protein, 11 aa, Influenza virus
VGSWSQNILRT

SEQ ID NO: 541587 - protein, 11 aa, Influenza virus
VGTRWMKIIRV

SEQ ID NO: 541588 - protein, 11 aa, Influenza virus
VGVAPSPSNSR

SEQ ID NO: 541589 - protein, 11 aa, Influenza virus
VGWSATACHDG

SEQ ID NO: 541590 - protein, 11 aa, Influenza virus
VGWSSTSCHDG

SEQ ID NO: 541591 - protein, 11 aa, Influenza virus
VGWSSTTCHDG

SEQ ID NO: 541592 - protein, 11 aa, Influenza virus
VGWTSNSIVVF

SEQ ID NO: 541593 - protein, 11 aa, Influenza virus
VGYHANNSTDT

SEQ ID NO: 541594 - protein, 11 aa, Influenza virus
VGYHANNSTKQ

SEQ ID NO: 541595 - protein, 11 aa, Influenza virus
VGYHSNNSTEK

SEQ ID NO: 541596 - protein, 11 aa, Influenza virus
VGYICSGVFGD

SEQ ID NO: 541597 - protein, 11 aa, Influenza virus
VGYLCAGIPSD

SEQ ID NO: 541598 - protein, 11 aa, Influenza virus
VGYLCAGIPTD

SEQ ID NO: 541599 - protein, 11 aa, Influenza virus
VGYLCAGLPSD

SEQ ID NO: 541600 - protein, 11 aa, Influenza virus
VGYLSTNSSDK

SEQ ID NO: 541601 - protein, 11 aa, Influenza virus
VGYLSTNSSEK

SEQ ID NO: 541602 - protein, 11 aa, Influenza virus
VGYLSTNSSER

SEQ ID NO: 541603 - protein, 11 aa, Influenza virus
VGYLSTNSTEK

SEQ ID NO: 541604 - protein, 11 aa, Influenza virus
VHDRIPHRTLL

SEQ ID NO: 541605 - protein, 11 aa, Influenza virus
VHFQNQVKIRR

SEQ ID NO: 541606 - protein, 11 aa, Influenza virus
VHFRNQIKIRR

SEQ ID NO: 541607 - protein, 11 aa, Influenza virus
VHFRNQVKIRR

SEQ ID NO: 541608 - protein, 11 aa, Influenza virus
VHFRSQVKIRR

SEQ ID NO: 541609 - protein, 11 aa, Influenza virus
VHHPSSDNEQT

SEQ ID NO: 541610 - protein, 11 aa, Influenza virus
VHHSSSLDEQN

SEQ ID NO: 541611 - protein, 11 aa, Influenza virus
VHIGPLSGSAQ

SEQ ID NO: 541612 - protein, 11 aa, Influenza virus
VHISPLAGSAQ

SEQ ID NO: 541613 - protein, 11 aa, Influenza virus
VHISPLSGSAQ

SEQ ID NO: 541614 - protein, 11 aa, Influenza virus
VHISSLSGSAQ

SEQ ID NO: 541615 - protein, 11 aa, Influenza virus
VHKSQLIWMAC

SEQ ID NO: 541616 - protein, 11 aa, Influenza virus
VHKSQLVWMAC

SEQ ID NO: 541617 - protein, 11 aa, Influenza virus
VHLGDCNFEGW

SEQ ID NO: 541618 - protein, 11 aa, Influenza virus
VHLGDCRFEGW

SEQ ID NO: 541619 - protein, 11 aa, Influenza virus
VHLGDCSFEGW

SEQ ID NO: 541620 - protein, 11 aa, Influenza virus
VHPLTIGECPK

SEQ ID NO: 541621 - protein, 11 aa, Influenza virus
VHPLTIGECPR

SEQ ID NO: 541622 - protein, 11 aa, Influenza virus
VHRNAIGDCPK

SEQ ID NO: 541623 - protein, 11 aa, Influenza virus
VHRNTFGDCPK

SEQ ID NO: 541624 - protein, 11 aa, Influenza virus
VHRNTIGDCPK

SEQ ID NO: 541625 - protein, 11 aa, Influenza virus
VHRSTIGDCPK

SEQ ID NO: 541626 - protein, 11 aa, Influenza virus
VHVSPLSGSAQ

SEQ ID NO: 541627 - protein, 11 aa, Influenza virus
VIAARNIVRRA

SEQ ID NO: 541628 - protein, 11 aa, Influenza virus
VIAKDNAIRFG

SEQ ID NO: 541629 - protein, 11 aa, Influenza virus
VIAKDNAVRFG

SEQ ID NO: 541630 - protein, 11 aa, Influenza virus
VIAQDNAIRFG

SEQ ID NO: 541631 - protein, 11 aa, Influenza virus
VIASTTAKAME

SEQ ID NO: 541632 - protein, 11 aa, Influenza virus
VIDGWTTANSK

SEQ ID NO: 541633 - protein, 11 aa, Influenza virus
VIDWTRDSVTE

SEQ ID NO: 541634 - protein, 11 aa, Influenza virus
VIEKDNAVRFG

SEQ ID NO: 541635 - protein, 11 aa, Influenza virus
VIGARPQVNGQ

SEQ ID NO: 541636 - protein, 11 aa, Influenza virus
VIGGWATANSK

SEQ ID NO: 541637 - protein, 11 aa, Influenza virus
VIGGWTIANSK

SEQ ID NO: 541638 - protein, 11 aa, Influenza virus
VIGGWTTANSK

SEQ ID NO: 541639 - protein, 11 aa, Influenza virus
VIHYGGIPTDV

SEQ ID NO: 541640 - protein, 11 aa, Influenza virus
VIHYGGMPTDV

SEQ ID NO: 541641 - protein, 11 aa, Influenza virus
VIHYGGVPTDV

SEQ ID NO: 541642 - protein, 11 aa, Influenza virus
VIITREPYVSC

SEQ ID NO: 541643 - protein, 11 aa, Influenza virus
VIKLLPFAAAP

SEQ ID NO: 541644 - protein, 11 aa, Influenza virus
VIKNNMINNDL

SEQ ID NO: 541645 - protein, 11 aa, Influenza virus
VIKNNMVNNDL

SEQ ID NO: 541646 - protein, 11 aa, Influenza virus
VIKYNGIITDT

SEQ ID NO: 541647 - protein, 11 aa, Influenza virus
VILEENTTYKI

SEQ ID NO: 541648 - protein, 11 aa, Influenza virus
VILLNPFVSHK

SEQ ID NO: 541649 - protein, 11 aa, Influenza virus
VILVLGLSMVK

SEQ ID NO: 541650 - protein, 11 aa, Influenza virus
VILVLGLSMVR

SEQ ID NO: 541651 - protein, 11 aa, Influenza virus
VILWFSFGASC

SEQ ID NO: 541652 - protein, 11 aa, Influenza virus
VILWFSLGASC

SEQ ID NO: 541653 - protein, 11 aa, Influenza virus
VIMEVVFPNEV

SEQ ID NO: 541654 - protein, 11 aa, Influenza virus
VIMTDGPANSQ

SEQ ID NO: 541655 - protein, 11 aa, Influenza virus
VIMTDGPASSQ

SEQ ID NO: 541656 - protein, 11 aa, Influenza virus
VIMTDGSANSQ

SEQ ID NO: 541657 - protein, 11 aa, Influenza virus
VIMTDGSASSQ

SEQ ID NO: 541658 - protein, 11 aa, Influenza virus
VINDKIDDQIE

SEQ ID NO: 541659 - protein, 11 aa, Influenza virus
VINFESTGNLI

SEQ ID NO: 541660 - protein, 11 aa, Influenza virus
VINTSKPFQNT

SEQ ID NO: 541661 - protein, 11 aa, Influenza virus
VINWTKDSITD

SEQ ID NO: 541662 - protein, 11 aa, Influenza virus
VINWTQDAMTE

SEQ ID NO: 541663 - protein, 11 aa, Influenza virus
VINWTRDAMTE

SEQ ID NO: 541664 - protein, 11 aa, Influenza virus
VINWTRDSIIE

SEQ ID NO: 541665 - protein, 11 aa, Influenza virus
VINWTRDSITE

SEQ ID NO: 541666 - protein, 11 aa, Influenza virus
VINWTRDSLTE

SEQ ID NO: 541667 - protein, 11 aa, Influenza virus
VINWTRDSMTE

SEQ ID NO: 541668 - protein, 11 aa, Influenza virus
VINWTRDSVTE

SEQ ID NO: 541669 - protein, 11 aa, Influenza virus
VIPLTTTPTKS

SEQ ID NO: 541670 - protein, 11 aa, Influenza virus
VIPSGPLKAEI

SEQ ID NO: 541671 - protein, 11 aa, Influenza virus
VIREPFISCSH

SEQ ID NO: 541672 - protein, 11 aa, Influenza virus
VIREPFISCSI

SEQ ID NO: 541673 - protein, 11 aa, Influenza virus
VIREPFISCSP

SEQ ID NO: 541674 - protein, 11 aa, Influenza virus
VIREPFISCSQ

SEQ ID NO: 541675 - protein, 11 aa, Influenza virus
VIREPFISCSV

SEQ ID NO: 541676 - protein, 11 aa, Influenza virus
VIREPFVACGP

SEQ ID NO: 541677 - protein, 11 aa, Influenza virus
VIREPFVACSP

SEQ ID NO: 541678 - protein, 11 aa, Influenza virus
VIREPFVSCGP

SEQ ID NO: 541679 - protein, 11 aa, Influenza virus
VIREPFVSCSI

SEQ ID NO: 541680 - protein, 11 aa, Influenza virus
VIREPFVSCSP

SEQ ID NO: 541681 - protein, 11 aa, Influenza virus
VIRNNMINNDL

SEQ ID NO: 541682 - protein, 11 aa, Influenza virus
VIRSWRKQILR

SEQ ID NO: 541683 - protein, 11 aa, Influenza virus
VISFESTGNLI

SEQ ID NO: 541684 - protein, 11 aa, Influenza virus
VISGWTTANSK

SEQ ID NO: 541685 - protein, 11 aa, Influenza virus
VITDTLKSWKG

SEQ ID NO: 541686 - protein, 11 aa, Influenza virus
VIVTREPYISC

SEQ ID NO: 541687 - protein, 11 aa, Influenza virus
VIVTREPYVSC

SEQ ID NO: 541688 - protein, 11 aa, Influenza virus
VIYGNPKCDIH

SEQ ID NO: 541689 - protein, 11 aa, Influenza virus
VIYGNPKCDTH

SEQ ID NO: 541690 - protein, 11 aa, Influenza virus
VIYGNPKCDVH

SEQ ID NO: 541691 - protein, 11 aa, Influenza virus
VKAVRGDLNFV

SEQ ID NO: 541692 - protein, 11 aa, Influenza virus
VKCICRDNWKG

SEQ ID NO: 541693 - protein, 11 aa, Influenza virus
VKCVCRDNWKG

SEQ ID NO: 541694 - protein, 11 aa, Influenza virus
VKCYQFALGQG

SEQ ID NO: 541695 - protein, 11 aa, Influenza virus
VKDRSPFRTLM

SEQ ID NO: 541696 - protein, 11 aa, Influenza virus
VKDRSPYRALM

SEQ ID NO: 541697 - protein, 11 aa, Influenza virus
VKDRSPYRTLM

SEQ ID NO: 541698 - protein, 11 aa, Influenza virus
VKEAQDVIMEV

SEQ ID NO: 541699 - protein, 11 aa, Influenza virus
VKEIGNGCFEF

SEQ ID NO: 541700 - protein, 11 aa, Influenza virus
VKELGNGCFEF

SEQ ID NO: 541701 - protein, 11 aa, Influenza virus
VKGDKICLGHH

SEQ ID NO: 541702 - protein, 11 aa, Influenza virus
VKGDQICIGYH

SEQ ID NO: 541703 - protein, 11 aa, Influenza virus
VKGDRICIGYH

SEQ ID NO: 541704 - protein, 11 aa, Influenza virus
VKGDYNNTTGR

SEQ ID NO: 541705 - protein, 11 aa, Influenza virus
VKGEYNNTTGR

SEQ ID NO: 541706 - protein, 11 aa, Influenza virus
VKGFAFKQGNS

SEQ ID NO: 541707 - protein, 11 aa, Influenza virus
VKGFGFRQGDD

SEQ ID NO: 541708 - protein, 11 aa, Influenza virus
VKGFGFRQGND

SEQ ID NO: 541709 - protein, 11 aa, Influenza virus
VKGFGFRQGNS

SEQ ID NO: 541710 - protein, 11 aa, Influenza virus
VKGFGFRQGSD

SEQ ID NO: 541711 - protein, 11 aa, Influenza virus
VKGFGFRQGTD

SEQ ID NO: 541712 - protein, 11 aa, Influenza virus
VKGFGFRQGTS

SEQ ID NO: 541713 - protein, 11 aa, Influenza virus
VKGFSFRYGDG

SEQ ID NO: 541714 - protein, 11 aa, Influenza virus
VKGRSHLRNDT

SEQ ID NO: 541715 - protein, 11 aa, Influenza virus
VKGWAFDNGDD

SEQ ID NO: 541716 - protein, 11 aa, Influenza virus
VKGWAFDNGND

SEQ ID NO: 541717 - protein, 11 aa, Influenza virus
VKGWAFDSGDD

SEQ ID NO: 541718 - protein, 11 aa, Influenza virus
VKGWAFDYGND

SEQ ID NO: 541719 - protein, 11 aa, Influenza virus
VKGWAFDYGSD

SEQ ID NO: 541720 - protein, 11 aa, Influenza virus
VKGWAPLSKDN

SEQ ID NO: 541721 - protein, 11 aa, Influenza virus
VKIKTNGNLIA

SEQ ID NO: 541722 - protein, 11 aa, Influenza virus
VKIQTNGNLIA

SEQ ID NO: 541723 - protein, 11 aa, Influenza virus
VKIQTSGNLIA

SEQ ID NO: 541724 - protein, 11 aa, Influenza virus
VKIRRRVDINP

SEQ ID NO: 541725 - protein, 11 aa, Influenza virus
VKIRRRVDMNP

SEQ ID NO: 541726 - protein, 11 aa, Influenza virus
VKIRRRVDTNP

SEQ ID NO: 541727 - protein, 11 aa, Influenza virus
VKIRRRVDVNP

SEQ ID NO: 541728 - protein, 11 aa, Influenza virus
VKKQLRENAEE

SEQ ID NO: 541729 - protein, 11 aa, Influenza virus
VKLEENSTYKI

SEQ ID NO: 541730 - protein, 11 aa, Influenza virus
VKLEENTSYKI

SEQ ID NO: 541731 - protein, 11 aa, Influenza virus
VKLEENTTYKI

SEQ ID NO: 541732 - protein, 11 aa, Influenza virus
VKLEENTTYRI

SEQ ID NO: 541733 - protein, 11 aa, Influenza virus
VKLSGGYKDII

SEQ ID NO: 541734 - protein, 11 aa, Influenza virus
VKLSGGYKDVI

SEQ ID NO: 541735 - protein, 11 aa, Influenza virus
VKLSNMGIYQI

SEQ ID NO: 541736 - protein, 11 aa, Influenza virus
VKLSNMGVYQI

SEQ ID NO: 541737 - protein, 11 aa, Influenza virus
VKLSSGYKDII

SEQ ID NO: 541738 - protein, 11 aa, Influenza virus
VKLSSGYKDVI

SEQ ID NO: 541739 - protein, 11 aa, Influenza virus
VKLSSGYKEVI

SEQ ID NO: 541740 - protein, 11 aa, Influenza virus
VKLSSGYKNVI

SEQ ID NO: 541741 - protein, 11 aa, Influenza virus
VKLSSMGIYQI

SEQ ID NO: 541742 - protein, 11 aa, Influenza virus
VKLSSMGVYQI

SEQ ID NO: 541743 - protein, 11 aa, Influenza virus
VKLYKKLKREI

SEQ ID NO: 541744 - protein, 11 aa, Influenza virus
VKLYKKLKREM

SEQ ID NO: 541745 - protein, 11 aa, Influenza virus
VKLYRKLKREI

SEQ ID NO: 541746 - protein, 11 aa, Influenza virus
VKMEKIVLLLA

SEQ ID NO: 541747 - protein, 11 aa, Influenza virus
VKMFDFIKWNV

SEQ ID NO: 541748 - protein, 11 aa, Influenza virus
VKMFDFSKWNV

SEQ ID NO: 541749 - protein, 11 aa, Influenza virus
VKMFDFTKWNV

SEQ ID NO: 541750 - protein, 11 aa, Influenza virus
VKMKWGMEMRR

SEQ ID NO: 541751 - protein, 11 aa, Influenza virus
VKMNPNQKIIT

SEQ ID NO: 541752 - protein, 11 aa, Influenza virus
VKMQLRDNAKE

SEQ ID NO: 541753 - protein, 11 aa, Influenza virus
VKNGNHAVHYC

SEQ ID NO: 541754 - protein, 11 aa, Influenza virus
VKNGNLRCTIC

SEQ ID NO: 541755 - protein, 11 aa, Influenza virus
VKNGNMQCTIC

SEQ ID NO: 541756 - protein, 11 aa, Influenza virus
VKNGNMRCTIC

SEQ ID NO: 541757 - protein, 11 aa, Influenza virus
VKNGNMRGTNW

SEQ ID NO: 541758 - protein, 11 aa, Influenza virus
VKNGTYDYPKY

SEQ ID NO: 541759 - protein, 11 aa, Influenza virus
VKNGTYNYPKY

SEQ ID NO: 541760 - protein, 11 aa, Influenza virus
VKNLFDEVKRR

SEQ ID NO: 541761 - protein, 11 aa, Influenza virus
VKNLFDEVRRR

SEQ ID NO: 541762 - protein, 11 aa, Influenza virus
VKNLYDKVRLQ

SEQ ID NO: 541763 - protein, 11 aa, Influenza virus
VKNLYDKVRMQ

SEQ ID NO: 541764 - protein, 11 aa, Influenza virus
VKNLYDRVRLQ

SEQ ID NO: 541765 - protein, 11 aa, Influenza virus
VKNLYEKVRLQ

SEQ ID NO: 541766 - protein, 11 aa, Influenza virus
VKNLYEKVRMQ

SEQ ID NO: 541767 - protein, 11 aa, Influenza virus
VKNLYNKVRMQ

SEQ ID NO: 541768 - protein, 11 aa, Influenza virus
VKQDGKSSACK

SEQ ID NO: 541769 - protein, 11 aa, Influenza virus
VKQESLLLATG

SEQ ID NO: 541770 - protein, 11 aa, Influenza virus
VKQESLMLATG

SEQ ID NO: 541771 - protein, 11 aa, Influenza virus
VKQGSLKLATG

SEQ ID NO: 541772 - protein, 11 aa, Influenza virus
VKQGSLMLATG

SEQ ID NO: 541773 - protein, 11 aa, Influenza virus
VKQGSLRLATG

SEQ ID NO: 541774 - protein, 11 aa, Influenza virus
VKQKSILLATG

SEQ ID NO: 541775 - protein, 11 aa, Influenza virus
VKQKSLLLATG

SEQ ID NO: 541776 - protein, 11 aa, Influenza virus
VKQKTLKLATG

SEQ ID NO: 541777 - protein, 11 aa, Influenza virus
VKQNGKSGACK

SEQ ID NO: 541778 - protein, 11 aa, Influenza virus
VKQNGKSSACK

SEQ ID NO: 541779 - protein, 11 aa, Influenza virus
VKQNTLKLATG

SEQ ID NO: 541780 - protein, 11 aa, Influenza virus
VKQSSLPLALG

SEQ ID NO: 541781 - protein, 11 aa, Influenza virus
VKQSTLKLATG

SEQ ID NO: 541782 - protein, 11 aa, Influenza virus
VKQTSLLLATG

SEQ ID NO: 541783 - protein, 11 aa, Influenza virus
VKRGINDRNFW

SEQ ID NO: 541784 - protein, 11 aa, Influenza virus
VKRLLRENAEE

SEQ ID NO: 541785 - protein, 11 aa, Influenza virus
VKRQLRENAED

SEQ ID NO: 541786 - protein, 11 aa, Influenza virus
VKRQLRENAEE

SEQ ID NO: 541787 - protein, 11 aa, Influenza virus
VKRRPVAKAGF

SEQ ID NO: 541788 - protein, 11 aa, Influenza virus
VKSDKICLGHH

SEQ ID NO: 541789 - protein, 11 aa, Influenza virus
VKSDRLVLAIG

SEQ ID NO: 541790 - protein, 11 aa, Influenza virus
VKSDRLVLATG

SEQ ID NO: 541791 - protein, 11 aa, Influenza virus
VKSEKLVLATG

SEQ ID NO: 541792 - protein, 11 aa, Influenza virus
VKSERLVLATG

SEQ ID NO: 541793 - protein, 11 aa, Influenza virus
VKSITQTLVSN

SEQ ID NO: 541794 - protein, 11 aa, Influenza virus
VKSLYDKVRMQ

SEQ ID NO: 541795 - protein, 11 aa, Influenza virus
VKSVTQTLVSN

SEQ ID NO: 541796 - protein, 11 aa, Influenza virus
VKTLTDNHVEV

SEQ ID NO: 541797 - protein, 11 aa, Influenza virus
VKTWAGNILRT

SEQ ID NO: 541798 - protein, 11 aa, Influenza virus
VKVDGSSSACL

SEQ ID NO: 541799 - protein, 11 aa, Influenza virus
VKYSRADKICI

SEQ ID NO: 541800 - protein, 11 aa, Influenza virus
VKYVWWTSNSL

SEQ ID NO: 541801 - protein, 11 aa, Influenza virus
VLAIGLRNVPQ

SEQ ID NO: 541802 - protein, 11 aa, Influenza virus
VLAIYSCIASS

SEQ ID NO: 541803 - protein, 11 aa, Influenza virus
VLASTTAKAME

SEQ ID NO: 541804 - protein, 11 aa, Influenza virus
VLATGLRNIPQ

SEQ ID NO: 541805 - protein, 11 aa, Influenza virus
VLATGLRNVPQ

SEQ ID NO: 541806 - protein, 11 aa, Influenza virus
VLATGPRNVPQ

SEQ ID NO: 541807 - protein, 11 aa, Influenza virus
VLDDCSLEGII

SEQ ID NO: 541808 - protein, 11 aa, Influenza virus
VLDDCSLEGLI

SEQ ID NO: 541809 - protein, 11 aa, Influenza virus
VLDDCSLEGLV

SEQ ID NO: 541810 - protein, 11 aa, Influenza virus
VLDDCSLKGLI

SEQ ID NO: 541811 - protein, 11 aa, Influenza virus
VLDGVTASCLD

SEQ ID NO: 541812 - protein, 11 aa, Influenza virus
VLDNKNWSGYS

SEQ ID NO: 541813 - protein, 11 aa, Influenza virus
VLEAMAFLEDS

SEQ ID NO: 541814 - protein, 11 aa, Influenza virus
VLEAMAFLEES

SEQ ID NO: 541815 - protein, 11 aa, Influenza virus
VLEAMAFLEKS

SEQ ID NO: 541816 - protein, 11 aa, Influenza virus
VLEAMAFLENS

SEQ ID NO: 541817 - protein, 11 aa, Influenza virus
VLEAMALLEES

SEQ ID NO: 541818 - protein, 11 aa, Influenza virus
VLEDEQMYQKC

SEQ ID NO: 541819 - protein, 11 aa, Influenza virus
VLEKNVTVTHS

SEQ ID NO: 541820 - protein, 11 aa, Influenza virus
VLELIRMIKRG

SEQ ID NO: 541821 - protein, 11 aa, Influenza virus
VLERNVTVTHS

SEQ ID NO: 541822 - protein, 11 aa, Influenza virus
VLFQGGHIEEC

SEQ ID NO: 541823 - protein, 11 aa, Influenza virus
VLGDCSIAGWL

SEQ ID NO: 541824 - protein, 11 aa, Influenza virus
VLGIINLLIGI

SEQ ID NO: 541825 - protein, 11 aa, Influenza virus
VLGLSMVKSDK

SEQ ID NO: 541826 - protein, 11 aa, Influenza virus
VLGLSMVRSDK

SEQ ID NO: 541827 - protein, 11 aa, Influenza virus
VLGNPKCDLYL

SEQ ID NO: 541828 - protein, 11 aa, Influenza virus
VLGVSILNLGQ

SEQ ID NO: 541829 - protein, 11 aa, Influenza virus
VLGVSVLNLGQ

SEQ ID NO: 541830 - protein, 11 aa, Influenza virus
VLHLTQGACWE

SEQ ID NO: 541831 - protein, 11 aa, Influenza virus
VLHLTQGTCWE

SEQ ID NO: 541832 - protein, 11 aa, Influenza virus
VLIAGGLILGM

SEQ ID NO: 541833 - protein, 11 aa, Influenza virus
VLIENDRTLDL

SEQ ID NO: 541834 - protein, 11 aa, Influenza virus
VLIENQKTLDE

SEQ ID NO: 541835 - protein, 11 aa, Influenza virus
VLIGQGDIVLV

SEQ ID NO: 541836 - protein, 11 aa, Influenza virus
VLIGQGDVVLV

SEQ ID NO: 541837 - protein, 11 aa, Influenza virus
VLINTYQWIIR

SEQ ID NO: 541838 - protein, 11 aa, Influenza virus
VLKPGQTVKIK

SEQ ID NO: 541839 - protein, 11 aa, Influenza virus
VLKPGQTVKIQ

SEQ ID NO: 541840 - protein, 11 aa, Influenza virus
VLKSDKRIGSC

SEQ ID NO: 541841 - protein, 11 aa, Influenza virus
VLKYKGIITGT

SEQ ID NO: 541842 - protein, 11 aa, Influenza virus
VLKYNDIITDT

SEQ ID NO: 541843 - protein, 11 aa, Influenza virus
VLKYNGIITDT

SEQ ID NO: 541844 - protein, 11 aa, Influenza virus
VLKYNGIITET

SEQ ID NO: 541845 - protein, 11 aa, Influenza virus
VLKYNGIITGT

SEQ ID NO: 541846 - protein, 11 aa, Influenza virus
VLKYNGVITDT

SEQ ID NO: 541847 - protein, 11 aa, Influenza virus
VLLENDKTLDL

SEQ ID NO: 541848 - protein, 11 aa, Influenza virus
VLLENDKTLDM

SEQ ID NO: 541849 - protein, 11 aa, Influenza virus
VLLENDKTLNM

SEQ ID NO: 541850 - protein, 11 aa, Influenza virus
VLLENDRTLDL

SEQ ID NO: 541851 - protein, 11 aa, Influenza virus
VLLENEKTLDL

SEQ ID NO: 541852 - protein, 11 aa, Influenza virus
VLLENERTLDF

SEQ ID NO: 541853 - protein, 11 aa, Influenza virus
VLLENERTLDL

SEQ ID NO: 541854 - protein, 11 aa, Influenza virus
VLLENERTLDY

SEQ ID NO: 541855 - protein, 11 aa, Influenza virus
VLLENGRTLDL

SEQ ID NO: 541856 - protein, 11 aa, Influenza virus
VLLENGRTLGL

SEQ ID NO: 541857 - protein, 11 aa, Influenza virus
VLLENQKILDE

SEQ ID NO: 541858 - protein, 11 aa, Influenza virus
VLLENQKPLDE

SEQ ID NO: 541859 - protein, 11 aa, Influenza virus
VLLENQKTLDD

SEQ ID NO: 541860 - protein, 11 aa, Influenza virus
VLLENQKTLDE

SEQ ID NO: 541861 - protein, 11 aa, Influenza virus
VLLENQKTLDK

SEQ ID NO: 541862 - protein, 11 aa, Influenza virus
VLLFMIIGGFI

SEQ ID NO: 541863 - protein, 11 aa, Influenza virus
VLLGNQKTLDE

SEQ ID NO: 541864 - protein, 11 aa, Influenza virus
VLLGSSPNAYQ

SEQ ID NO: 541865 - protein, 11 aa, Influenza virus
VLLGTKHSNGT

SEQ ID NO: 541866 - protein, 11 aa, Influenza virus
VLLKHRFEIIE

SEQ ID NO: 541867 - protein, 11 aa, Influenza virus
VLLLMIIGGFI

SEQ ID NO: 541868 - protein, 11 aa, Influenza virus
VLLNASWFNSF

SEQ ID NO: 541869 - protein, 11 aa, Influenza virus
VLLNDKHSNNT

SEQ ID NO: 541870 - protein, 11 aa, Influenza virus
VLLSPEEVSEA

SEQ ID NO: 541871 - protein, 11 aa, Influenza virus
VLLSPEEVSET

SEQ ID NO: 541872 - protein, 11 aa, Influenza virus
VLMENEITLDF

SEQ ID NO: 541873 - protein, 11 aa, Influenza virus
VLMENEMTLDF

SEQ ID NO: 541874 - protein, 11 aa, Influenza virus
VLMENERILDF

SEQ ID NO: 541875 - protein, 11 aa, Influenza virus
VLMENERTLDF

SEQ ID NO: 541876 - protein, 11 aa, Influenza virus
VLMENERTLDL

SEQ ID NO: 541877 - protein, 11 aa, Influenza virus
VLMENERTLDY

SEQ ID NO: 541878 - protein, 11 aa, Influenza virus
VLMENERTLGF

SEQ ID NO: 541879 - protein, 11 aa, Influenza virus
VLMENERTLYF

SEQ ID NO: 541880 - protein, 11 aa, Influenza virus
VLMETERTLDF

SEQ ID NO: 541881 - protein, 11 aa, Influenza virus
VLNLLIGISNI

SEQ ID NO: 541882 - protein, 11 aa, Influenza virus
VLNLLIGISNV

SEQ ID NO: 541883 - protein, 11 aa, Influenza virus
VLNLLIGVSNV

SEQ ID NO: 541884 - protein, 11 aa, Influenza virus
VLNNKNWSGYS

SEQ ID NO: 541885 - protein, 11 aa, Influenza virus
VLNNMNWSGYS

SEQ ID NO: 541886 - protein, 11 aa, Influenza virus
VLNNRNWSGYS

SEQ ID NO: 541887 - protein, 11 aa, Influenza virus
VLNTDWSGYSG

SEQ ID NO: 541888 - protein, 11 aa, Influenza virus
VLRGFLIIGKE

SEQ ID NO: 541889 - protein, 11 aa, Influenza virus
VLRGFLILGKE

SEQ ID NO: 541890 - protein, 11 aa, Influenza virus
VLRGFLILGRE

SEQ ID NO: 541891 - protein, 11 aa, Influenza virus
VLRTQESECAC

SEQ ID NO: 541892 - protein, 11 aa, Influenza virus
VLSAFDERRNK

SEQ ID NO: 541893 - protein, 11 aa, Influenza virus
VLSAFDERRNR

SEQ ID NO: 541894 - protein, 11 aa, Influenza virus
VLSCIFCLAFG

SEQ ID NO: 541895 - protein, 11 aa, Influenza virus
VLSIAPIMFSN

SEQ ID NO: 541896 - protein, 11 aa, Influenza virus
VLSIIPSGPLK

SEQ ID NO: 541897 - protein, 11 aa, Influenza virus
VLSIVPSGPLK

SEQ ID NO: 541898 - protein, 11 aa, Influenza virus
VLSIYSCIASS

SEQ ID NO: 541899 - protein, 11 aa, Influenza virus
VLSVAPIMFSN

SEQ ID NO: 541900 - protein, 11 aa, Influenza virus
VLSVIPSGPLK

SEQ ID NO: 541901 - protein, 11 aa, Influenza virus
VLTDNPRPNDP

SEQ ID NO: 541902 - protein, 11 aa, Influenza virus
VLTDTSKPSDK

SEQ ID NO: 541903 - protein, 11 aa, Influenza virus
VLTDTSRPGDK

SEQ ID NO: 541904 - protein, 11 aa, Influenza virus
VLTDTSRPKDK

SEQ ID NO: 541905 - protein, 11 aa, Influenza virus
VLTDTSRPSDK

SEQ ID NO: 541906 - protein, 11 aa, Influenza virus
VLTDTSRPSDR

SEQ ID NO: 541907 - protein, 11 aa, Influenza virus
VLVALENQHTI

SEQ ID NO: 541908 - protein, 11 aa, Influenza virus
VLVGLILAFIL

SEQ ID NO: 541909 - protein, 11 aa, Influenza virus
VLVGLILAFIM

SEQ ID NO: 541910 - protein, 11 aa, Influenza virus
VLVGLILSFIM

SEQ ID NO: 541911 - protein, 11 aa, Influenza virus
VLVGLILTFIM

SEQ ID NO: 541912 - protein, 11 aa, Influenza virus
VLVGPILSFIM

SEQ ID NO: 541913 - protein, 11 aa, Influenza virus
VLVLMENERTL

SEQ ID NO: 541914 - protein, 11 aa, Influenza virus
VLVLWGIHHPD

SEQ ID NO: 541915 - protein, 11 aa, Influenza virus
VLVMKRKRDSS

SEQ ID NO: 541916 - protein, 11 aa, Influenza virus
VLVMKRKRNSS

SEQ ID NO: 541917 - protein, 11 aa, Influenza virus
VLVNTYQWIIK

SEQ ID NO: 541918 - protein, 11 aa, Influenza virus
VLVNTYQWIIR

SEQ ID NO: 541919 - protein, 11 aa, Influenza virus
VLVNTYQWVIR

SEQ ID NO: 541920 - protein, 11 aa, Influenza virus
VLVTREPYISC

SEQ ID NO: 541921 - protein, 11 aa, Influenza virus
VLVTREPYLSC

SEQ ID NO: 541922 - protein, 11 aa, Influenza virus
VLVTREPYVSC

SEQ ID NO: 541923 - protein, 11 aa, Influenza virus
VLWACQNGNIR

SEQ ID NO: 541924 - protein, 11 aa, Influenza virus
VLWGIHHPDSE

SEQ ID NO: 541925 - protein, 11 aa, Influenza virus
VLWGIHHPDTE

SEQ ID NO: 541926 - protein, 11 aa, Influenza virus
VLWISFAISCF

SEQ ID NO: 541927 - protein, 11 aa, Influenza virus
VLWTSNSIVAL

SEQ ID NO: 541928 - protein, 11 aa, Influenza virus
VLWTSNSIVVF

SEQ ID NO: 541929 - protein, 11 aa, Influenza virus
VLWTSNSMVAL

SEQ ID NO: 541930 - protein, 11 aa, Influenza virus
VMEHTSQYLCT

SEQ ID NO: 541931 - protein, 11 aa, Influenza virus
VMELIRMIKRG

SEQ ID NO: 541932 - protein, 11 aa, Influenza virus
VMELIRMVKRG

SEQ ID NO: 541933 - protein, 11 aa, Influenza virus
VMELVRMIKRG

SEQ ID NO: 541934 - protein, 11 aa, Influenza virus
VMGARPQVNGQ

SEQ ID NO: 541935 - protein, 11 aa, Influenza virus
VMGLVFFCLKN

SEQ ID NO: 541936 - protein, 11 aa, Influenza virus
VMGLVFICIKN

SEQ ID NO: 541937 - protein, 11 aa, Influenza virus
VMGQASYKIFK

SEQ ID NO: 541938 - protein, 11 aa, Influenza virus
VMGQQGRMDYY

SEQ ID NO: 541939 - protein, 11 aa, Influenza virus
VMKRKRDSSIL

SEQ ID NO: 541940 - protein, 11 aa, Influenza virus
VMKRKRNSSIL

SEQ ID NO: 541941 - protein, 11 aa, Influenza virus
VMLLAIAMGLI

SEQ ID NO: 541942 - protein, 11 aa, Influenza virus
VMNTSKPFQNI

SEQ ID NO: 541943 - protein, 11 aa, Influenza virus
VMNTSKPFQNT

SEQ ID NO: 541944 - protein, 11 aa, Influenza virus
VMNTSKPLQNT

SEQ ID NO: 541945 - protein, 11 aa, Influenza virus
VMREPFISCSH

SEQ ID NO: 541946 - protein, 11 aa, Influenza virus
VMTDGNASGKA

SEQ ID NO: 541947 - protein, 11 aa, Influenza virus
VMTDGPANKQA

SEQ ID NO: 541948 - protein, 11 aa, Influenza virus
VMTDGPANNQA

SEQ ID NO: 541949 - protein, 11 aa, Influenza virus
VMTDGPANRQA

SEQ ID NO: 541950 - protein, 11 aa, Influenza virus
VMTDGPANSQA

SEQ ID NO: 541951 - protein, 11 aa, Influenza virus
VMTDGPASNQA

SEQ ID NO: 541952 - protein, 11 aa, Influenza virus
VMTDGSASGKA

SEQ ID NO: 541953 - protein, 11 aa, Influenza virus
VMTDGSASGQA

SEQ ID NO: 541954 - protein, 11 aa, Influenza virus
VMTDGSASGRA

SEQ ID NO: 541955 - protein, 11 aa, Influenza virus
VMTDGSASRKA

SEQ ID NO: 541956 - protein, 11 aa, Influenza virus
VMTDGSASSQA

SEQ ID NO: 541957 - protein, 11 aa, Influenza virus
VMTHTSQYICS

SEQ ID NO: 541958 - protein, 11 aa, Influenza virus
VMVGLILAFIM

SEQ ID NO: 541959 - protein, 11 aa, Influenza virus
VMVVYAELLVA

SEQ ID NO: 541960 - protein, 11 aa, Influenza virus
VNAALGSPGCD

SEQ ID NO: 541961 - protein, 11 aa, Influenza virus
VNATETVEITG

SEQ ID NO: 541962 - protein, 11 aa, Influenza virus
VNDRNFWRGEN

SEQ ID NO: 541963 - protein, 11 aa, Influenza virus
VNEEALRQKIM

SEQ ID NO: 541964 - protein, 11 aa, Influenza virus
VNEGALRQKIM

SEQ ID NO: 541965 - protein, 11 aa, Influenza virus
VNERTLDFHDS

SEQ ID NO: 541966 - protein, 11 aa, Influenza virus
VNESADMSIGI

SEQ ID NO: 541967 - protein, 11 aa, Influenza virus
VNESADMSIGV

SEQ ID NO: 541968 - protein, 11 aa, Influenza virus
VNFLSMEFSLT

SEQ ID NO: 541969 - protein, 11 aa, Influenza virus
VNFVSMEFSLT

SEQ ID NO: 541970 - protein, 11 aa, Influenza virus
VNGALGSPGCD

SEQ ID NO: 541971 - protein, 11 aa, Influenza virus
VNGKLNRLIEK

SEQ ID NO: 541972 - protein, 11 aa, Influenza virus
VNGPESVLVNT

SEQ ID NO: 541973 - protein, 11 aa, Influenza virus
VNGQAGRIDFH

SEQ ID NO: 541974 - protein, 11 aa, Influenza virus
VNGQAGRMTFY

SEQ ID NO: 541975 - protein, 11 aa, Influenza virus
VNGQFGRIDFH

SEQ ID NO: 541976 - protein, 11 aa, Influenza virus
VNGQFGRINFH

SEQ ID NO: 541977 - protein, 11 aa, Influenza virus
VNGQRGRIDFH

SEQ ID NO: 541978 - protein, 11 aa, Influenza virus
VNGQSGRIDFH

SEQ ID NO: 541979 - protein, 11 aa, Influenza virus
VNGQSGRIEFH

SEQ ID NO: 541980 - protein, 11 aa, Influenza virus
VNGQSGRINFH

SEQ ID NO: 541981 - protein, 11 aa, Influenza virus
VNGQSGRIVFH

SEQ ID NO: 541982 - protein, 11 aa, Influenza virus
VNGQTGRIDFH

SEQ ID NO: 541983 - protein, 11 aa, Influenza virus
VNGVKLEENST

SEQ ID NO: 541984 - protein, 11 aa, Influenza virus
VNGWYGFRHQN

SEQ ID NO: 541985 - protein, 11 aa, Influenza virus
VNIDRFLRVRD

SEQ ID NO: 541986 - protein, 11 aa, Influenza virus
VNITNVQNNYT

SEQ ID NO: 541987 - protein, 11 aa, Influenza virus
VNKNPYTLVST

SEQ ID NO: 541988 - protein, 11 aa, Influenza virus
VNLGLNIGLHL

SEQ ID NO: 541989 - protein, 11 aa, Influenza virus
VNNGKGRYGVK

SEQ ID NO: 541990 - protein, 11 aa, Influenza virus
VNNIVDKMNRE

SEQ ID NO: 541991 - protein, 11 aa, Influenza virus
VNNNNWSGYSG

SEQ ID NO: 541992 - protein, 11 aa, Influenza virus
VNNPNWSGYSG

SEQ ID NO: 541993 - protein, 11 aa, Influenza virus
VNNQDWSGYSG

SEQ ID NO: 541994 - protein, 11 aa, Influenza virus
VNNQNWSGYSG

SEQ ID NO: 541995 - protein, 11 aa, Influenza virus
VNPGDSIIFNS

SEQ ID NO: 541996 - protein, 11 aa, Influenza virus
VNQITGKLNRL

SEQ ID NO: 541997 - protein, 11 aa, Influenza virus
VNRANQRLNPM

SEQ ID NO: 541998 - protein, 11 aa, Influenza virus
VNRANQRLNTM

SEQ ID NO: 541999 - protein, 11 aa, Influenza virus
VNRCFYVELIR

SEQ ID NO: 542000 - protein, 11 aa, Influenza virus
VNRTHQYSEKG

SEQ ID NO: 542001 - protein, 11 aa, Influenza virus
VNRTHQYSERG

SEQ ID NO: 542002 - protein, 11 aa, Influenza virus
VNSALGSPGCD

SEQ ID NO: 542003 - protein, 11 aa, Influenza virus
VNSFSRTELIN

SEQ ID NO: 542004 - protein, 11 aa, Influenza virus
VNSFSRTELIP

SEQ ID NO: 542005 - protein, 11 aa, Influenza virus
VNSFSRTELIS

SEQ ID NO: 542006 - protein, 11 aa, Influenza virus
VNSIIDKMNTQ

SEQ ID NO: 542007 - protein, 11 aa, Influenza virus
VNSIIGKMNTQ

SEQ ID NO: 542008 - protein, 11 aa, Influenza virus
VNSIINKMNTQ

SEQ ID NO: 542009 - protein, 11 aa, Influenza virus
VNSSKPFQNAS

SEQ ID NO: 542010 - protein, 11 aa, Influenza virus
VNSSMPFHNIH

SEQ ID NO: 542011 - protein, 11 aa, Influenza virus
VNSWHIFSKDN

SEQ ID NO: 542012 - protein, 11 aa, Influenza virus
VNSWHILSKDN

SEQ ID NO: 542013 - protein, 11 aa, Influenza virus
VNTALLNASCA

SEQ ID NO: 542014 - protein, 11 aa, Influenza virus
VNTIIENNVTV

SEQ ID NO: 542015 - protein, 11 aa, Influenza virus
VNTILEKNVTV

SEQ ID NO: 542016 - protein, 11 aa, Influenza virus
VNTILSTKALL

SEQ ID NO: 542017 - protein, 11 aa, Influenza virus
VNTLIEQNIPV

SEQ ID NO: 542018 - protein, 11 aa, Influenza virus
VNTLIEQNVPV

SEQ ID NO: 542019 - protein, 11 aa, Influenza virus
VNTLLENDVPV

SEQ ID NO: 542020 - protein, 11 aa, Influenza virus
VNTLSEQNVPV

SEQ ID NO: 542021 - protein, 11 aa, Influenza virus
VNTLTEKGIEV

SEQ ID NO: 542022 - protein, 11 aa, Influenza virus
VNTLTEKGVEV

SEQ ID NO: 542023 - protein, 11 aa, Influenza virus
VNTLTEQNVPV

SEQ ID NO: 542024 - protein, 11 aa, Influenza virus
VNTLTEREVEV

SEQ ID NO: 542025 - protein, 11 aa, Influenza virus
VNTLTERGIEV

SEQ ID NO: 542026 - protein, 11 aa, Influenza virus
VNTLTERGVEV

SEQ ID NO: 542027 - protein, 11 aa, Influenza virus
VNTLTGRGIEV

SEQ ID NO: 542028 - protein, 11 aa, Influenza virus
VNTNKTFQNIE

SEQ ID NO: 542029 - protein, 11 aa, Influenza virus
VNTNTINRSFQ

SEQ ID NO: 542030 - protein, 11 aa, Influenza virus
VNTTLSTIALF

SEQ ID NO: 542031 - protein, 11 aa, Influenza virus
VNTTLSTIALI

SEQ ID NO: 542032 - protein, 11 aa, Influenza virus
VNTTLSTIALL

SEQ ID NO: 542033 - protein, 11 aa, Influenza virus
VNTVLSIIALL

SEQ ID NO: 542034 - protein, 11 aa, Influenza virus
VNTYQWIIKNW

SEQ ID NO: 542035 - protein, 11 aa, Influenza virus
VNTYQWIIRNW

SEQ ID NO: 542036 - protein, 11 aa, Influenza virus
VNTYQWVIRNW

SEQ ID NO: 542037 - protein, 11 aa, Influenza virus
VNVRGSGLRIL

SEQ ID NO: 542038 - protein, 11 aa, Influenza virus
VNVRGSGMRIL

SEQ ID NO: 542039 - protein, 11 aa, Influenza virus
VNVRGSGMRVL

SEQ ID NO: 542040 - protein, 11 aa, Influenza virus
VNVRGTGMRIL

SEQ ID NO: 542041 - protein, 11 aa, Influenza virus
VNVTHVQNNYT

SEQ ID NO: 542042 - protein, 11 aa, Influenza virus
VNVTNVQNDYT

SEQ ID NO: 542043 - protein, 11 aa, Influenza virus
VNVTNVQNNYT

SEQ ID NO: 542044 - protein, 11 aa, Influenza virus
VNYVSMEFSLT

SEQ ID NO: 542045 - protein, 11 aa, Influenza virus
VPASRYLIDMT

SEQ ID NO: 542046 - protein, 11 aa, Influenza virus
VPASRYLTDMT

SEQ ID NO: 542047 - protein, 11 aa, Influenza virus
VPCFWLEMIRG

SEQ ID NO: 542048 - protein, 11 aa, Influenza virus
VPCFWVEMIRG

SEQ ID NO: 542049 - protein, 11 aa, Influenza virus
VPDYQSIRSIL

SEQ ID NO: 542050 - protein, 11 aa, Influenza virus
VPDYQSLRSIL

SEQ ID NO: 542051 - protein, 11 aa, Influenza virus
VPEKIHTRGLF

SEQ ID NO: 542052 - protein, 11 aa, Influenza virus
VPEKIRTRGLF

SEQ ID NO: 542053 - protein, 11 aa, Influenza virus
VPEKIRVKRRP

SEQ ID NO: 542054 - protein, 11 aa, Influenza virus
VPEWSWDDGAI

SEQ ID NO: 542055 - protein, 11 aa, Influenza virus
VPEWSYIIEKE

SEQ ID NO: 542056 - protein, 11 aa, Influenza virus
VPEWSYIMEKE

SEQ ID NO: 542057 - protein, 11 aa, Influenza virus
VPEWSYIMEKK

SEQ ID NO: 542058 - protein, 11 aa, Influenza virus
VPEWSYIMERE

SEQ ID NO: 542059 - protein, 11 aa, Influenza virus
VPEWSYIVEKE

SEQ ID NO: 542060 - protein, 11 aa, Influenza virus
VPEWSYIVERE

SEQ ID NO: 542061 - protein, 11 aa, Influenza virus
VPEYGFKISKR

SEQ ID NO: 542062 - protein, 11 aa, Influenza virus
VPEYQSLRSIL

SEQ ID NO: 542063 - protein, 11 aa, Influenza virus
VPFHLATKQVC

SEQ ID NO: 542064 - protein, 11 aa, Influenza virus
VPFHLGTKQVC

SEQ ID NO: 542065 - protein, 11 aa, Influenza virus
VPFHLGTRQVC

SEQ ID NO: 542066 - protein, 11 aa, Influenza virus
VPFYLGTKQVC

SEQ ID NO: 542067 - protein, 11 aa, Influenza virus
VPGVKGFGFLN

SEQ ID NO: 542068 - protein, 11 aa, Influenza virus
VPGWSWDDGAI

SEQ ID NO: 542069 - protein, 11 aa, Influenza virus
VPGYQSLRSIL

SEQ ID NO: 542070 - protein, 11 aa, Influenza virus
VPILNTSQRGI

SEQ ID NO: 542071 - protein, 11 aa, Influenza virus
VPKRNRSILNT

SEQ ID NO: 542072 - protein, 11 aa, Influenza virus
VPLGSSPNAYQ

SEQ ID NO: 542073 - protein, 11 aa, Influenza virus
VPLVPCEPIII

SEQ ID NO: 542074 - protein, 11 aa, Influenza virus
VPMGSSPNAYQ

SEQ ID NO: 542075 - protein, 11 aa, Influenza virus
VPNALIDDRSK

SEQ ID NO: 542076 - protein, 11 aa, Influenza virus
VPNALTDDKSK

SEQ ID NO: 542077 - protein, 11 aa, Influenza virus
VPNALTDDRSK

SEQ ID NO: 542078 - protein, 11 aa, Influenza virus
VPNALTDNRSK

SEQ ID NO: 542079 - protein, 11 aa, Influenza virus
VPNALTNDRSK

SEQ ID NO: 542080 - protein, 11 aa, Influenza virus
VPNGTIVKTIT

SEQ ID NO: 542081 - protein, 11 aa, Influenza virus
VPNGTIVRTIT

SEQ ID NO: 542082 - protein, 11 aa, Influenza virus
VPNGTKVNTLT

SEQ ID NO: 542083 - protein, 11 aa, Influenza virus
VPNGTLVKTIT

SEQ ID NO: 542084 - protein, 11 aa, Influenza virus
VPNGTMVKTIT

SEQ ID NO: 542085 - protein, 11 aa, Influenza virus
VPNGTVVKTIT

SEQ ID NO: 542086 - protein, 11 aa, Influenza virus
VPNIGSRPRVR

SEQ ID NO: 542087 - protein, 11 aa, Influenza virus
VPNYQSLRSIL

SEQ ID NO: 542088 - protein, 11 aa, Influenza virus
VPPLELGDCSI

SEQ ID NO: 542089 - protein, 11 aa, Influenza virus
VPQAQDRGLFG

SEQ ID NO: 542090 - protein, 11 aa, Influenza virus
VPQAQNRGLFG

SEQ ID NO: 542091 - protein, 11 aa, Influenza virus
VPQIEARGLFG

SEQ ID NO: 542092 - protein, 11 aa, Influenza virus
VPQIEPRGLFG

SEQ ID NO: 542093 - protein, 11 aa, Influenza virus
VPQIESRGLFG

SEQ ID NO: 542094 - protein, 11 aa, Influenza virus
VPQIQNRGLFG

SEQ ID NO: 542095 - protein, 11 aa, Influenza virus
VPQMESRGLFG

SEQ ID NO: 542096 - protein, 11 aa, Influenza virus
VPQVQDRGLFG

SEQ ID NO: 542097 - protein, 11 aa, Influenza virus
VPQVQNRGLFG

SEQ ID NO: 542098 - protein, 11 aa, Influenza virus
VPSERGLQRRR

SEQ ID NO: 542099 - protein, 11 aa, Influenza virus
VPSGPLKAEIA

SEQ ID NO: 542100 - protein, 11 aa, Influenza virus
VPSIQSRGLFG

SEQ ID NO: 542101 - protein, 11 aa, Influenza virus
VPSPYNSRFES

SEQ ID NO: 542102 - protein, 11 aa, Influenza virus
VPSVQSRGLFG

SEQ ID NO: 542103 - protein, 11 aa, Influenza virus
VPVGSGSFPDG

SEQ ID NO: 542104 - protein, 11 aa, Influenza virus
VPVIGARPQVN

SEQ ID NO: 542105 - protein, 11 aa, Influenza virus
VPVMGARPQVN

SEQ ID NO: 542106 - protein, 11 aa, Influenza virus
VPVTQAMELVE

SEQ ID NO: 542107 - protein, 11 aa, Influenza virus
VPVTQTMELVE

SEQ ID NO: 542108 - protein, 11 aa, Influenza virus
VPVTQVEELVH

SEQ ID NO: 542109 - protein, 11 aa, Influenza virus
VPVTSSIDLIE

SEQ ID NO: 542110 - protein, 11 aa, Influenza virus
VPVTSSIDLVE

SEQ ID NO: 542111 - protein, 11 aa, Influenza virus
VPVTSSVDLIE

SEQ ID NO: 542112 - protein, 11 aa, Influenza virus
VPVTSSVDLVE

SEQ ID NO: 542113 - protein, 11 aa, Influenza virus
VPVTSTIDLIE

SEQ ID NO: 542114 - protein, 11 aa, Influenza virus
VPVVGARPKVN

SEQ ID NO: 542115 - protein, 11 aa, Influenza virus
VPVVGARPQVN

SEQ ID NO: 542116 - protein, 11 aa, Influenza virus
VPVVRARPQVN

SEQ ID NO: 542117 - protein, 11 aa, Influenza virus
VQAGVDRFYRT

SEQ ID NO: 542118 - protein, 11 aa, Influenza virus
VQDIIDNDNWS

SEQ ID NO: 542119 - protein, 11 aa, Influenza virus
VQDIIDNNNWS

SEQ ID NO: 542120 - protein, 11 aa, Influenza virus
VQGFFPFHKDN

SEQ ID NO: 542121 - protein, 11 aa, Influenza virus
VQGNNDNATAT

SEQ ID NO: 542122 - protein, 11 aa, Influenza virus
VQGNNKNATAT

SEQ ID NO: 542123 - protein, 11 aa, Influenza virus
VQGNNNNATAT

SEQ ID NO: 542124 - protein, 11 aa, Influenza virus
VQHLEECSCYV

SEQ ID NO: 542125 - protein, 11 aa, Influenza virus
VQHPELTGLDC

SEQ ID NO: 542126 - protein, 11 aa, Influenza virus
VQHPELTGLNC

SEQ ID NO: 542127 - protein, 11 aa, Influenza virus
VQHPELTGMDC

SEQ ID NO: 542128 - protein, 11 aa, Influenza virus
VQHPELTGMNC

SEQ ID NO: 542129 - protein, 11 aa, Influenza virus
VQHPELTGVDC

SEQ ID NO: 542130 - protein, 11 aa, Influenza virus
VQHPEMTGLDC

SEQ ID NO: 542131 - protein, 11 aa, Influenza virus
VQITGKLNRLI

SEQ ID NO: 542132 - protein, 11 aa, Influenza virus
VQMQRFRRPDS

SEQ ID NO: 542133 - protein, 11 aa, Influenza virus
VQNAISTTFPY

SEQ ID NO: 542134 - protein, 11 aa, Influenza virus
VQNALNGNGDP

SEQ ID NO: 542135 - protein, 11 aa, Influenza virus
VQNALSGNGDP

SEQ ID NO: 542136 - protein, 11 aa, Influenza virus
VQNEFNKACEL

SEQ ID NO: 542137 - protein, 11 aa, Influenza virus
VQPAFSVQRNL

SEQ ID NO: 542138 - protein, 11 aa, Influenza virus
VQPGDNITFLH

SEQ ID NO: 542139 - protein, 11 aa, Influenza virus
VQPGDNITFSD

SEQ ID NO: 542140 - protein, 11 aa, Influenza virus
VQPGDNITFSH

SEQ ID NO: 542141 - protein, 11 aa, Influenza virus
VQPTFSVQRNL

SEQ ID NO: 542142 - protein, 11 aa, Influenza virus
VQPTFSVQRSL

SEQ ID NO: 542143 - protein, 11 aa, Influenza virus
VQQTRMDKLTQ

SEQ ID NO: 542144 - protein, 11 aa, Influenza virus
VQQTRVDKLTQ

SEQ ID NO: 542145 - protein, 11 aa, Influenza virus
VQQTRVDRLTQ

SEQ ID NO: 542146 - protein, 11 aa, Influenza virus
VQSEFNKACEL

SEQ ID NO: 542147 - protein, 11 aa, Influenza virus
VQSRGLFGAIA

SEQ ID NO: 542148 - protein, 11 aa, Influenza virus
VQSYFQLFLVC

SEQ ID NO: 542149 - protein, 11 aa, Influenza virus
VQTDEYKNTGD

SEQ ID NO: 542150 - protein, 11 aa, Influenza virus
VQTDEYKNTRD

SEQ ID NO: 542151 - protein, 11 aa, Influenza virus
VRCICRDNWKG

SEQ ID NO: 542152 - protein, 11 aa, Influenza virus
VRCICRDNWRG

SEQ ID NO: 542153 - protein, 11 aa, Influenza virus
VRCTCRDNWKG

SEQ ID NO: 542154 - protein, 11 aa, Influenza virus
VRCVCRDNWKG

SEQ ID NO: 542155 - protein, 11 aa, Influenza virus
VRCVCRDNWMG

SEQ ID NO: 542156 - protein, 11 aa, Influenza virus
VRCVCRDNWRG

SEQ ID NO: 542157 - protein, 11 aa, Influenza virus
VREGRNPGNAE

SEQ ID NO: 542158 - protein, 11 aa, Influenza virus
VREKNVTVTHS

SEQ ID NO: 542159 - protein, 11 aa, Influenza virus
VREQQGRMDYY

SEQ ID NO: 542160 - protein, 11 aa, Influenza virus
VRESRNPGNAE

SEQ ID NO: 542161 - protein, 11 aa, Influenza virus
VREWSYLIEDP

SEQ ID NO: 542162 - protein, 11 aa, Influenza virus
VRFGESEQIIV

SEQ ID NO: 542163 - protein, 11 aa, Influenza virus
VRFNSDLDYQI

SEQ ID NO: 542164 - protein, 11 aa, Influenza virus
VRGDLNFVNRA

SEQ ID NO: 542165 - protein, 11 aa, Influenza virus
VRGDQICIGYH

SEQ ID NO: 542166 - protein, 11 aa, Influenza virus
VRGDQICVGYH

SEQ ID NO: 542167 - protein, 11 aa, Influenza virus
VRGDYNNTTGR

SEQ ID NO: 542168 - protein, 11 aa, Influenza virus
VRGLSSRISFY

SEQ ID NO: 542169 - protein, 11 aa, Influenza virus
VRGNSPAFNYN

SEQ ID NO: 542170 - protein, 11 aa, Influenza virus
VRGNSPVFNYN

SEQ ID NO: 542171 - protein, 11 aa, Influenza virus
VRGNSPVFNYS

SEQ ID NO: 542172 - protein, 11 aa, Influenza virus
VRGQQGRMDYY

SEQ ID NO: 542173 - protein, 11 aa, Influenza virus
VRGQQGTMDYY

SEQ ID NO: 542174 - protein, 11 aa, Influenza virus
VRGQQGWMDYY

SEQ ID NO: 542175 - protein, 11 aa, Influenza virus
VRGQSGRISFY

SEQ ID NO: 542176 - protein, 11 aa, Influenza virus
VRGQSGRVSFY

SEQ ID NO: 542177 - protein, 11 aa, Influenza virus
VRGQSSRISFY

SEQ ID NO: 542178 - protein, 11 aa, Influenza virus
VRHQLRDNAKE

SEQ ID NO: 542179 - protein, 11 aa, Influenza virus
VRHQLRENAED

SEQ ID NO: 542180 - protein, 11 aa, Influenza virus
VRHRLKITENS

SEQ ID NO: 542181 - protein, 11 aa, Influenza virus
VRIGSKGDVFV

SEQ ID NO: 542182 - protein, 11 aa, Influenza virus
VRINNETILET

SEQ ID NO: 542183 - protein, 11 aa, Influenza virus
VRKMMTNSHDT

SEQ ID NO: 542184 - protein, 11 aa, Influenza virus
VRKMMTNSQDT

SEQ ID NO: 542185 - protein, 11 aa, Influenza virus
VRKMMTNSRDT

SEQ ID NO: 542186 - protein, 11 aa, Influenza virus
VRKMMTSSQDT

SEQ ID NO: 542187 - protein, 11 aa, Influenza virus
VRKQLRENAEE

SEQ ID NO: 542188 - protein, 11 aa, Influenza virus
VRKQLRQNAEE

SEQ ID NO: 542189 - protein, 11 aa, Influenza virus
VRKRFADQELG

SEQ ID NO: 542190 - protein, 11 aa, Influenza virus
VRKTRFLPVAG

SEQ ID NO: 542191 - protein, 11 aa, Influenza virus
VRKTRFLPVSG

SEQ ID NO: 542192 - protein, 11 aa, Influenza virus
VRKTRFLPVTG

SEQ ID NO: 542193 - protein, 11 aa, Influenza virus
VRKTRFLPVVG

SEQ ID NO: 542194 - protein, 11 aa, Influenza virus
VRLEENTTYKI

SEQ ID NO: 542195 - protein, 11 aa, Influenza virus
VRLFDYSRWNV

SEQ ID NO: 542196 - protein, 11 aa, Influenza virus
VRLQLKDNAKE

SEQ ID NO: 542197 - protein, 11 aa, Influenza virus
VRLQLKDNARE

SEQ ID NO: 542198 - protein, 11 aa, Influenza virus
VRLQLRDNAKE

SEQ ID NO: 542199 - protein, 11 aa, Influenza virus
VRLQLRDNARE

SEQ ID NO: 542200 - protein, 11 aa, Influenza virus
VRLYLWGVHHP

SEQ ID NO: 542201 - protein, 11 aa, Influenza virus
VRMIKRGINDR

SEQ ID NO: 542202 - protein, 11 aa, Influenza virus
VRMQLKDNAKE

SEQ ID NO: 542203 - protein, 11 aa, Influenza virus
VRMQLRDNAKE

SEQ ID NO: 542204 - protein, 11 aa, Influenza virus
VRMQLRDNVKE

SEQ ID NO: 542205 - protein, 11 aa, Influenza virus
VRNGTYDHKEF

SEQ ID NO: 542206 - protein, 11 aa, Influenza virus
VRNGTYDYPKY

SEQ ID NO: 542207 - protein, 11 aa, Influenza virus
VRNLYDKVRLQ

SEQ ID NO: 542208 - protein, 11 aa, Influenza virus
VRNLYDKVRMQ

SEQ ID NO: 542209 - protein, 11 aa, Influenza virus
VRNQSGRISIY

SEQ ID NO: 542210 - protein, 11 aa, Influenza virus
VRPGDNITFSH

SEQ ID NO: 542211 - protein, 11 aa, Influenza virus
VRPGYNGQKSW

SEQ ID NO: 542212 - protein, 11 aa, Influenza virus
VRPGYNGQRSW

SEQ ID NO: 542213 - protein, 11 aa, Influenza virus
VRPRYNGQRSW

SEQ ID NO: 542214 - protein, 11 aa, Influenza virus
VRQNTLKLATG

SEQ ID NO: 542215 - protein, 11 aa, Influenza virus
VRRAAVSADPL

SEQ ID NO: 542216 - protein, 11 aa, Influenza virus
VRRAIVSADPL

SEQ ID NO: 542217 - protein, 11 aa, Influenza virus
VRRATVSADPL

SEQ ID NO: 542218 - protein, 11 aa, Influenza virus
VRRDQMAHCRM

SEQ ID NO: 542219 - protein, 11 aa, Influenza virus
VRRQLRENAED

SEQ ID NO: 542220 - protein, 11 aa, Influenza virus
VRRQLRENAEE

SEQ ID NO: 542221 - protein, 11 aa, Influenza virus
VRSDKICLGHH

SEQ ID NO: 542222 - protein, 11 aa, Influenza virus
VRSEKLVLATG

SEQ ID NO: 542223 - protein, 11 aa, Influenza virus
VRSGMDPRMCS

SEQ ID NO: 542224 - protein, 11 aa, Influenza virus
VRSQSGRISFY

SEQ ID NO: 542225 - protein, 11 aa, Influenza virus
VRSWKKQILRT

SEQ ID NO: 542226 - protein, 11 aa, Influenza virus
VRSWRKKILRT

SEQ ID NO: 542227 - protein, 11 aa, Influenza virus
VRSWRKQILRT

SEQ ID NO: 542228 - protein, 11 aa, Influenza virus
VRSWRRQILRT

SEQ ID NO: 542229 - protein, 11 aa, Influenza virus
VRTGMDPRMCS

SEQ ID NO: 542230 - protein, 11 aa, Influenza virus
VRTLFQQMRDI

SEQ ID NO: 542231 - protein, 11 aa, Influenza virus
VRTLFQQMRDV

SEQ ID NO: 542232 - protein, 11 aa, Influenza virus
VRTNGTSKIKM

SEQ ID NO: 542233 - protein, 11 aa, Influenza virus
VRTNGTSKVKM

SEQ ID NO: 542234 - protein, 11 aa, Influenza virus
VSADPLASLLE

SEQ ID NO: 542235 - protein, 11 aa, Influenza virus
VSADPLLSLLE

SEQ ID NO: 542236 - protein, 11 aa, Influenza virus
VSADPLVSLLE

SEQ ID NO: 542237 - protein, 11 aa, Influenza virus
VSAGGDIWVTR

SEQ ID NO: 542238 - protein, 11 aa, Influenza virus
VSAKELVETNH

SEQ ID NO: 542239 - protein, 11 aa, Influenza virus
VSCDPDECRFY

SEQ ID NO: 542240 - protein, 11 aa, Influenza virus
VSCDPDGCRFY

SEQ ID NO: 542241 - protein, 11 aa, Influenza virus
VSCDPLGCKMY

SEQ ID NO: 542242 - protein, 11 aa, Influenza virus
VSCDPLGCKTY

SEQ ID NO: 542243 - protein, 11 aa, Influenza virus
VSCDPLGCRMY

SEQ ID NO: 542244 - protein, 11 aa, Influenza virus
VSCDPNECRFY

SEQ ID NO: 542245 - protein, 11 aa, Influenza virus
VSCDPSGCKMY

SEQ ID NO: 542246 - protein, 11 aa, Influenza virus
VSCDPTGCKMY

SEQ ID NO: 542247 - protein, 11 aa, Influenza virus
VSCEPDECRFY

SEQ ID NO: 542248 - protein, 11 aa, Influenza virus
VSCGPSECRTF

SEQ ID NO: 542249 - protein, 11 aa, Influenza virus
VSCSHLECRTF

SEQ ID NO: 542250 - protein, 11 aa, Influenza virus
VSCSIHECRTF

SEQ ID NO: 542251 - protein, 11 aa, Influenza virus
VSCVCRDNWQG

SEQ ID NO: 542252 - protein, 11 aa, Influenza virus
VSDGGPNLYNI

SEQ ID NO: 542253 - protein, 11 aa, Influenza virus
VSECRTFFLTQ

SEQ ID NO: 542254 - protein, 11 aa, Influenza virus
VSFESNGGLLA

SEQ ID NO: 542255 - protein, 11 aa, Influenza virus
VSFHLGTKQVC

SEQ ID NO: 542256 - protein, 11 aa, Influenza virus
VSFQGGHIEEC

SEQ ID NO: 542257 - protein, 11 aa, Influenza virus
VSFQGRGVFEF

SEQ ID NO: 542258 - protein, 11 aa, Influenza virus
VSFQGRGVFEL

SEQ ID NO: 542259 - protein, 11 aa, Influenza virus
VSFRGRGVFEL

SEQ ID NO: 542260 - protein, 11 aa, Influenza virus
VSFSISCFLLV

SEQ ID NO: 542261 - protein, 11 aa, Influenza virus
VSFWMCSNGSL

SEQ ID NO: 542262 - protein, 11 aa, Influenza virus
VSFYWTIVEPG

SEQ ID NO: 542263 - protein, 11 aa, Influenza virus
VSGADDDAYAV

SEQ ID NO: 542264 - protein, 11 aa, Influenza virus
VSGADNDAYAV

SEQ ID NO: 542265 - protein, 11 aa, Influenza virus
VSGEVPGWSWD

SEQ ID NO: 542266 - protein, 11 aa, Influenza virus
VSGINESADMS

SEQ ID NO: 542267 - protein, 11 aa, Influenza virus
VSGPDNGAVAV

SEQ ID NO: 542268 - protein, 11 aa, Influenza virus
VSGPNNNASAV

SEQ ID NO: 542269 - protein, 11 aa, Influenza virus
VSGTDDDAYAV

SEQ ID NO: 542270 - protein, 11 aa, Influenza virus
VSGVNESADMS

SEQ ID NO: 542271 - protein, 11 aa, Influenza virus
VSGWLLGNPMC

SEQ ID NO: 542272 - protein, 11 aa, Influenza virus
VSHCRATEYII

SEQ ID NO: 542273 - protein, 11 aa, Influenza virus
VSHCRATEYIM

SEQ ID NO: 542274 - protein, 11 aa, Influenza virus
VSHCRATEYMM

SEQ ID NO: 542275 - protein, 11 aa, Influenza virus
VSIDRFLRVKD

SEQ ID NO: 542276 - protein, 11 aa, Influenza virus
VSIDRFLRVRD

SEQ ID NO: 542277 - protein, 11 aa, Influenza virus
VSIGTSTLNQR

SEQ ID NO: 542278 - protein, 11 aa, Influenza virus
VSKDNGIRIGS

SEQ ID NO: 542279 - protein, 11 aa, Influenza virus
VSKDNGIRVGS

SEQ ID NO: 542280 - protein, 11 aa, Influenza virus
VSLGAISFWMC

SEQ ID NO: 542281 - protein, 11 aa, Influenza virus
VSLGAVSFWMC

SEQ ID NO: 542282 - protein, 11 aa, Influenza virus
VSLLEMCHSTQ

SEQ ID NO: 542283 - protein, 11 aa, Influenza virus
VSLLQSAILSL

SEQ ID NO: 542284 - protein, 11 aa, Influenza virus
VSLSPGMMMGM

SEQ ID NO: 542285 - protein, 11 aa, Influenza virus
VSMCSSTEFLG

SEQ ID NO: 542286 - protein, 11 aa, Influenza virus
VSMEFSLTDPK

SEQ ID NO: 542287 - protein, 11 aa, Influenza virus
VSMEFSLTDPR

SEQ ID NO: 542288 - protein, 11 aa, Influenza virus
VSNDNWSGYSG

SEQ ID NO: 542289 - protein, 11 aa, Influenza virus
VSNGTKINTLT

SEQ ID NO: 542290 - protein, 11 aa, Influenza virus
VSNGTKVNTLT

SEQ ID NO: 542291 - protein, 11 aa, Influenza virus
VSNNDWSGYSG

SEQ ID NO: 542292 - protein, 11 aa, Influenza virus
VSNSDFICVGW

SEQ ID NO: 542293 - protein, 11 aa, Influenza virus
VSNSDFLCVGW

SEQ ID NO: 542294 - protein, 11 aa, Influenza virus
VSNSDFMCVGW

SEQ ID NO: 542295 - protein, 11 aa, Influenza virus
VSNSDWSGYSG

SEQ ID NO: 542296 - protein, 11 aa, Influenza virus
VSNSEFLCVGW

SEQ ID NO: 542297 - protein, 11 aa, Influenza virus
VSNTDWSGYSG

SEQ ID NO: 542298 - protein, 11 aa, Influenza virus
VSPIHLGDCSF

SEQ ID NO: 542299 - protein, 11 aa, Influenza virus
VSPLAITWWNR

SEQ ID NO: 542300 - protein, 11 aa, Influenza virus
VSPLAVTWWNR

SEQ ID NO: 542301 - protein, 11 aa, Influenza virus
VSPLSGSAQHI

SEQ ID NO: 542302 - protein, 11 aa, Influenza virus
VSPVHLGDCNF

SEQ ID NO: 542303 - protein, 11 aa, Influenza virus
VSPVHLGDCRF

SEQ ID NO: 542304 - protein, 11 aa, Influenza virus
VSPVHLGDCSF

SEQ ID NO: 542305 - protein, 11 aa, Influenza virus
VSRARIDARID

SEQ ID NO: 542306 - protein, 11 aa, Influenza virus
VSRARIDARTD

SEQ ID NO: 542307 - protein, 11 aa, Influenza virus
VSRARIDARVD

SEQ ID NO: 542308 - protein, 11 aa, Influenza virus
VSRIAIGNCPK

SEQ ID NO: 542309 - protein, 11 aa, Influenza virus
VSRTHQYSEKG

SEQ ID NO: 542310 - protein, 11 aa, Influenza virus
VSSEAPGWSWD

SEQ ID NO: 542311 - protein, 11 aa, Influenza virus
VSSEVPEWSWD

SEQ ID NO: 542312 - protein, 11 aa, Influenza virus
VSSEVPGWSWD

SEQ ID NO: 542313 - protein, 11 aa, Influenza virus
VSSEVPGWSWG

SEQ ID NO: 542314 - protein, 11 aa, Influenza virus
VSSFEKFEIFP

SEQ ID NO: 542315 - protein, 11 aa, Influenza virus
VSSFERFEIFP

SEQ ID NO: 542316 - protein, 11 aa, Influenza virus
VSSFERFEMFP

SEQ ID NO: 542317 - protein, 11 aa, Influenza virus
VSSFKRFEIFP

SEQ ID NO: 542318 - protein, 11 aa, Influenza virus
VSSFYSEMKWL

SEQ ID NO: 542319 - protein, 11 aa, Influenza virus
VSSGLVLVGLI

SEQ ID NO: 542320 - protein, 11 aa, Influenza virus
VSSSGTSKACN

SEQ ID NO: 542321 - protein, 11 aa, Influenza virus
VSSSLVLAGLI

SEQ ID NO: 542322 - protein, 11 aa, Influenza virus
VSSSLVLVGLI

SEQ ID NO: 542323 - protein, 11 aa, Influenza virus
VSSSLVLVGLV

SEQ ID NO: 542324 - protein, 11 aa, Influenza virus
VSSWHILSKDN

SEQ ID NO: 542325 - protein, 11 aa, Influenza virus
VSTDKDSNGVQ

SEQ ID NO: 542326 - protein, 11 aa, Influenza virus
VSTDKNSNGVQ

SEQ ID NO: 542327 - protein, 11 aa, Influenza virus
VSTKEWSKRYE

SEQ ID NO: 542328 - protein, 11 aa, Influenza virus
VSTKEWSRRYE

SEQ ID NO: 542329 - protein, 11 aa, Influenza virus
VSTNAYDRICI

SEQ ID NO: 542330 - protein, 11 aa, Influenza virus
VSTQKAINEIT

SEQ ID NO: 542331 - protein, 11 aa, Influenza virus
VSTQKALNEIT

SEQ ID NO: 542332 - protein, 11 aa, Influenza virus
VSTRSDQISIV

SEQ ID NO: 542333 - protein, 11 aa, Influenza virus
VSVGSGSFPDG

SEQ ID NO: 542334 - protein, 11 aa, Influenza virus
VSVGTSTLNQR

SEQ ID NO: 542335 - protein, 11 aa, Influenza virus
VSVRGSGMRIL

SEQ ID NO: 542336 - protein, 11 aa, Influenza virus
VSVTDGPAANS

SEQ ID NO: 542337 - protein, 11 aa, Influenza virus
VSWASNSIVTF

SEQ ID NO: 542338 - protein, 11 aa, Influenza virus
VSWEMGQAPSP

SEQ ID NO: 542339 - protein, 11 aa, Influenza virus
VSWPLSSPPTV

SEQ ID NO: 542340 - protein, 11 aa, Influenza virus
VSWSQNILRTQ

SEQ ID NO: 542341 - protein, 11 aa, Influenza virus
VSWTSNSIITF

SEQ ID NO: 542342 - protein, 11 aa, Influenza virus
VSWTSNSIVTF

SEQ ID NO: 542343 - protein, 11 aa, Influenza virus
VSWTSNSMVTF

SEQ ID NO: 542344 - protein, 11 aa, Influenza virus
VSYCRATEYIM

SEQ ID NO: 542345 - protein, 11 aa, Influenza virus
VTADKDSNGVQ

SEQ ID NO: 542346 - protein, 11 aa, Influenza virus
VTCGCRDNWQG

SEQ ID NO: 542347 - protein, 11 aa, Influenza virus
VTCICRDNWQG

SEQ ID NO: 542348 - protein, 11 aa, Influenza virus
VTCTCRDNWQG

SEQ ID NO: 542349 - protein, 11 aa, Influenza virus
VTCVCRDNWKS

SEQ ID NO: 542350 - protein, 11 aa, Influenza virus
VTCVCRDNWQG

SEQ ID NO: 542351 - protein, 11 aa, Influenza virus
VTDGPAANNAD

SEQ ID NO: 542352 - protein, 11 aa, Influenza virus
VTDGPAANSAD

SEQ ID NO: 542353 - protein, 11 aa, Influenza virus
VTDGPADNKAD

SEQ ID NO: 542354 - protein, 11 aa, Influenza virus
VTDGPSDAQAF

SEQ ID NO: 542355 - protein, 11 aa, Influenza virus
VTDIWAYNAEL

SEQ ID NO: 542356 - protein, 11 aa, Influenza virus
VTDIWSYNAKL

SEQ ID NO: 542357 - protein, 11 aa, Influenza virus
VTDIWSYNARL

SEQ ID NO: 542358 - protein, 11 aa, Influenza virus
VTDSEMNKLFE

SEQ ID NO: 542359 - protein, 11 aa, Influenza virus
VTDVWSYNAKL

SEQ ID NO: 542360 - protein, 11 aa, Influenza virus
VTEINTWARNI

SEQ ID NO: 542361 - protein, 11 aa, Influenza virus
VTELWSYNAEL

SEQ ID NO: 542362 - protein, 11 aa, Influenza virus
VTFCGLDNEPD

SEQ ID NO: 542363 - protein, 11 aa, Influenza virus
VTFCGLDNEPG

SEQ ID NO: 542364 - protein, 11 aa, Influenza virus
VTFCGLNNEPG

SEQ ID NO: 542365 - protein, 11 aa, Influenza virus
VTFIFNGAFIA

SEQ ID NO: 542366 - protein, 11 aa, Influenza virus
VTFSFNGAFIA

SEQ ID NO: 542367 - protein, 11 aa, Influenza virus
VTFTFNGAFIA

SEQ ID NO: 542368 - protein, 11 aa, Influenza virus
VTGDDENATAS

SEQ ID NO: 542369 - protein, 11 aa, Influenza virus
VTGDDKNATAS

SEQ ID NO: 542370 - protein, 11 aa, Influenza virus
VTGDDRNATAS

SEQ ID NO: 542371 - protein, 11 aa, Influenza virus
VTGFAPFSKDN

SEQ ID NO: 542372 - protein, 11 aa, Influenza virus
VTGKLNRLIEK

SEQ ID NO: 542373 - protein, 11 aa, Influenza virus
VTGKSHGRILK

SEQ ID NO: 542374 - protein, 11 aa, Influenza virus
VTGLRNIPSIQ

SEQ ID NO: 542375 - protein, 11 aa, Influenza virus
VTGLRNVPSIQ

SEQ ID NO: 542376 - protein, 11 aa, Influenza virus
VTHAKDILEKA

SEQ ID NO: 542377 - protein, 11 aa, Influenza virus
VTHAKDILEKT

SEQ ID NO: 542378 - protein, 11 aa, Influenza virus
VTHAKNILEKT

SEQ ID NO: 542379 - protein, 11 aa, Influenza virus
VTHAQDILEKT

SEQ ID NO: 542380 - protein, 11 aa, Influenza virus
VTHAQNILEKT

SEQ ID NO: 542381 - protein, 11 aa, Influenza virus
VTHTGTSKACN

SEQ ID NO: 542382 - protein, 11 aa, Influenza virus
VTIGECPKYVK

SEQ ID NO: 542383 - protein, 11 aa, Influenza virus
VTIGECPKYVR

SEQ ID NO: 542384 - protein, 11 aa, Influenza virus
VTIGKCPKYVK

SEQ ID NO: 542385 - protein, 11 aa, Influenza virus
VTKENTGSYVR

SEQ ID NO: 542386 - protein, 11 aa, Influenza virus
VTLSSGYKDII

SEQ ID NO: 542387 - protein, 11 aa, Influenza virus
VTLTMGYKDII

SEQ ID NO: 542388 - protein, 11 aa, Influenza virus
VTNATETVENK

SEQ ID NO: 542389 - protein, 11 aa, Influenza virus
VTNATETVESK

SEQ ID NO: 542390 - protein, 11 aa, Influenza virus
VTNATETVESR

SEQ ID NO: 542391 - protein, 11 aa, Influenza virus
VTNATETVEST

SEQ ID NO: 542392 - protein, 11 aa, Influenza virus
VTNKVNSIIDK

SEQ ID NO: 542393 - protein, 11 aa, Influenza virus
VTNKVNSIIGK

SEQ ID NO: 542394 - protein, 11 aa, Influenza virus
VTNKVNSIINK

SEQ ID NO: 542395 - protein, 11 aa, Influenza virus
VTQAMELVEAE

SEQ ID NO: 542396 - protein, 11 aa, Influenza virus
VTQTLVSNNDW

SEQ ID NO: 542397 - protein, 11 aa, Influenza virus
VTQTMELVEAE

SEQ ID NO: 542398 - protein, 11 aa, Influenza virus
VTQTMELVETE

SEQ ID NO: 542399 - protein, 11 aa, Influenza virus
VTQTMELVETK

SEQ ID NO: 542400 - protein, 11 aa, Influenza virus
VTQVEELVHGG

SEQ ID NO: 542401 - protein, 11 aa, Influenza virus
VTQVEELVHGQ

SEQ ID NO: 542402 - protein, 11 aa, Influenza virus
VTQVEELVHRG

SEQ ID NO: 542403 - protein, 11 aa, Influenza virus
VTREPYISCDN

SEQ ID NO: 542404 - protein, 11 aa, Influenza virus
VTREPYLSCDP

SEQ ID NO: 542405 - protein, 11 aa, Influenza virus
VTREPYLSCEP

SEQ ID NO: 542406 - protein, 11 aa, Influenza virus
VTREPYLSCGP

SEQ ID NO: 542407 - protein, 11 aa, Influenza virus
VTREPYVSCDN

SEQ ID NO: 542408 - protein, 11 aa, Influenza virus
VTREPYVSCDP

SEQ ID NO: 542409 - protein, 11 aa, Influenza virus
VTREPYVSCDS

SEQ ID NO: 542410 - protein, 11 aa, Influenza virus
VTREPYVSCDY

SEQ ID NO: 542411 - protein, 11 aa, Influenza virus
VTREPYVSCEP

SEQ ID NO: 542412 - protein, 11 aa, Influenza virus
VTRREIHIYYL

SEQ ID NO: 542413 - protein, 11 aa, Influenza virus
VTRREVHIYYL

SEQ ID NO: 542414 - protein, 11 aa, Influenza virus
VTRREVHMYYL

SEQ ID NO: 542415 - protein, 11 aa, Influenza virus
VTRREVHTYYL

SEQ ID NO: 542416 - protein, 11 aa, Influenza virus
VTRREVHVYYL

SEQ ID NO: 542417 - protein, 11 aa, Influenza virus
VTRSGTSKACN

SEQ ID NO: 542418 - protein, 11 aa, Influenza virus
VTSSGTSKACN

SEQ ID NO: 542419 - protein, 11 aa, Influenza virus
VTSSGTSKACS

SEQ ID NO: 542420 - protein, 11 aa, Influenza virus
VTSSIDLVETN

SEQ ID NO: 542421 - protein, 11 aa, Influenza virus
VTSSVDLVETN

SEQ ID NO: 542422 - protein, 11 aa, Influenza virus
VTTNTINRIFQ

SEQ ID NO: 542423 - protein, 11 aa, Influenza virus
VTTNTINRNFQ

SEQ ID NO: 542424 - protein, 11 aa, Influenza virus
VTTNTINRSFQ

SEQ ID NO: 542425 - protein, 11 aa, Influenza virus
VTTNTINRSFR

SEQ ID NO: 542426 - protein, 11 aa, Influenza virus
VTTRQASPSCL

SEQ ID NO: 542427 - protein, 11 aa, Influenza virus
VTTVGWSWPDG

SEQ ID NO: 542428 - protein, 11 aa, Influenza virus
VTTVTLHFKQH

SEQ ID NO: 542429 - protein, 11 aa, Influenza virus
VTVSTRSDQIS

SEQ ID NO: 542430 - protein, 11 aa, Influenza virus
VTVTDGPAANS

SEQ ID NO: 542431 - protein, 11 aa, Influenza virus
VTVTHAKDILE

SEQ ID NO: 542432 - protein, 11 aa, Influenza virus
VTVTHAKNILE

SEQ ID NO: 542433 - protein, 11 aa, Influenza virus
VTVTHAQDILE

SEQ ID NO: 542434 - protein, 11 aa, Influenza virus
VTVTHAQNILE

SEQ ID NO: 542435 - protein, 11 aa, Influenza virus
VTVTHSIELLE

SEQ ID NO: 542436 - protein, 11 aa, Influenza virus
VTVTHSINLLE

SEQ ID NO: 542437 - protein, 11 aa, Influenza virus
VTVTHSVDLLE

SEQ ID NO: 542438 - protein, 11 aa, Influenza virus
VTVTHSVELLE

SEQ ID NO: 542439 - protein, 11 aa, Influenza virus
VTVTHSVNILE

SEQ ID NO: 542440 - protein, 11 aa, Influenza virus
VTVTHSVNLLE

SEQ ID NO: 542441 - protein, 11 aa, Influenza virus
VTVTNSVELVE

SEQ ID NO: 542442 - protein, 11 aa, Influenza virus
VTVTSSIELVE

SEQ ID NO: 542443 - protein, 11 aa, Influenza virus
VTVTSSVELVE

SEQ ID NO: 542444 - protein, 11 aa, Influenza virus
VTYQILSIYST

SEQ ID NO: 542445 - protein, 11 aa, Influenza virus
VTYTGISKACN

SEQ ID NO: 542446 - protein, 11 aa, Influenza virus
VTYTGTSKACN

SEQ ID NO: 542447 - protein, 11 aa, Influenza virus
VTYTGTSRACN

SEQ ID NO: 542448 - protein, 11 aa, Influenza virus
VVAKDNAIRFG

SEQ ID NO: 542449 - protein, 11 aa, Influenza virus
VVAMVFSQEDC

SEQ ID NO: 542450 - protein, 11 aa, Influenza virus
VVAVTDGPAAN

SEQ ID NO: 542451 - protein, 11 aa, Influenza virus
VVAVTDGPADN

SEQ ID NO: 542452 - protein, 11 aa, Influenza virus
VVENKYVNNTT

SEQ ID NO: 542453 - protein, 11 aa, Influenza virus
VVENTYVNNTT

SEQ ID NO: 542454 - protein, 11 aa, Influenza virus
VVFCGASGTYG

SEQ ID NO: 542455 - protein, 11 aa, Influenza virus
VVFCGTSGIYG

SEQ ID NO: 542456 - protein, 11 aa, Influenza virus
VVFCGTSGTYG

SEQ ID NO: 542457 - protein, 11 aa, Influenza virus
VVFCSTSGTYG

SEQ ID NO: 542458 - protein, 11 aa, Influenza virus
VVFPNEVGAKI

SEQ ID NO: 542459 - protein, 11 aa, Influenza virus
VVFPNEVGARI

SEQ ID NO: 542460 - protein, 11 aa, Influenza virus
VVFTDGSATGP

SEQ ID NO: 542461 - protein, 11 aa, Influenza virus
VVGARPLVNGQ

SEQ ID NO: 542462 - protein, 11 aa, Influenza virus
VVGARPQVNGQ

SEQ ID NO: 542463 - protein, 11 aa, Influenza virus
VVHISPLSGSA

SEQ ID NO: 542464 - protein, 11 aa, Influenza virus
VVIAKDNAIRF

SEQ ID NO: 542465 - protein, 11 aa, Influenza virus
VVIAKDNAVRF

SEQ ID NO: 542466 - protein, 11 aa, Influenza virus
VVIAQDNAIRF

SEQ ID NO: 542467 - protein, 11 aa, Influenza virus
VVIEKDNAVRF

SEQ ID NO: 542468 - protein, 11 aa, Influenza virus
VVLENQHTIDL

SEQ ID NO: 542469 - protein, 11 aa, Influenza virus
VVLNTDWSGYS

SEQ ID NO: 542470 - protein, 11 aa, Influenza virus
VVLVGLILAFI

SEQ ID NO: 542471 - protein, 11 aa, Influenza virus
VVLVMKRKRDS

SEQ ID NO: 542472 - protein, 11 aa, Influenza virus
VVLVMKRKRNS

SEQ ID NO: 542473 - protein, 11 aa, Influenza virus
VVMTDGNASGK

SEQ ID NO: 542474 - protein, 11 aa, Influenza virus
VVMTDGSASGK

SEQ ID NO: 542475 - protein, 11 aa, Influenza virus
VVMTDGSASGR

SEQ ID NO: 542476 - protein, 11 aa, Influenza virus
VVMTDGSASRK

SEQ ID NO: 542477 - protein, 11 aa, Influenza virus
VVMTDGSASSQ

SEQ ID NO: 542478 - protein, 11 aa, Influenza virus
VVNATETVEIT

SEQ ID NO: 542479 - protein, 11 aa, Influenza virus
VVNATETVERT

SEQ ID NO: 542480 - protein, 11 aa, Influenza virus
VVNATETVETA

SEQ ID NO: 542481 - protein, 11 aa, Influenza virus
VVNATETVETT

SEQ ID NO: 542482 - protein, 11 aa, Influenza virus
VVNATETVETV

SEQ ID NO: 542483 - protein, 11 aa, Influenza virus
VVNFLSMEFSL

SEQ ID NO: 542484 - protein, 11 aa, Influenza virus
VVNFVSMEFSL

SEQ ID NO: 542485 - protein, 11 aa, Influenza virus
VVNTALSTIAL

SEQ ID NO: 542486 - protein, 11 aa, Influenza virus
VVNTILSTKAL

SEQ ID NO: 542487 - protein, 11 aa, Influenza virus
VVNTTLSTIAL

SEQ ID NO: 542488 - protein, 11 aa, Influenza virus
VVNYVSMEFSL

SEQ ID NO: 542489 - protein, 11 aa, Influenza virus
VVRARPQVNGQ

SEQ ID NO: 542490 - protein, 11 aa, Influenza virus
VVRKMMTNSQD

SEQ ID NO: 542491 - protein, 11 aa, Influenza virus
VVRKMMTNSRD

SEQ ID NO: 542492 - protein, 11 aa, Influenza virus
VVRKMMTSSQD

SEQ ID NO: 542493 - protein, 11 aa, Influenza virus
VVRSWKKQILR

SEQ ID NO: 542494 - protein, 11 aa, Influenza virus
VVRSWRKKILR

SEQ ID NO: 542495 - protein, 11 aa, Influenza virus
VVRSWRKQILR

SEQ ID NO: 542496 - protein, 11 aa, Influenza virus
VVRSWRRQILR

SEQ ID NO: 542497 - protein, 11 aa, Influenza virus
VVSAKELVETN

SEQ ID NO: 542498 - protein, 11 aa, Influenza virus
VVSLGAISFWM

SEQ ID NO: 542499 - protein, 11 aa, Influenza virus
VVTREPYVSCD

SEQ ID NO: 542500 - protein, 11 aa, Influenza virus
VVTVTDGPAAN

SEQ ID NO: 542501 - protein, 11 aa, Influenza virus
VVVAKDNAIRF

SEQ ID NO: 542502 - protein, 11 aa, Influenza virus
VWACQRGNIRC

SEQ ID NO: 542503 - protein, 11 aa, Influenza virus
VWAYNAELLVL

SEQ ID NO: 542504 - protein, 11 aa, Influenza virus
VWDANGWVSTD

SEQ ID NO: 542505 - protein, 11 aa, Influenza virus
VWDDNGWVSTD

SEQ ID NO: 542506 - protein, 11 aa, Influenza virus
VWGVHHSSSLD

SEQ ID NO: 542507 - protein, 11 aa, Influenza virus
VWIGRTKSLES

SEQ ID NO: 542508 - protein, 11 aa, Influenza virus
VWLENEKTLDL

SEQ ID NO: 542509 - protein, 11 aa, Influenza virus
VWLGRTVSING

SEQ ID NO: 542510 - protein, 11 aa, Influenza virus
VWLGRTVSISG

SEQ ID NO: 542511 - protein, 11 aa, Influenza virus
VWLGRTVSNSG

SEQ ID NO: 542512 - protein, 11 aa, Influenza virus
VWLGRTVSTSG

SEQ ID NO: 542513 - protein, 11 aa, Influenza virus
VWLWLVLREKM

SEQ ID NO: 542514 - protein, 11 aa, Influenza virus
VWMACHSAAFE

SEQ ID NO: 542515 - protein, 11 aa, Influenza virus
VWMACNSAAFE

SEQ ID NO: 542516 - protein, 11 aa, Influenza virus
VWMGRTISKDS

SEQ ID NO: 542517 - protein, 11 aa, Influenza virus
VWMGRTISMDS

SEQ ID NO: 542518 - protein, 11 aa, Influenza virus
VWMGRTISRDS

SEQ ID NO: 542519 - protein, 11 aa, Influenza virus
VWSYNAELLVA

SEQ ID NO: 542520 - protein, 11 aa, Influenza virus
VWSYNAKLLVL

SEQ ID NO: 542521 - protein, 11 aa, Influenza virus
VWTSGSIISFC

SEQ ID NO: 542522 - protein, 11 aa, Influenza virus
VWTSGSSISFC

SEQ ID NO: 542523 - protein, 11 aa, Influenza virus
VWTYNAEILVL

SEQ ID NO: 542524 - protein, 11 aa, Influenza virus
VWTYNAELFVL

SEQ ID NO: 542525 - protein, 11 aa, Influenza virus
VWTYNAELLIL

SEQ ID NO: 542526 - protein, 11 aa, Influenza virus
VWTYNAELLVL

SEQ ID NO: 542527 - protein, 11 aa, Influenza virus
VWTYNAEVLVL

SEQ ID NO: 542528 - protein, 11 aa, Influenza virus
VWTYNTELLVL

SEQ ID NO: 542529 - protein, 11 aa, Influenza virus
VWTYNVELLVL

SEQ ID NO: 542530 - protein, 11 aa, Influenza virus
VWVTREPYVSC

SEQ ID NO: 542531 - protein, 11 aa, Influenza virus
VWWASNSLIAL

SEQ ID NO: 542532 - protein, 11 aa, Influenza virus
VWWTSNSIAVF

SEQ ID NO: 542533 - protein, 11 aa, Influenza virus
VWWTSNSIISM

SEQ ID NO: 542534 - protein, 11 aa, Influenza virus
VWWTSNSIIVF

SEQ ID NO: 542535 - protein, 11 aa, Influenza virus
VWWTSNSIVAF

SEQ ID NO: 542536 - protein, 11 aa, Influenza virus
VWWTSNSIVAL

SEQ ID NO: 542537 - protein, 11 aa, Influenza virus
VWWTSNSIVSM

SEQ ID NO: 542538 - protein, 11 aa, Influenza virus
VWWTSNSIVVF

SEQ ID NO: 542539 - protein, 11 aa, Influenza virus
VWWTSNSLIAL

SEQ ID NO: 542540 - protein, 11 aa, Influenza virus
VWWTSNSLVAL

SEQ ID NO: 542541 - protein, 11 aa, Influenza virus
VWWTSTSIVVF

SEQ ID NO: 542542 - protein, 11 aa, Influenza virus
VWWTTNSIVVF

SEQ ID NO: 542543 - protein, 11 aa, Influenza virus
VYCICRDNWKG

SEQ ID NO: 542544 - protein, 11 aa, Influenza virus
VYCVCRDNWKG

SEQ ID NO: 542545 - protein, 11 aa, Influenza virus
VYIEVLHLTQG

SEQ ID NO: 542546 - protein, 11 aa, Influenza virus
VYINTALLNAS

SEQ ID NO: 542547 - protein, 11 aa, Influenza virus
VYINTALLNSS

SEQ ID NO: 542548 - protein, 11 aa, Influenza virus
VYINTAMLNAS

SEQ ID NO: 542549 - protein, 11 aa, Influenza virus
VYKALSIYSCI

SEQ ID NO: 542550 - protein, 11 aa, Influenza virus
VYKILSIYSCI

SEQ ID NO: 542551 - protein, 11 aa, Influenza virus
VYKILSIYSCV

SEQ ID NO: 542552 - protein, 11 aa, Influenza virus
VYKVLAIYSCI

SEQ ID NO: 542553 - protein, 11 aa, Influenza virus
VYKVLSIYSCI

SEQ ID NO: 542554 - protein, 11 aa, Influenza virus
VYMNTALLNAS

SEQ ID NO: 542555 - protein, 11 aa, Influenza virus
VYNNTTGRDVL

SEQ ID NO: 542556 - protein, 11 aa, Influenza virus
VYQAKFEAVAW

SEQ ID NO: 542557 - protein, 11 aa, Influenza virus
VYQAKFESVAW

SEQ ID NO: 542558 - protein, 11 aa, Influenza virus
VYQARFEAVAW

SEQ ID NO: 542559 - protein, 11 aa, Influenza virus
VYQARFESVAW

SEQ ID NO: 542560 - protein, 11 aa, Influenza virus
VYQILAIYATV

SEQ ID NO: 542561 - protein, 11 aa, Influenza virus
VYQILAIYSTI

SEQ ID NO: 542562 - protein, 11 aa, Influenza virus
VYQILAIYSTV

SEQ ID NO: 542563 - protein, 11 aa, Influenza virus
VYQILSIYSTV

SEQ ID NO: 542564 - protein, 11 aa, Influenza virus
VYQSRFEAVAW

SEQ ID NO: 542565 - protein, 11 aa, Influenza virus
VYQVLAIYATV

SEQ ID NO: 542566 - protein, 11 aa, Influenza virus
VYRALSIYSCI

SEQ ID NO: 542567 - protein, 11 aa, Influenza virus
VYRDNWKGSNR

SEQ ID NO: 542568 - protein, 11 aa, Influenza virus
VYVEVLHLTQG

SEQ ID NO: 542569 - protein, 11 aa, Influenza virus
VYVNTALLNAS

SEQ ID NO: 542570 - protein, 11 aa, Influenza virus
VYWWDGLQSSD

SEQ ID NO: 542571 - protein, 11 aa, Influenza virus
VYYDRRLTTTI

SEQ ID NO: 542572 - protein, 11 aa, Influenza virus
VYYDRRLTTTV

SEQ ID NO: 542573 - protein, 11 aa, Influenza virus
VYYNGRLTTTI

SEQ ID NO: 542574 - protein, 11 aa, Influenza virus
VYYNKRLTTTI

SEQ ID NO: 542575 - protein, 11 aa, Influenza virus
VYYNRRLTTTI

SEQ ID NO: 542576 - protein, 11 aa, Influenza virus
VYYNRRPTTTI

SEQ ID NO: 542577 - protein, 11 aa, Influenza virus
WACGNGSCRCT

SEQ ID NO: 542578 - protein, 11 aa, Influenza virus
WACNNGSCRCT

SEQ ID NO: 542579 - protein, 11 aa, Influenza virus
WACQKGNIKCN

SEQ ID NO: 542580 - protein, 11 aa, Influenza virus
WACQKGNIRCD

SEQ ID NO: 542581 - protein, 11 aa, Influenza virus
WACQKGNIRCN

SEQ ID NO: 542582 - protein, 11 aa, Influenza virus
WACQNGNIRCQ

SEQ ID NO: 542583 - protein, 11 aa, Influenza virus
WACQNGNLRCQ

SEQ ID NO: 542584 - protein, 11 aa, Influenza virus
WACQNGNVRCQ

SEQ ID NO: 542585 - protein, 11 aa, Influenza virus
WACQRGNIRCN

SEQ ID NO: 542586 - protein, 11 aa, Influenza virus
WACQTGNIRCQ

SEQ ID NO: 542587 - protein, 11 aa, Influenza virus
WACSNGNCRFN

SEQ ID NO: 542588 - protein, 11 aa, Influenza virus
WACSNGSCRCT

SEQ ID NO: 542589 - protein, 11 aa, Influenza virus
WACSNGSCRFN

SEQ ID NO: 542590 - protein, 11 aa, Influenza virus
WACSSGNCRFN

SEQ ID NO: 542591 - protein, 11 aa, Influenza virus
WACSSGNCRFS

SEQ ID NO: 542592 - protein, 11 aa, Influenza virus
WAEGDCYRACF

SEQ ID NO: 542593 - protein, 11 aa, Influenza virus
WAEGECYRACF

SEQ ID NO: 542594 - protein, 11 aa, Influenza virus
WAGKILRTQES

SEQ ID NO: 542595 - protein, 11 aa, Influenza virus
WAGNILRTQES

SEQ ID NO: 542596 - protein, 11 aa, Influenza virus
WAIHHPPTSAE

SEQ ID NO: 542597 - protein, 11 aa, Influenza virus
WAIHHPPTSDE

SEQ ID NO: 542598 - protein, 11 aa, Influenza virus
WAIHHPPTSNE

SEQ ID NO: 542599 - protein, 11 aa, Influenza virus
WAIHHPPTTDE

SEQ ID NO: 542600 - protein, 11 aa, Influenza virus
WAILKPGQTVK

SEQ ID NO: 542601 - protein, 11 aa, Influenza virus
WAIRTKSGGNT

SEQ ID NO: 542602 - protein, 11 aa, Influenza virus
WAIRTRSGGNT

SEQ ID NO: 542603 - protein, 11 aa, Influenza virus
WAKEECYRACF

SEQ ID NO: 542604 - protein, 11 aa, Influenza virus
WAKGDCYRACF

SEQ ID NO: 542605 - protein, 11 aa, Influenza virus
WAKGECYRACF

SEQ ID NO: 542606 - protein, 11 aa, Influenza virus
WAKNILRTQES

SEQ ID NO: 542607 - protein, 11 aa, Influenza virus
WALGENMAPEK

SEQ ID NO: 542608 - protein, 11 aa, Influenza virus
WAPLSKDNGIR

SEQ ID NO: 542609 - protein, 11 aa, Influenza virus
WARNILRTQDS

SEQ ID NO: 542610 - protein, 11 aa, Influenza virus
WARNILRTQES

SEQ ID NO: 542611 - protein, 11 aa, Influenza virus
WASGSSISFCG

SEQ ID NO: 542612 - protein, 11 aa, Influenza virus
WASNSIVTFCG

SEQ ID NO: 542613 - protein, 11 aa, Influenza virus
WASNSLIALCG

SEQ ID NO: 542614 - protein, 11 aa, Influenza virus
WAVGRCPRYVK

SEQ ID NO: 542615 - protein, 11 aa, Influenza virus
WAVLKPGQTVK

SEQ ID NO: 542616 - protein, 11 aa, Influenza virus
WAYNAELIVLL

SEQ ID NO: 542617 - protein, 11 aa, Influenza virus
WAYNAELLVLI

SEQ ID NO: 542618 - protein, 11 aa, Influenza virus
WAYNAELLVLL

SEQ ID NO: 542619 - protein, 11 aa, Influenza virus
WCGMIDGWYGF

SEQ ID NO: 542620 - protein, 11 aa, Influenza virus
WCKIVTTVGWS

SEQ ID NO: 542621 - protein, 11 aa, Influenza virus
WDANGWVSTDK

SEQ ID NO: 542622 - protein, 11 aa, Influenza virus
WDANGWVTADK

SEQ ID NO: 542623 - protein, 11 aa, Influenza virus
WDDGAILPFDI

SEQ ID NO: 542624 - protein, 11 aa, Influenza virus
WDDGAILPFGI

SEQ ID NO: 542625 - protein, 11 aa, Influenza virus
WDDGAILPLTS

SEQ ID NO: 542626 - protein, 11 aa, Influenza virus
WDGLQSSDDFA

SEQ ID NO: 542627 - protein, 11 aa, Influenza virus
WDSFRQSERGE

SEQ ID NO: 542628 - protein, 11 aa, Influenza virus
WDTINFESTGN

SEQ ID NO: 542629 - protein, 11 aa, Influenza virus
WDTISFESTGN

SEQ ID NO: 542630 - protein, 11 aa, Influenza virus
WDVFIERPTAV

SEQ ID NO: 542631 - protein, 11 aa, Influenza virus
WDVINFESTGN

SEQ ID NO: 542632 - protein, 11 aa, Influenza virus
WDVISFESTGN

SEQ ID NO: 542633 - protein, 11 aa, Influenza virus
WDWPDGAKIEY

SEQ ID NO: 542634 - protein, 11 aa, Influenza virus
WEGLIDGWYGF

SEQ ID NO: 542635 - protein, 11 aa, Influenza virus
WEGLIDGWYGY

SEQ ID NO: 542636 - protein, 11 aa, Influenza virus
WEGLINGWYGF

SEQ ID NO: 542637 - protein, 11 aa, Influenza virus
WEGLVDGWYGF

SEQ ID NO: 542638 - protein, 11 aa, Influenza virus
WEGMIDGWYGF

SEQ ID NO: 542639 - protein, 11 aa, Influenza virus
WEGMMDGWYGF

SEQ ID NO: 542640 - protein, 11 aa, Influenza virus
WEGMVDGWYGF

SEQ ID NO: 542641 - protein, 11 aa, Influenza virus
WEGMVNGWYGF

SEQ ID NO: 542642 - protein, 11 aa, Influenza virus
WEGNILRTQES

SEQ ID NO: 542643 - protein, 11 aa, Influenza virus
WEINGPDSVLV

SEQ ID NO: 542644 - protein, 11 aa, Influenza virus
WEINGPESVLI

SEQ ID NO: 542645 - protein, 11 aa, Influenza virus
WEINGPESVLV

SEQ ID NO: 542646 - protein, 11 aa, Influenza virus
WEKNCTLIDAL

SEQ ID NO: 542647 - protein, 11 aa, Influenza virus
WEMGLAPSPYN

SEQ ID NO: 542648 - protein, 11 aa, Influenza virus
WEMGQAPSPCN

SEQ ID NO: 542649 - protein, 11 aa, Influenza virus
WEMGQAPSPYN

SEQ ID NO: 542650 - protein, 11 aa, Influenza virus
WEMGQAPSPYT

SEQ ID NO: 542651 - protein, 11 aa, Influenza virus
WEQLYTPGGEV

SEQ ID NO: 542652 - protein, 11 aa, Influenza virus
WEQMYNPGGEV

SEQ ID NO: 542653 - protein, 11 aa, Influenza virus
WEQMYTPGGEV

SEQ ID NO: 542654 - protein, 11 aa, Influenza virus
WEQMYTPGGGV

SEQ ID NO: 542655 - protein, 11 aa, Influenza virus
WEQMYTPGGKV

SEQ ID NO: 542656 - protein, 11 aa, Influenza virus
WETTGRNCTVP

SEQ ID NO: 542657 - protein, 11 aa, Influenza virus
WEVNGPESVLV

SEQ ID NO: 542658 - protein, 11 aa, Influenza virus
WFGYFGIFFVE

SEQ ID NO: 542659 - protein, 11 aa, Influenza virus
WFRNALSIAPI

SEQ ID NO: 542660 - protein, 11 aa, Influenza virus
WFRNILSIAPI

SEQ ID NO: 542661 - protein, 11 aa, Influenza virus
WFRNILSMAPI

SEQ ID NO: 542662 - protein, 11 aa, Influenza virus
WFRNVLSIAPI

SEQ ID NO: 542663 - protein, 11 aa, Influenza virus
WFRNVLSVAPI

SEQ ID NO: 542664 - protein, 11 aa, Influenza virus
WFSFGASCFIF

SEQ ID NO: 542665 - protein, 11 aa, Influenza virus
WFSFGASCFIL

SEQ ID NO: 542666 - protein, 11 aa, Influenza virus
WFSFGASCFLF

SEQ ID NO: 542667 - protein, 11 aa, Influenza virus
WFSFGASCFLL

SEQ ID NO: 542668 - protein, 11 aa, Influenza virus
WFSFGASCFTL

SEQ ID NO: 542669 - protein, 11 aa, Influenza virus
WFSFGASCFVL

SEQ ID NO: 542670 - protein, 11 aa, Influenza virus
WFSFGASCLIL

SEQ ID NO: 542671 - protein, 11 aa, Influenza virus
WFSFGASCVML

SEQ ID NO: 542672 - protein, 11 aa, Influenza virus
WFSFGASSFVL

SEQ ID NO: 542673 - protein, 11 aa, Influenza virus
WFSHYNQMKQA

SEQ ID NO: 542674 - protein, 11 aa, Influenza virus
WFSHYNQMTQA

SEQ ID NO: 542675 - protein, 11 aa, Influenza virus
WFSHYNQVAQT

SEQ ID NO: 542676 - protein, 11 aa, Influenza virus
WFSHYNQVTQP

SEQ ID NO: 542677 - protein, 11 aa, Influenza virus
WFSHYNQVTQT

SEQ ID NO: 542678 - protein, 11 aa, Influenza virus
WFSLGASCFLL

SEQ ID NO: 542679 - protein, 11 aa, Influenza virus
WGDILDGVTAS

SEQ ID NO: 542680 - protein, 11 aa, Influenza virus
WGDILEGTTAS

SEQ ID NO: 542681 - protein, 11 aa, Influenza virus
WGDVLDGVTAS

SEQ ID NO: 542682 - protein, 11 aa, Influenza virus
WGIHHPDSETT

SEQ ID NO: 542683 - protein, 11 aa, Influenza virus
WGIHHPDTEAT

SEQ ID NO: 542684 - protein, 11 aa, Influenza virus
WGIHHPDTEAV

SEQ ID NO: 542685 - protein, 11 aa, Influenza virus
WGIHHPDTEEV

SEQ ID NO: 542686 - protein, 11 aa, Influenza virus
WGIHHPDTETT

SEQ ID NO: 542687 - protein, 11 aa, Influenza virus
WGIHHPPDAKE

SEQ ID NO: 542688 - protein, 11 aa, Influenza virus
WGIHHPPDETE

SEQ ID NO: 542689 - protein, 11 aa, Influenza virus
WGIHHPPDTKE

SEQ ID NO: 542690 - protein, 11 aa, Influenza virus
WGIHHPPNTKE

SEQ ID NO: 542691 - protein, 11 aa, Influenza virus
WGIHHPSSAQE

SEQ ID NO: 542692 - protein, 11 aa, Influenza virus
WGIHHPSSTKE

SEQ ID NO: 542693 - protein, 11 aa, Influenza virus
WGIHHPSSTQE

SEQ ID NO: 542694 - protein, 11 aa, Influenza virus
WGILKRGETLK

SEQ ID NO: 542695 - protein, 11 aa, Influenza virus
WGMELRRCLLQ

SEQ ID NO: 542696 - protein, 11 aa, Influenza virus
WGMEMRRCLLQ

SEQ ID NO: 542697 - protein, 11 aa, Influenza virus
WGMGQAPSPYN

SEQ ID NO: 542698 - protein, 11 aa, Influenza virus
WGNGCFEFYHK

SEQ ID NO: 542699 - protein, 11 aa, Influenza virus
WGNVLDGVTAS

SEQ ID NO: 542700 - protein, 11 aa, Influenza virus
WGTIVSSLPFQ

SEQ ID NO: 542701 - protein, 11 aa, Influenza virus
WGVHHPSSDNE

SEQ ID NO: 542702 - protein, 11 aa, Influenza virus
WGVHHPSTDAE

SEQ ID NO: 542703 - protein, 11 aa, Influenza virus
WGVHHPSTDKE

SEQ ID NO: 542704 - protein, 11 aa, Influenza virus
WGVHHPSTDTE

SEQ ID NO: 542705 - protein, 11 aa, Influenza virus
WGVHHSSSLDE

SEQ ID NO: 542706 - protein, 11 aa, Influenza virus
WHASNRPWISF

SEQ ID NO: 542707 - protein, 11 aa, Influenza virus
WHASNRPWVSF

SEQ ID NO: 542708 - protein, 11 aa, Influenza virus
WHDGAEIIYFE

SEQ ID NO: 542709 - protein, 11 aa, Influenza virus
WHDGAEIIYFK

SEQ ID NO: 542710 - protein, 11 aa, Influenza virus
WHDGAEITYFK

SEQ ID NO: 542711 - protein, 11 aa, Influenza virus
WHGANRPWVSF

SEQ ID NO: 542712 - protein, 11 aa, Influenza virus
WHGSNRPWISF

SEQ ID NO: 542713 - protein, 11 aa, Influenza virus
WHGSNRPWLSF

SEQ ID NO: 542714 - protein, 11 aa, Influenza virus
WHGSNRPWVSF

SEQ ID NO: 542715 - protein, 11 aa, Influenza virus
WHIFGKDNAIR

SEQ ID NO: 542716 - protein, 11 aa, Influenza virus
WHIFGKDNAVR

SEQ ID NO: 542717 - protein, 11 aa, Influenza virus
WHIFSKDNAIR

SEQ ID NO: 542718 - protein, 11 aa, Influenza virus
WHILSKDNAIR

SEQ ID NO: 542719 - protein, 11 aa, Influenza virus
WHILSKDNAVR

SEQ ID NO: 542720 - protein, 11 aa, Influenza virus
WHIYGKDNAIR

SEQ ID NO: 542721 - protein, 11 aa, Influenza virus
WHIYGKDNAVR

SEQ ID NO: 542722 - protein, 11 aa, Influenza virus
WHSNLNDATYQ

SEQ ID NO: 542723 - protein, 11 aa, Influenza virus
WHSNLNDTTYQ

SEQ ID NO: 542724 - protein, 11 aa, Influenza virus
WHVRKRFADQE

SEQ ID NO: 542725 - protein, 11 aa, Influenza virus
WICMGHHAVAN

SEQ ID NO: 542726 - protein, 11 aa, Influenza virus
WIELIRGRPKE

SEQ ID NO: 542727 - protein, 11 aa, Influenza virus
WIGRTKSLESR

SEQ ID NO: 542728 - protein, 11 aa, Influenza virus
WIKTRPILSPL

SEQ ID NO: 542729 - protein, 11 aa, Influenza virus
WILGNPMCDDL

SEQ ID NO: 542730 - protein, 11 aa, Influenza virus
WILGNPMCDEL

SEQ ID NO: 542731 - protein, 11 aa, Influenza virus
WILGNPMCDNL

SEQ ID NO: 542732 - protein, 11 aa, Influenza virus
WILGNPMCDYL

SEQ ID NO: 542733 - protein, 11 aa, Influenza virus
WILGNPRCDDL

SEQ ID NO: 542734 - protein, 11 aa, Influenza virus
WILWISFAISC

SEQ ID NO: 542735 - protein, 11 aa, Influenza virus
WILWISFAMSC

SEQ ID NO: 542736 - protein, 11 aa, Influenza virus
WILWISFATSC

SEQ ID NO: 542737 - protein, 11 aa, Influenza virus
WIPKRNRSILN

SEQ ID NO: 542738 - protein, 11 aa, Influenza virus
WIQNEFNKACE

SEQ ID NO: 542739 - protein, 11 aa, Influenza virus
WIQSEFNKACE

SEQ ID NO: 542740 - protein, 11 aa, Influenza virus
WIRFNSDLDYQ

SEQ ID NO: 542741 - protein, 11 aa, Influenza virus
WIRFNSDPDYQ

SEQ ID NO: 542742 - protein, 11 aa, Influenza virus
WIRFNSNLDYQ

SEQ ID NO: 542743 - protein, 11 aa, Influenza virus
WIRINNETILE

SEQ ID NO: 542744 - protein, 11 aa, Influenza virus
WISFAISCFLL

SEQ ID NO: 542745 - protein, 11 aa, Influenza virus
WISFAISCLLL

SEQ ID NO: 542746 - protein, 11 aa, Influenza virus
WISFAMSCFLL

SEQ ID NO: 542747 - protein, 11 aa, Influenza virus
WISFATSCFLL

SEQ ID NO: 542748 - protein, 11 aa, Influenza virus
WISFSISCFLL

SEQ ID NO: 542749 - protein, 11 aa, Influenza virus
WISFSMSCFVF

SEQ ID NO: 542750 - protein, 11 aa, Influenza virus
WITIGISGPDD

SEQ ID NO: 542751 - protein, 11 aa, Influenza virus
WITIGISGPDN

SEQ ID NO: 542752 - protein, 11 aa, Influenza virus
WITREPYVSCD

SEQ ID NO: 542753 - protein, 11 aa, Influenza virus
WIVGNPSCASN

SEQ ID NO: 542754 - protein, 11 aa, Influenza virus
WIVGNPSCATN

SEQ ID NO: 542755 - protein, 11 aa, Influenza virus
WKGANRPIITI

SEQ ID NO: 542756 - protein, 11 aa, Influenza virus
WKGANRPVIII

SEQ ID NO: 542757 - protein, 11 aa, Influenza virus
WKGANRPVITI

SEQ ID NO: 542758 - protein, 11 aa, Influenza virus
WKGGSIKTKLP

SEQ ID NO: 542759 - protein, 11 aa, Influenza virus
WKGGSINTKLP

SEQ ID NO: 542760 - protein, 11 aa, Influenza virus
WKGNIMRTQES

SEQ ID NO: 542761 - protein, 11 aa, Influenza virus
WKGSNRPIIDI

SEQ ID NO: 542762 - protein, 11 aa, Influenza virus
WKGSNRPIVDI

SEQ ID NO: 542763 - protein, 11 aa, Influenza virus
WKGSNRPVIDI

SEQ ID NO: 542764 - protein, 11 aa, Influenza virus
WKGSNRPVIDV

SEQ ID NO: 542765 - protein, 11 aa, Influenza virus
WKGSNRPVVDI

SEQ ID NO: 542766 - protein, 11 aa, Influenza virus
WKGSNRPWIRI

SEQ ID NO: 542767 - protein, 11 aa, Influenza virus
WKGSNRPWMKI

SEQ ID NO: 542768 - protein, 11 aa, Influenza virus
WKGSNRPWMRI

SEQ ID NO: 542769 - protein, 11 aa, Influenza virus
WKGSNRPWVRI

SEQ ID NO: 542770 - protein, 11 aa, Influenza virus
WKGSNRPWVRM

SEQ ID NO: 542771 - protein, 11 aa, Influenza virus
WKHVTNTILLV

SEQ ID NO: 542772 - protein, 11 aa, Influenza virus
WKKQILRTQES

SEQ ID NO: 542773 - protein, 11 aa, Influenza virus
WLEMIRGKPEE

SEQ ID NO: 542774 - protein, 11 aa, Influenza virus
WLEMIRGKPKE

SEQ ID NO: 542775 - protein, 11 aa, Influenza virus
WLEMIRGRPEE

SEQ ID NO: 542776 - protein, 11 aa, Influenza virus
WLENEKTLDLH

SEQ ID NO: 542777 - protein, 11 aa, Influenza virus
WLGGTISPRSR

SEQ ID NO: 542778 - protein, 11 aa, Influenza virus
WLGRTFSPRSR

SEQ ID NO: 542779 - protein, 11 aa, Influenza virus
WLGRTISIASR

SEQ ID NO: 542780 - protein, 11 aa, Influenza virus
WLGRTISKDLR

SEQ ID NO: 542781 - protein, 11 aa, Influenza virus
WLGRTISKDSR

SEQ ID NO: 542782 - protein, 11 aa, Influenza virus
WLGRTISKDTR

SEQ ID NO: 542783 - protein, 11 aa, Influenza virus
WLGRTISPHSR

SEQ ID NO: 542784 - protein, 11 aa, Influenza virus
WLGRTISPKLR

SEQ ID NO: 542785 - protein, 11 aa, Influenza virus
WLGRTISPRLR

SEQ ID NO: 542786 - protein, 11 aa, Influenza virus
WLGRTISPRSR

SEQ ID NO: 542787 - protein, 11 aa, Influenza virus
WLGRTISTASR

SEQ ID NO: 542788 - protein, 11 aa, Influenza virus
WLGRTLNTASR

SEQ ID NO: 542789 - protein, 11 aa, Influenza virus
WLGRTTSKDSR

SEQ ID NO: 542790 - protein, 11 aa, Influenza virus
WLGRTTSTASR

SEQ ID NO: 542791 - protein, 11 aa, Influenza virus
WLGRTVSINGR

SEQ ID NO: 542792 - protein, 11 aa, Influenza virus
WLGRTVSISGR

SEQ ID NO: 542793 - protein, 11 aa, Influenza virus
WLGRTVSNSGR

SEQ ID NO: 542794 - protein, 11 aa, Influenza virus
WLGRTVSTSGR

SEQ ID NO: 542795 - protein, 11 aa, Influenza virus
WLHICVTGDDR

SEQ ID NO: 542796 - protein, 11 aa, Influenza virus
WLHVCITGDDR

SEQ ID NO: 542797 - protein, 11 aa, Influenza virus
WLHVCVTGDDG

SEQ ID NO: 542798 - protein, 11 aa, Influenza virus
WLHVCVTGDDK

SEQ ID NO: 542799 - protein, 11 aa, Influenza virus
WLHVCVTGDDR

SEQ ID NO: 542800 - protein, 11 aa, Influenza virus
WLIIGISGPDN

SEQ ID NO: 542801 - protein, 11 aa, Influenza virus
WLKTRPILSPL

SEQ ID NO: 542802 - protein, 11 aa, Influenza virus
WLLGNPECDIL

SEQ ID NO: 542803 - protein, 11 aa, Influenza virus
WLLGNPECDLF

SEQ ID NO: 542804 - protein, 11 aa, Influenza virus
WLLGNPECDLL

SEQ ID NO: 542805 - protein, 11 aa, Influenza virus
WLLGNPECDRL

SEQ ID NO: 542806 - protein, 11 aa, Influenza virus
WLLGNPKCDRL

SEQ ID NO: 542807 - protein, 11 aa, Influenza virus
WLLGNPLCDEF

SEQ ID NO: 542808 - protein, 11 aa, Influenza virus
WLLGNPMCDEF

SEQ ID NO: 542809 - protein, 11 aa, Influenza virus
WLLGNPMCDKF

SEQ ID NO: 542810 - protein, 11 aa, Influenza virus
WLLGNPTCDEF

SEQ ID NO: 542811 - protein, 11 aa, Influenza virus
WLLSSKANQVF

SEQ ID NO: 542812 - protein, 11 aa, Influenza virus
WLLSSKDNQVF

SEQ ID NO: 542813 - protein, 11 aa, Influenza virus
WLSSSGNNQVF

SEQ ID NO: 542814 - protein, 11 aa, Influenza virus
WLSSSMNNQVF

SEQ ID NO: 542815 - protein, 11 aa, Influenza virus
WLTIGISGPDD

SEQ ID NO: 542816 - protein, 11 aa, Influenza virus
WLTIGISGPDN

SEQ ID NO: 542817 - protein, 11 aa, Influenza virus
WLTIGISGPDS

SEQ ID NO: 542818 - protein, 11 aa, Influenza virus
WLTIGITGPDA

SEQ ID NO: 542819 - protein, 11 aa, Influenza virus
WLTIGVSGPDN

SEQ ID NO: 542820 - protein, 11 aa, Influenza virus
WLTKATNGNYG

SEQ ID NO: 542821 - protein, 11 aa, Influenza virus
WLTKETNGNYG

SEQ ID NO: 542822 - protein, 11 aa, Influenza virus
WLTKKEPDTYD

SEQ ID NO: 542823 - protein, 11 aa, Influenza virus
WLTKKKNPEAY

SEQ ID NO: 542824 - protein, 11 aa, Influenza virus
WLTKKKPDIYD

SEQ ID NO: 542825 - protein, 11 aa, Influenza virus
WLTKKKPDTYD

SEQ ID NO: 542826 - protein, 11 aa, Influenza virus
WLTLGITGPDA

SEQ ID NO: 542827 - protein, 11 aa, Influenza virus
WLTLGITGPDS

SEQ ID NO: 542828 - protein, 11 aa, Influenza virus
WLTLGITGPDT

SEQ ID NO: 542829 - protein, 11 aa, Influenza virus
WLTLKLGQFPV

SEQ ID NO: 542830 - protein, 11 aa, Influenza virus
WLTLKSEQFPV

SEQ ID NO: 542831 - protein, 11 aa, Influenza virus
WLTLKSGQFPV

SEQ ID NO: 542832 - protein, 11 aa, Influenza virus
WLWLVLREKMP

SEQ ID NO: 542833 - protein, 11 aa, Influenza virus
WMACHSAAFED

SEQ ID NO: 542834 - protein, 11 aa, Influenza virus
WMACNSAAFED

SEQ ID NO: 542835 - protein, 11 aa, Influenza virus
WMCFNGSLQCR

SEQ ID NO: 542836 - protein, 11 aa, Influenza virus
WMCLNGSMQCR

SEQ ID NO: 542837 - protein, 11 aa, Influenza virus
WMCPNGSLQCT

SEQ ID NO: 542838 - protein, 11 aa, Influenza virus
WMCSGHSCRIC

SEQ ID NO: 542839 - protein, 11 aa, Influenza virus
WMCSNGSLHGR

SEQ ID NO: 542840 - protein, 11 aa, Influenza virus
WMCSNGSLQCK

SEQ ID NO: 542841 - protein, 11 aa, Influenza virus
WMCSNGSLQCR

SEQ ID NO: 542842 - protein, 11 aa, Influenza virus
WMCSNGSLQCT

SEQ ID NO: 542843 - protein, 11 aa, Influenza virus
WMCSNGSLQSK

SEQ ID NO: 542844 - protein, 11 aa, Influenza virus
WMCSNGSLRCR

SEQ ID NO: 542845 - protein, 11 aa, Influenza virus
WMCSNGSMQCK

SEQ ID NO: 542846 - protein, 11 aa, Influenza virus
WMCSNGSMQCN

SEQ ID NO: 542847 - protein, 11 aa, Influenza virus
WMCSNGSMQCR

SEQ ID NO: 542848 - protein, 11 aa, Influenza virus
WMCSNSSMQCR

SEQ ID NO: 542849 - protein, 11 aa, Influenza virus
WMDYYWGILKR

SEQ ID NO: 542850 - protein, 11 aa, Influenza virus
WMGRTISKDSR

SEQ ID NO: 542851 - protein, 11 aa, Influenza virus
WMGRTISMDSR

SEQ ID NO: 542852 - protein, 11 aa, Influenza virus
WMGRTISRDSR

SEQ ID NO: 542853 - protein, 11 aa, Influenza virus
WMKIIRVGCVI

SEQ ID NO: 542854 - protein, 11 aa, Influenza virus
WMKIYWHLMHP

SEQ ID NO: 542855 - protein, 11 aa, Influenza virus
WMKLYWHLMHP

SEQ ID NO: 542856 - protein, 11 aa, Influenza virus
WMKLYWHLMRP

SEQ ID NO: 542857 - protein, 11 aa, Influenza virus
WMKLYWHLMSP

SEQ ID NO: 542858 - protein, 11 aa, Influenza virus
WMLLDPGDTVT

SEQ ID NO: 542859 - protein, 11 aa, Influenza virus
WMMAMKYPITA

SEQ ID NO: 542860 - protein, 11 aa, Influenza virus
WMMAMRYPITA

SEQ ID NO: 542861 - protein, 11 aa, Influenza virus
WMRINNETILE

SEQ ID NO: 542862 - protein, 11 aa, Influenza virus
WMRISNETILE

SEQ ID NO: 542863 - protein, 11 aa, Influenza virus
WNENQNPRIFL

SEQ ID NO: 542864 - protein, 11 aa, Influenza virus
WNENQNPRMFL

SEQ ID NO: 542865 - protein, 11 aa, Influenza virus
WNENQNPRVFL

SEQ ID NO: 542866 - protein, 11 aa, Influenza virus
WNGVKVDGSSS

SEQ ID NO: 542867 - protein, 11 aa, Influenza virus
WNVSSSGTSKA

SEQ ID NO: 542868 - protein, 11 aa, Influenza virus
WNVTHTGTSKA

SEQ ID NO: 542869 - protein, 11 aa, Influenza virus
WNVTRSGTSKA

SEQ ID NO: 542870 - protein, 11 aa, Influenza virus
WNVTSSGTSKA

SEQ ID NO: 542871 - protein, 11 aa, Influenza virus
WNVTYTGISKA

SEQ ID NO: 542872 - protein, 11 aa, Influenza virus
WNVTYTGTSKA

SEQ ID NO: 542873 - protein, 11 aa, Influenza virus
WNVTYTGTSRA

SEQ ID NO: 542874 - protein, 11 aa, Influenza virus
WNWPDGAEIEY

SEQ ID NO: 542875 - protein, 11 aa, Influenza virus
WNWPDGAKIET

SEQ ID NO: 542876 - protein, 11 aa, Influenza virus
WNWPDGAKIEY

SEQ ID NO: 542877 - protein, 11 aa, Influenza virus
WPDGADINFMP

SEQ ID NO: 542878 - protein, 11 aa, Influenza virus
WPDGADINYMP

SEQ ID NO: 542879 - protein, 11 aa, Influenza virus
WPDGAEIEYFL

SEQ ID NO: 542880 - protein, 11 aa, Influenza virus
WPDGAKIEYFL

SEQ ID NO: 542881 - protein, 11 aa, Influenza virus
WPDGAKIKYFL

SEQ ID NO: 542882 - protein, 11 aa, Influenza virus
WPDGALLPFDI

SEQ ID NO: 542883 - protein, 11 aa, Influenza virus
WPDGANIDFMP

SEQ ID NO: 542884 - protein, 11 aa, Influenza virus
WPDGANIGFMP

SEQ ID NO: 542885 - protein, 11 aa, Influenza virus
WPDGANIGLCP

SEQ ID NO: 542886 - protein, 11 aa, Influenza virus
WPDGANINFMA

SEQ ID NO: 542887 - protein, 11 aa, Influenza virus
WPDGANINFMP

SEQ ID NO: 542888 - protein, 11 aa, Influenza virus
WPDGANINLMP

SEQ ID NO: 542889 - protein, 11 aa, Influenza virus
WPDGANTNFMP

SEQ ID NO: 542890 - protein, 11 aa, Influenza virus
WPDGSDIGFMP

SEQ ID NO: 542891 - protein, 11 aa, Influenza virus
WPDGSNIGFMP

SEQ ID NO: 542892 - protein, 11 aa, Influenza virus
WPDGSNIGLCP

SEQ ID NO: 542893 - protein, 11 aa, Influenza virus
WPGLINGWYGF

SEQ ID NO: 542894 - protein, 11 aa, Influenza virus
WPGLVAGWYGF

SEQ ID NO: 542895 - protein, 11 aa, Influenza virus
WPLSSPPTVYN

SEQ ID NO: 542896 - protein, 11 aa, Influenza virus
WPQSSPPTVYN

SEQ ID NO: 542897 - protein, 11 aa, Influenza virus
WQGANRPIIEI

SEQ ID NO: 542898 - protein, 11 aa, Influenza virus
WQGANRPVIEI

SEQ ID NO: 542899 - protein, 11 aa, Influenza virus
WQGANRPVIKI

SEQ ID NO: 542900 - protein, 11 aa, Influenza virus
WQGLIDGWYGF

SEQ ID NO: 542901 - protein, 11 aa, Influenza virus
WQGLVDGWYGY

SEQ ID NO: 542902 - protein, 11 aa, Influenza virus
WQGMIDGWYGY

SEQ ID NO: 542903 - protein, 11 aa, Influenza virus
WQGMVDGWYGF

SEQ ID NO: 542904 - protein, 11 aa, Influenza virus
WQGMVDGWYGY

SEQ ID NO: 542905 - protein, 11 aa, Influenza virus
WQGSNRPVIQI

SEQ ID NO: 542906 - protein, 11 aa, Influenza virus
WQGSNRPVIRI

SEQ ID NO: 542907 - protein, 11 aa, Influenza virus
WQGSNRPWIRF

SEQ ID NO: 542908 - protein, 11 aa, Influenza virus
WREQLSQKFEE

SEQ ID NO: 542909 - protein, 11 aa, Influenza virus
WRGANRPVITI

SEQ ID NO: 542910 - protein, 11 aa, Influenza virus
WRGGSINTKLP

SEQ ID NO: 542911 - protein, 11 aa, Influenza virus
WRGGSINTRLP

SEQ ID NO: 542912 - protein, 11 aa, Influenza virus
WRGSNRPIVDI

SEQ ID NO: 542913 - protein, 11 aa, Influenza virus
WRGSNRPWIRF

SEQ ID NO: 542914 - protein, 11 aa, Influenza virus
WRKDILRTQES

SEQ ID NO: 542915 - protein, 11 aa, Influenza virus
WRKKILRTQES

SEQ ID NO: 542916 - protein, 11 aa, Influenza virus
WRKQILRTQES

SEQ ID NO: 542917 - protein, 11 aa, Influenza virus
WRRDILRTQES

SEQ ID NO: 542918 - protein, 11 aa, Influenza virus
WRRQILRTQES

SEQ ID NO: 542919 - protein, 11 aa, Influenza virus
WSASACHDGAS

SEQ ID NO: 542920 - protein, 11 aa, Influenza virus
WSASACHDGIS

SEQ ID NO: 542921 - protein, 11 aa, Influenza virus
WSASACHDGSS

SEQ ID NO: 542922 - protein, 11 aa, Influenza virus
WSASACHDGTN

SEQ ID NO: 542923 - protein, 11 aa, Influenza virus
WSASACHDGTS

SEQ ID NO: 542924 - protein, 11 aa, Influenza virus
WSATACHDGKE

SEQ ID NO: 542925 - protein, 11 aa, Influenza virus
WSATACHDGKG

SEQ ID NO: 542926 - protein, 11 aa, Influenza virus
WSATACHDGKK

SEQ ID NO: 542927 - protein, 11 aa, Influenza virus
WSATACHDGRK

SEQ ID NO: 542928 - protein, 11 aa, Influenza virus
WSATACSDGPG

SEQ ID NO: 542929 - protein, 11 aa, Influenza virus
WSATACSDGSG

SEQ ID NO: 542930 - protein, 11 aa, Influenza virus
WSFALAQGALL

SEQ ID NO: 542931 - protein, 11 aa, Influenza virus
WSFALAQGALV

SEQ ID NO: 542932 - protein, 11 aa, Influenza virus
WSFALAQGTLL

SEQ ID NO: 542933 - protein, 11 aa, Influenza virus
WSFALAQGVLL

SEQ ID NO: 542934 - protein, 11 aa, Influenza virus
WSGLIAGWYGF

SEQ ID NO: 542935 - protein, 11 aa, Influenza virus
WSGLVAGWYGF

SEQ ID NO: 542936 - protein, 11 aa, Influenza virus
WSGMIDGWYGF

SEQ ID NO: 542937 - protein, 11 aa, Influenza virus
WSGYSGAFIDY

SEQ ID NO: 542938 - protein, 11 aa, Influenza virus
WSGYSGAFINY

SEQ ID NO: 542939 - protein, 11 aa, Influenza virus
WSGYSGAFMDY

SEQ ID NO: 542940 - protein, 11 aa, Influenza virus
WSGYSGAFTIP

SEQ ID NO: 542941 - protein, 11 aa, Influenza virus
WSGYSGAFTVP

SEQ ID NO: 542942 - protein, 11 aa, Influenza virus
WSGYSGAFVDY

SEQ ID NO: 542943 - protein, 11 aa, Influenza virus
WSGYSGIFSIE

SEQ ID NO: 542944 - protein, 11 aa, Influenza virus
WSGYSGIFSVE

SEQ ID NO: 542945 - protein, 11 aa, Influenza virus
WSGYSGSFIDY

SEQ ID NO: 542946 - protein, 11 aa, Influenza virus
WSGYSGSFIQH

SEQ ID NO: 542947 - protein, 11 aa, Influenza virus
WSGYSGSFMDY

SEQ ID NO: 542948 - protein, 11 aa, Influenza virus
WSGYSGSFSIR

SEQ ID NO: 542949 - protein, 11 aa, Influenza virus
WSGYSGSFTIP

SEQ ID NO: 542950 - protein, 11 aa, Influenza virus
WSGYSGSFTLP

SEQ ID NO: 542951 - protein, 11 aa, Influenza virus
WSGYSGSFVDY

SEQ ID NO: 542952 - protein, 11 aa, Influenza virus
WSGYSGSFVQH

SEQ ID NO: 542953 - protein, 11 aa, Influenza virus
WSGYSGVFSVE

SEQ ID NO: 542954 - protein, 11 aa, Influenza virus
WSHNILRTQES

SEQ ID NO: 542955 - protein, 11 aa, Influenza virus
WSKNILRTQES

SEQ ID NO: 542956 - protein, 11 aa, Influenza virus
WSKPQCHITGF

SEQ ID NO: 542957 - protein, 11 aa, Influenza virus
WSKPQCKITGF

SEQ ID NO: 542958 - protein, 11 aa, Influenza virus
WSKPQCQIAGF

SEQ ID NO: 542959 - protein, 11 aa, Influenza virus
WSKPQCQITGF

SEQ ID NO: 542960 - protein, 11 aa, Influenza virus
WSKRYELEIGA

SEQ ID NO: 542961 - protein, 11 aa, Influenza virus
WSKRYELEIGT

SEQ ID NO: 542962 - protein, 11 aa, Influenza virus
WSQNILKKQES

SEQ ID NO: 542963 - protein, 11 aa, Influenza virus
WSQNILRTQES

SEQ ID NO: 542964 - protein, 11 aa, Influenza virus
WSRRYELEIGT

SEQ ID NO: 542965 - protein, 11 aa, Influenza virus
WSRSSCHDGKA

SEQ ID NO: 542966 - protein, 11 aa, Influenza virus
WSSASCHDGRA

SEQ ID NO: 542967 - protein, 11 aa, Influenza virus
WSSSSCFDGKE

SEQ ID NO: 542968 - protein, 11 aa, Influenza virus
WSSSSCFDGRE

SEQ ID NO: 542969 - protein, 11 aa, Influenza virus
WSSSSCHDGKA

SEQ ID NO: 542970 - protein, 11 aa, Influenza virus
WSSSSCHDGKS

SEQ ID NO: 542971 - protein, 11 aa, Influenza virus
WSSSSCHDGNA

SEQ ID NO: 542972 - protein, 11 aa, Influenza virus
WSSSSCHDGRA

SEQ ID NO: 542973 - protein, 11 aa, Influenza virus
WSSSSCYDGKA

SEQ ID NO: 542974 - protein, 11 aa, Influenza virus
WSSTSCFDGKE

SEQ ID NO: 542975 - protein, 11 aa, Influenza virus
WSSTSCHDGIG

SEQ ID NO: 542976 - protein, 11 aa, Influenza virus
WSSTSCHDGKA

SEQ ID NO: 542977 - protein, 11 aa, Influenza virus
WSSTSCHDGKF

SEQ ID NO: 542978 - protein, 11 aa, Influenza virus
WSSTSCHDGKS

SEQ ID NO: 542979 - protein, 11 aa, Influenza virus
WSSTSCHDGKT

SEQ ID NO: 542980 - protein, 11 aa, Influenza virus
WSSTSCHDGRA

SEQ ID NO: 542981 - protein, 11 aa, Influenza virus
WSSTSCHDGVG

SEQ ID NO: 542982 - protein, 11 aa, Influenza virus
WSSTTCHDGIG

SEQ ID NO: 542983 - protein, 11 aa, Influenza virus
WSWDDGAILPF

SEQ ID NO: 542984 - protein, 11 aa, Influenza virus
WSWDDGAILPL

SEQ ID NO: 542985 - protein, 11 aa, Influenza virus
WSWHDGAEIIY

SEQ ID NO: 542986 - protein, 11 aa, Influenza virus
WSWHDGAEITY

SEQ ID NO: 542987 - protein, 11 aa, Influenza virus
WSWHDGAILPF

SEQ ID NO: 542988 - protein, 11 aa, Influenza virus
WSWHDGAILPL

SEQ ID NO: 542989 - protein, 11 aa, Influenza virus
WSWHDGAVLPF

SEQ ID NO: 542990 - protein, 11 aa, Influenza virus
WSWPDDAELPF

SEQ ID NO: 542991 - protein, 11 aa, Influenza virus
WSWPDDAELPL

SEQ ID NO: 542992 - protein, 11 aa, Influenza virus
WSWPDGADLPF

SEQ ID NO: 542993 - protein, 11 aa, Influenza virus
WSWPDGAELPF

SEQ ID NO: 542994 - protein, 11 aa, Influenza virus
WSWPDGAELPS

SEQ ID NO: 542995 - protein, 11 aa, Influenza virus
WSWPDGAEVPF

SEQ ID NO: 542996 - protein, 11 aa, Influenza virus
WSWPDGAKLPF

SEQ ID NO: 542997 - protein, 11 aa, Influenza virus
WSWPDGALFPL

SEQ ID NO: 542998 - protein, 11 aa, Influenza virus
WSWPDGALLPF

SEQ ID NO: 542999 - protein, 11 aa, Influenza virus
WSWPDGALLPL

SEQ ID NO: 543000 - protein, 11 aa, Influenza virus
WSWQDGAILPF

SEQ ID NO: 543001 - protein, 11 aa, Influenza virus
WSYIVERPKEI

SEQ ID NO: 543002 - protein, 11 aa, Influenza virus
WSYIVERPKEM

SEQ ID NO: 543003 - protein, 11 aa, Influenza virus
WSYIVERPSAP

SEQ ID NO: 543004 - protein, 11 aa, Influenza virus
WSYIVERTKEM

SEQ ID NO: 543005 - protein, 11 aa, Influenza virus
WSYLIEDPAAP

SEQ ID NO: 543006 - protein, 11 aa, Influenza virus
WSYLIEDPGAP

SEQ ID NO: 543007 - protein, 11 aa, Influenza virus
WSYLIEDPNAP

SEQ ID NO: 543008 - protein, 11 aa, Influenza virus
WSYLIEDPSAP

SEQ ID NO: 543009 - protein, 11 aa, Influenza virus
WSYLIEDPTAP

SEQ ID NO: 543010 - protein, 11 aa, Influenza virus
WSYNADLLVAM

SEQ ID NO: 543011 - protein, 11 aa, Influenza virus
WSYNADVLVAL

SEQ ID NO: 543012 - protein, 11 aa, Influenza virus
WSYNAEFLVAL

SEQ ID NO: 543013 - protein, 11 aa, Influenza virus
WSYNAEFLVAM

SEQ ID NO: 543014 - protein, 11 aa, Influenza virus
WSYNAEFLVAV

SEQ ID NO: 543015 - protein, 11 aa, Influenza virus
WSYNAEILVAL

SEQ ID NO: 543016 - protein, 11 aa, Influenza virus
WSYNAELLIAM

SEQ ID NO: 543017 - protein, 11 aa, Influenza virus
WSYNAELLVAI

SEQ ID NO: 543018 - protein, 11 aa, Influenza virus
WSYNAELLVAL

SEQ ID NO: 543019 - protein, 11 aa, Influenza virus
WSYNAELLVAM

SEQ ID NO: 543020 - protein, 11 aa, Influenza virus
WSYNAGLLVAL

SEQ ID NO: 543021 - protein, 11 aa, Influenza virus
WSYNAKLLVLI

SEQ ID NO: 543022 - protein, 11 aa, Influenza virus
WSYNAKLLVLL

SEQ ID NO: 543023 - protein, 11 aa, Influenza virus
WSYNAQLLVLL

SEQ ID NO: 543024 - protein, 11 aa, Influenza virus
WSYNAQLLVWL

SEQ ID NO: 543025 - protein, 11 aa, Influenza virus
WSYNARLLVLL

SEQ ID NO: 543026 - protein, 11 aa, Influenza virus
WTCSNGSCRCT

SEQ ID NO: 543027 - protein, 11 aa, Influenza virus
WTGLIDGWYGY

SEQ ID NO: 543028 - protein, 11 aa, Influenza virus
WTGMIDGWYGY

SEQ ID NO: 543029 - protein, 11 aa, Influenza virus
WTGMVDGWYGY

SEQ ID NO: 543030 - protein, 11 aa, Influenza virus
WTGMVNGWYGY

SEQ ID NO: 543031 - protein, 11 aa, Influenza virus
WTGTNRPILVI

SEQ ID NO: 543032 - protein, 11 aa, Influenza virus
WTGTNRPVLII

SEQ ID NO: 543033 - protein, 11 aa, Influenza virus
WTGTNRPVLMI

SEQ ID NO: 543034 - protein, 11 aa, Influenza virus
WTGTNRPVLVI

SEQ ID NO: 543035 - protein, 11 aa, Influenza virus
WTGTNRPVLVV

SEQ ID NO: 543036 - protein, 11 aa, Influenza virus
WTKDSITDIWT

SEQ ID NO: 543037 - protein, 11 aa, Influenza virus
WTLGENMAPEK

SEQ ID NO: 543038 - protein, 11 aa, Influenza virus
WTLNRNQPAAT

SEQ ID NO: 543039 - protein, 11 aa, Influenza virus
WTLVNPGDSII

SEQ ID NO: 543040 - protein, 11 aa, Influenza virus
WTPKRNRSILN

SEQ ID NO: 543041 - protein, 11 aa, Influenza virus
WTQDAMTEVWS

SEQ ID NO: 543042 - protein, 11 aa, Influenza virus
WTRDAMTEIWS

SEQ ID NO: 543043 - protein, 11 aa, Influenza virus
WTRDAMTEVWS

SEQ ID NO: 543044 - protein, 11 aa, Influenza virus
WTRDSITEVWS

SEQ ID NO: 543045 - protein, 11 aa, Influenza virus
WTRDSLTEIWS

SEQ ID NO: 543046 - protein, 11 aa, Influenza virus
WTRDSMTEIWS

SEQ ID NO: 543047 - protein, 11 aa, Influenza virus
WTRDSMTEVWS

SEQ ID NO: 543048 - protein, 11 aa, Influenza virus
WTRDSVTELWS

SEQ ID NO: 543049 - protein, 11 aa, Influenza virus
WTSGSIISFCG

SEQ ID NO: 543050 - protein, 11 aa, Influenza virus
WTSGSSIAFCG

SEQ ID NO: 543051 - protein, 11 aa, Influenza virus
WTSGSSISFCG

SEQ ID NO: 543052 - protein, 11 aa, Influenza virus
WTSNSIAVFCG

SEQ ID NO: 543053 - protein, 11 aa, Influenza virus
WTSNSIISMCS

SEQ ID NO: 543054 - protein, 11 aa, Influenza virus
WTSNSIIVFCG

SEQ ID NO: 543055 - protein, 11 aa, Influenza virus
WTSNSIVAFCG

SEQ ID NO: 543056 - protein, 11 aa, Influenza virus
WTSNSIVALCG

SEQ ID NO: 543057 - protein, 11 aa, Influenza virus
WTSNSIVSMCS

SEQ ID NO: 543058 - protein, 11 aa, Influenza virus
WTSNSIVTFCG

SEQ ID NO: 543059 - protein, 11 aa, Influenza virus
WTSNSIVVFCA

SEQ ID NO: 543060 - protein, 11 aa, Influenza virus
WTSNSIVVFCG

SEQ ID NO: 543061 - protein, 11 aa, Influenza virus
WTSNSLIALCG

SEQ ID NO: 543062 - protein, 11 aa, Influenza virus
WTSNSLVALCG

SEQ ID NO: 543063 - protein, 11 aa, Influenza virus
WTSNSMVTFCG

SEQ ID NO: 543064 - protein, 11 aa, Influenza virus
WTSNSVVVFCG

SEQ ID NO: 543065 - protein, 11 aa, Influenza virus
WTSSSIVVFCG

SEQ ID NO: 543066 - protein, 11 aa, Influenza virus
WTSSSSIVMCG

SEQ ID NO: 543067 - protein, 11 aa, Influenza virus
WTSSSSTVFCG

SEQ ID NO: 543068 - protein, 11 aa, Influenza virus
WTSSSSVVMCG

SEQ ID NO: 543069 - protein, 11 aa, Influenza virus
WTSTSIVVFCG

SEQ ID NO: 543070 - protein, 11 aa, Influenza virus
WTTNSIVVFCG

SEQ ID NO: 543071 - protein, 11 aa, Influenza virus
WTYNAELFVLM

SEQ ID NO: 543072 - protein, 11 aa, Influenza virus
WTYNAELLILL

SEQ ID NO: 543073 - protein, 11 aa, Influenza virus
WTYNAELLVLI

SEQ ID NO: 543074 - protein, 11 aa, Influenza virus
WTYNAELLVLL

SEQ ID NO: 543075 - protein, 11 aa, Influenza virus
WTYNAELLVLM

SEQ ID NO: 543076 - protein, 11 aa, Influenza virus
WTYNAEVLVLM

SEQ ID NO: 543077 - protein, 11 aa, Influenza virus
WTYNTELLVLM

SEQ ID NO: 543078 - protein, 11 aa, Influenza virus
WTYNVELLVLM

SEQ ID NO: 543079 - protein, 11 aa, Influenza virus
WTYQAELLIAM

SEQ ID NO: 543080 - protein, 11 aa, Influenza virus
WTYQAELLVAM

SEQ ID NO: 543081 - protein, 11 aa, Influenza virus
WTYQEELLVAM

SEQ ID NO: 543082 - protein, 11 aa, Influenza virus
WVAVAKDNAIR

SEQ ID NO: 543083 - protein, 11 aa, Influenza virus
WVCSNGSCRCT

SEQ ID NO: 543084 - protein, 11 aa, Influenza virus
WVDDAVTDIWS

SEQ ID NO: 543085 - protein, 11 aa, Influenza virus
WVELIRGQPKE

SEQ ID NO: 543086 - protein, 11 aa, Influenza virus
WVELIRGRPEE

SEQ ID NO: 543087 - protein, 11 aa, Influenza virus
WVELIRGRPKE

SEQ ID NO: 543088 - protein, 11 aa, Influenza virus
WVELVRGRPKE

SEQ ID NO: 543089 - protein, 11 aa, Influenza virus
WVEMIRGEPEE

SEQ ID NO: 543090 - protein, 11 aa, Influenza virus
WVEMIRGKPEE

SEQ ID NO: 543091 - protein, 11 aa, Influenza virus
WVEMIRGQPKE

SEQ ID NO: 543092 - protein, 11 aa, Influenza virus
WVEMIRGRPEE

SEQ ID NO: 543093 - protein, 11 aa, Influenza virus
WVETIRGKPEE

SEQ ID NO: 543094 - protein, 11 aa, Influenza virus
WVLGENMAPEK

SEQ ID NO: 543095 - protein, 11 aa, Influenza virus
WVLLNASWFNS

SEQ ID NO: 543096 - protein, 11 aa, Influenza virus
WVLWISFAISC

SEQ ID NO: 543097 - protein, 11 aa, Influenza virus
WVMREPYVSCN

SEQ ID NO: 543098 - protein, 11 aa, Influenza virus
WVMTDGPANKQ

SEQ ID NO: 543099 - protein, 11 aa, Influenza virus
WVMTDGPANNQ

SEQ ID NO: 543100 - protein, 11 aa, Influenza virus
WVMTDGPANRQ

SEQ ID NO: 543101 - protein, 11 aa, Influenza virus
WVMTDGPANSQ

SEQ ID NO: 543102 - protein, 11 aa, Influenza virus
WVMTDGPASNQ

SEQ ID NO: 543103 - protein, 11 aa, Influenza virus
WVPILNTSQRG

SEQ ID NO: 543104 - protein, 11 aa, Influenza virus
WVPKRNRSILN

SEQ ID NO: 543105 - protein, 11 aa, Influenza virus
WVQNEFNKACE

SEQ ID NO: 543106 - protein, 11 aa, Influenza virus
WVQSEFNKACE

SEQ ID NO: 543107 - protein, 11 aa, Influenza virus
WVRFNSDLDYQ

SEQ ID NO: 543108 - protein, 11 aa, Influenza virus
WVRINNETILE

SEQ ID NO: 543109 - protein, 11 aa, Influenza virus
WVRMNNETILE

SEQ ID NO: 543110 - protein, 11 aa, Influenza virus
WVSFSISCFLL

SEQ ID NO: 543111 - protein, 11 aa, Influenza virus
WVSTDKDSNGV

SEQ ID NO: 543112 - protein, 11 aa, Influenza virus
WVSTDKNSNGV

SEQ ID NO: 543113 - protein, 11 aa, Influenza virus
WVTADKDSNGV

SEQ ID NO: 543114 - protein, 11 aa, Influenza virus
WVTRELYVSCD

SEQ ID NO: 543115 - protein, 11 aa, Influenza virus
WVTREPYVSCD

SEQ ID NO: 543116 - protein, 11 aa, Influenza virus
WVTREPYVSCG

SEQ ID NO: 543117 - protein, 11 aa, Influenza virus
WVTREPYVSCS

SEQ ID NO: 543118 - protein, 11 aa, Influenza virus
WVTRESYVSCG

SEQ ID NO: 543119 - protein, 11 aa, Influenza virus
WVVIAKDNAIR

SEQ ID NO: 543120 - protein, 11 aa, Influenza virus
WVVIAKDNAVR

SEQ ID NO: 543121 - protein, 11 aa, Influenza virus
WVVIAQDNAIR

SEQ ID NO: 543122 - protein, 11 aa, Influenza virus
WVVIEKDNAVR

SEQ ID NO: 543123 - protein, 11 aa, Influenza virus
WVVVAKDNAIR

SEQ ID NO: 543124 - protein, 11 aa, Influenza virus
WVWLWLVLREK

SEQ ID NO: 543125 - protein, 11 aa, Influenza virus
WWASNSLIALC

SEQ ID NO: 543126 - protein, 11 aa, Influenza virus
WWDGLQSSDDF

SEQ ID NO: 543127 - protein, 11 aa, Influenza virus
WWTSNSIAVFC

SEQ ID NO: 543128 - protein, 11 aa, Influenza virus
WWTSNSIISMC

SEQ ID NO: 543129 - protein, 11 aa, Influenza virus
WWTSNSIIVFC

SEQ ID NO: 543130 - protein, 11 aa, Influenza virus
WWTSNSIVAFC

SEQ ID NO: 543131 - protein, 11 aa, Influenza virus
WWTSNSIVALC

SEQ ID NO: 543132 - protein, 11 aa, Influenza virus
WWTSNSIVSMC

SEQ ID NO: 543133 - protein, 11 aa, Influenza virus
WWTSNSIVVFC

SEQ ID NO: 543134 - protein, 11 aa, Influenza virus
WWTSNSLIALC

SEQ ID NO: 543135 - protein, 11 aa, Influenza virus
WWTSNSLVALC

SEQ ID NO: 543136 - protein, 11 aa, Influenza virus
WWTSSSIVVFC

SEQ ID NO: 543137 - protein, 11 aa, Influenza virus
WWTTNSIVVFC

SEQ ID NO: 543138 - protein, 11 aa, Influenza virus
WWVWLWLVLRE

SEQ ID NO: 543139 - protein, 11 aa, Influenza virus
WYGFHHSNAEG

SEQ ID NO: 543140 - protein, 11 aa, Influenza virus
WYGFHHSNSEG

SEQ ID NO: 543141 - protein, 11 aa, Influenza virus
WYGFKHQNAQG

SEQ ID NO: 543142 - protein, 11 aa, Influenza virus
WYGFQHQNAEG

SEQ ID NO: 543143 - protein, 11 aa, Influenza virus
WYGFQHQNEQG

SEQ ID NO: 543144 - protein, 11 aa, Influenza virus
WYGFQHQNSEG

SEQ ID NO: 543145 - protein, 11 aa, Influenza virus
WYGFQHRDEEG

SEQ ID NO: 543146 - protein, 11 aa, Influenza virus
WYGFQHRNEEG

SEQ ID NO: 543147 - protein, 11 aa, Influenza virus
WYGFQHSNAQG

SEQ ID NO: 543148 - protein, 11 aa, Influenza virus
WYGFQHSNDQG

SEQ ID NO: 543149 - protein, 11 aa, Influenza virus
WYGFQHSNEQG

SEQ ID NO: 543150 - protein, 11 aa, Influenza virus
WYGFQHTNDQG

SEQ ID NO: 543151 - protein, 11 aa, Influenza virus
WYGFRHHNSEG

SEQ ID NO: 543152 - protein, 11 aa, Influenza virus
WYGFRHLNSEG

SEQ ID NO: 543153 - protein, 11 aa, Influenza virus
WYGFRHQKAQG

SEQ ID NO: 543154 - protein, 11 aa, Influenza virus
WYGFRHQNAEG

SEQ ID NO: 543155 - protein, 11 aa, Influenza virus
WYGFRHQNAQG

SEQ ID NO: 543156 - protein, 11 aa, Influenza virus
WYGFRHQNSEG

SEQ ID NO: 543157 - protein, 11 aa, Influenza virus
WYGFRHQNSQG

SEQ ID NO: 543158 - protein, 11 aa, Influenza virus
WYGFRHQNTQG

SEQ ID NO: 543159 - protein, 11 aa, Influenza virus
WYGFRYQNSEG

SEQ ID NO: 543160 - protein, 11 aa, Influenza virus
WYGYHHENSQG

SEQ ID NO: 543161 - protein, 11 aa, Influenza virus
WYGYHHQNAQG

SEQ ID NO: 543162 - protein, 11 aa, Influenza virus
WYGYHHQNEQG

SEQ ID NO: 543163 - protein, 11 aa, Influenza virus
WYGYHHQNGQG

SEQ ID NO: 543164 - protein, 11 aa, Influenza virus
WYGYHHSNDQG

SEQ ID NO: 543165 - protein, 11 aa, Influenza virus
WYGYKHQNAQG

SEQ ID NO: 543166 - protein, 11 aa, Influenza virus
WYGYRHQNAQG

SEQ ID NO: 543167 - protein, 11 aa, Influenza virus
YAADKASTQKA

SEQ ID NO: 543168 - protein, 11 aa, Influenza virus
YAADKESTQKA

SEQ ID NO: 543169 - protein, 11 aa, Influenza virus
YAADKESTQRA

SEQ ID NO: 543170 - protein, 11 aa, Influenza virus
YAADKKSTQKA

SEQ ID NO: 543171 - protein, 11 aa, Influenza virus
YAADQESTQKA

SEQ ID NO: 543172 - protein, 11 aa, Influenza virus
YAADRESTQKA

SEQ ID NO: 543173 - protein, 11 aa, Influenza virus
YAADRESTQRA

SEQ ID NO: 543174 - protein, 11 aa, Influenza virus
YAADRKSTQKA

SEQ ID NO: 543175 - protein, 11 aa, Influenza virus
YAEESKLKRQE

SEQ ID NO: 543176 - protein, 11 aa, Influenza virus
YAEGQESPPKA

SEQ ID NO: 543177 - protein, 11 aa, Influenza virus
YAELIRGRPKE

SEQ ID NO: 543178 - protein, 11 aa, Influenza virus
YAELKWLISKS

SEQ ID NO: 543179 - protein, 11 aa, Influenza virus
YAELKWLVSKD

SEQ ID NO: 543180 - protein, 11 aa, Influenza virus
YAELKWLVSKN

SEQ ID NO: 543181 - protein, 11 aa, Influenza virus
YAELKWLVSKS

SEQ ID NO: 543182 - protein, 11 aa, Influenza virus
YAELKWLVSKT

SEQ ID NO: 543183 - protein, 11 aa, Influenza virus
YAEMKWLLSNA

SEQ ID NO: 543184 - protein, 11 aa, Influenza virus
YAEMKWLLSNN

SEQ ID NO: 543185 - protein, 11 aa, Influenza virus
YAEMKWLLSNS

SEQ ID NO: 543186 - protein, 11 aa, Influenza virus
YAEMKWLLSNT

SEQ ID NO: 543187 - protein, 11 aa, Influenza virus
YAEMKWLLSSS

SEQ ID NO: 543188 - protein, 11 aa, Influenza virus
YAEMKWLLSST

SEQ ID NO: 543189 - protein, 11 aa, Influenza virus
YALHQGTTIRN

SEQ ID NO: 543190 - protein, 11 aa, Influenza virus
YALSQGTTIRG

SEQ ID NO: 543191 - protein, 11 aa, Influenza virus
YAQTDCVLEAM

SEQ ID NO: 543192 - protein, 11 aa, Influenza virus
YARLYIWGVHH

SEQ ID NO: 543193 - protein, 11 aa, Influenza virus
YASKNPYTLVS

SEQ ID NO: 543194 - protein, 11 aa, Influenza virus
YASPQLEGFSA

SEQ ID NO: 543195 - protein, 11 aa, Influenza virus
YASSQLEGFSA

SEQ ID NO: 543196 - protein, 11 aa, Influenza virus
YATVAGSLSLA

SEQ ID NO: 543197 - protein, 11 aa, Influenza virus
YAVIHYGGIPT

SEQ ID NO: 543198 - protein, 11 aa, Influenza virus
YAVIHYGGMPT

SEQ ID NO: 543199 - protein, 11 aa, Influenza virus
YAVIHYGGVPT

SEQ ID NO: 543200 - protein, 11 aa, Influenza virus
YCICRDNWKGS

SEQ ID NO: 543201 - protein, 11 aa, Influenza virus
YCNTDLGAPLE

SEQ ID NO: 543202 - protein, 11 aa, Influenza virus
YCNTDLGSPLE

SEQ ID NO: 543203 - protein, 11 aa, Influenza virus
YCNTDLGTPLE

SEQ ID NO: 543204 - protein, 11 aa, Influenza virus
YCRATEYIMKG

SEQ ID NO: 543205 - protein, 11 aa, Influenza virus
YCSLNGISPIH

SEQ ID NO: 543206 - protein, 11 aa, Influenza virus
YCSLNGISPVH

SEQ ID NO: 543207 - protein, 11 aa, Influenza virus
YCSLNGVSPIH

SEQ ID NO: 543208 - protein, 11 aa, Influenza virus
YCSLNGVSPVH

SEQ ID NO: 543209 - protein, 11 aa, Influenza virus
YCVCRDNWKGS

SEQ ID NO: 543210 - protein, 11 aa, Influenza virus
YDAIEECLIND

SEQ ID NO: 543211 - protein, 11 aa, Influenza virus
YDAVATTHSWI

SEQ ID NO: 543212 - protein, 11 aa, Influenza virus
YDAVATTHSWT

SEQ ID NO: 543213 - protein, 11 aa, Influenza virus
YDAVATTHSWV

SEQ ID NO: 543214 - protein, 11 aa, Influenza virus
YDFEKEGYSLV

SEQ ID NO: 543215 - protein, 11 aa, Influenza virus
YDFEREGYSLV

SEQ ID NO: 543216 - protein, 11 aa, Influenza virus
YDHAQYREEAL

SEQ ID NO: 543217 - protein, 11 aa, Influenza virus
YDHKDYEEEAK

SEQ ID NO: 543218 - protein, 11 aa, Influenza virus
YDHKEFEEESK

SEQ ID NO: 543219 - protein, 11 aa, Influenza virus
YDHKEFEEESR

SEQ ID NO: 543220 - protein, 11 aa, Influenza virus
YDHKEFEKESK

SEQ ID NO: 543221 - protein, 11 aa, Influenza virus
YDHKEFEKESR

SEQ ID NO: 543222 - protein, 11 aa, Influenza virus
YDHKEFKEESK

SEQ ID NO: 543223 - protein, 11 aa, Influenza virus
YDHKEYEEEAK

SEQ ID NO: 543224 - protein, 11 aa, Influenza virus
YDHNIYRDEAI

SEQ ID NO: 543225 - protein, 11 aa, Influenza virus
YDHSQYREEAL

SEQ ID NO: 543226 - protein, 11 aa, Influenza virus
YDHTQYREEAL

SEQ ID NO: 543227 - protein, 11 aa, Influenza virus
YDKICIGYQTN

SEQ ID NO: 543228 - protein, 11 aa, Influenza virus
YDKVRLQLKDN

SEQ ID NO: 543229 - protein, 11 aa, Influenza virus
YDKVRLQLRDN

SEQ ID NO: 543230 - protein, 11 aa, Influenza virus
YDKVRMQLKDN

SEQ ID NO: 543231 - protein, 11 aa, Influenza virus
YDKVRMQLRDN

SEQ ID NO: 543232 - protein, 11 aa, Influenza virus
YDNGVWIGRTK

SEQ ID NO: 543233 - protein, 11 aa, Influenza virus
YDRICIGYQSN

SEQ ID NO: 543234 - protein, 11 aa, Influenza virus
YDRRLTTTIKT

SEQ ID NO: 543235 - protein, 11 aa, Influenza virus
YDRVRKQLRQN

SEQ ID NO: 543236 - protein, 11 aa, Influenza virus
YDRVRLQLRDN

SEQ ID NO: 543237 - protein, 11 aa, Influenza virus
YDRVRMQLRDN

SEQ ID NO: 543238 - protein, 11 aa, Influenza virus
YDSIRGEFNQV

SEQ ID NO: 543239 - protein, 11 aa, Influenza virus
YDSIRGEFSQV

SEQ ID NO: 543240 - protein, 11 aa, Influenza virus
YDVGYLCAGIP

SEQ ID NO: 543241 - protein, 11 aa, Influenza virus
YDWTLNRNQPA

SEQ ID NO: 543242 - protein, 11 aa, Influenza virus
YDYPKYEEESK

SEQ ID NO: 543243 - protein, 11 aa, Influenza virus
YDYPKYEEESR

SEQ ID NO: 543244 - protein, 11 aa, Influenza virus
YDYSKYEEESK

SEQ ID NO: 543245 - protein, 11 aa, Influenza virus
YEAIEECLIND

SEQ ID NO: 543246 - protein, 11 aa, Influenza virus
YEAVEECLIND

SEQ ID NO: 543247 - protein, 11 aa, Influenza virus
YEDESRIERQK

SEQ ID NO: 543248 - protein, 11 aa, Influenza virus
YEECSCYPDAG

SEQ ID NO: 543249 - protein, 11 aa, Influenza virus
YEECSCYPDAS

SEQ ID NO: 543250 - protein, 11 aa, Influenza virus
YEECSCYPDSG

SEQ ID NO: 543251 - protein, 11 aa, Influenza virus
YEECSCYPNAG

SEQ ID NO: 543252 - protein, 11 aa, Influenza virus
YEEEAKLEKSR

SEQ ID NO: 543253 - protein, 11 aa, Influenza virus
YEEEAKLERSK

SEQ ID NO: 543254 - protein, 11 aa, Influenza virus
YEEESKIERQK

SEQ ID NO: 543255 - protein, 11 aa, Influenza virus
YEEESKLERQK

SEQ ID NO: 543256 - protein, 11 aa, Influenza virus
YEEESKLERQR

SEQ ID NO: 543257 - protein, 11 aa, Influenza virus
YEEESKLKRNE

SEQ ID NO: 543258 - protein, 11 aa, Influenza virus
YEEESKLKRQE

SEQ ID NO: 543259 - protein, 11 aa, Influenza virus
YEEESKLNRNE

SEQ ID NO: 543260 - protein, 11 aa, Influenza virus
YEEESKLNRSE

SEQ ID NO: 543261 - protein, 11 aa, Influenza virus
YEEESKLNRTE

SEQ ID NO: 543262 - protein, 11 aa, Influenza virus
YEEESRIERQK

SEQ ID NO: 543263 - protein, 11 aa, Influenza virus
YEEESRLNRNE

SEQ ID NO: 543264 - protein, 11 aa, Influenza virus
YEELKEQLSTV

SEQ ID NO: 543265 - protein, 11 aa, Influenza virus
YEELKHLLNRI

SEQ ID NO: 543266 - protein, 11 aa, Influenza virus
YEELKHLLSRI

SEQ ID NO: 543267 - protein, 11 aa, Influenza virus
YEELKHLLSRT

SEQ ID NO: 543268 - protein, 11 aa, Influenza virus
YEELKHLLSST

SEQ ID NO: 543269 - protein, 11 aa, Influenza virus
YEELKHLMSST

SEQ ID NO: 543270 - protein, 11 aa, Influenza virus
YEELREHLSSV

SEQ ID NO: 543271 - protein, 11 aa, Influenza virus
YEELREQLSSV

SEQ ID NO: 543272 - protein, 11 aa, Influenza virus
YEELREQLSTV

SEQ ID NO: 543273 - protein, 11 aa, Influenza virus
YEKESKLNRNE

SEQ ID NO: 543274 - protein, 11 aa, Influenza virus
YEKVRLQLRDN

SEQ ID NO: 543275 - protein, 11 aa, Influenza virus
YEKVRMQLRDN

SEQ ID NO: 543276 - protein, 11 aa, Influenza virus
YEKVRRQLREN

SEQ ID NO: 543277 - protein, 11 aa, Influenza virus
YELEIGARIGE

SEQ ID NO: 543278 - protein, 11 aa, Influenza virus
YELEIGTRIGD

SEQ ID NO: 543279 - protein, 11 aa, Influenza virus
YELEIGTRIGE

SEQ ID NO: 543280 - protein, 11 aa, Influenza virus
YEMLKVPNALT

SEQ ID NO: 543281 - protein, 11 aa, Influenza virus
YENNTWGNQTY

SEQ ID NO: 543282 - protein, 11 aa, Influenza virus
YENNTWVNQTF

SEQ ID NO: 543283 - protein, 11 aa, Influenza virus
YENNTWVNQTY

SEQ ID NO: 543284 - protein, 11 aa, Influenza virus
YERMCNILKGK

SEQ ID NO: 543285 - protein, 11 aa, Influenza virus
YERRLTTTIKT

SEQ ID NO: 543286 - protein, 11 aa, Influenza virus
YERVKKQLREN

SEQ ID NO: 543287 - protein, 11 aa, Influenza virus
YERVKMFDFIK

SEQ ID NO: 543288 - protein, 11 aa, Influenza virus
YERVKMFDFSK

SEQ ID NO: 543289 - protein, 11 aa, Influenza virus
YERVKMFDFTK

SEQ ID NO: 543290 - protein, 11 aa, Influenza virus
YERVKRQLREN

SEQ ID NO: 543291 - protein, 11 aa, Influenza virus
YERVRKQLREN

SEQ ID NO: 543292 - protein, 11 aa, Influenza virus
YERVRKQLRQN

SEQ ID NO: 543293 - protein, 11 aa, Influenza virus
YERVRRQLREN

SEQ ID NO: 543294 - protein, 11 aa, Influenza virus
YESIEECLIND

SEQ ID NO: 543295 - protein, 11 aa, Influenza virus
YESTQAAIDQI

SEQ ID NO: 543296 - protein, 11 aa, Influenza virus
YETFKVIGGWS

SEQ ID NO: 543297 - protein, 11 aa, Influenza virus
YETFKVIGGWT

SEQ ID NO: 543298 - protein, 11 aa, Influenza virus
YETFRVIDGWT

SEQ ID NO: 543299 - protein, 11 aa, Influenza virus
YETFRVIGGWA

SEQ ID NO: 543300 - protein, 11 aa, Influenza virus
YETFRVIGGWT

SEQ ID NO: 543301 - protein, 11 aa, Influenza virus
YETFRVIGGWV

SEQ ID NO: 543302 - protein, 11 aa, Influenza virus
YETFRVISGWT

SEQ ID NO: 543303 - protein, 11 aa, Influenza virus
YEVGYLCAGIP

SEQ ID NO: 543304 - protein, 11 aa, Influenza virus
YEVLRVPNALT

SEQ ID NO: 543305 - protein, 11 aa, Influenza virus
YFFLKVPVQNA

SEQ ID NO: 543306 - protein, 11 aa, Influenza virus
YFHDSNVKNLY

SEQ ID NO: 543307 - protein, 11 aa, Influenza virus
YFHKGIVIKEE

SEQ ID NO: 543308 - protein, 11 aa, Influenza virus
YFHKGLIIKEE

SEQ ID NO: 543309 - protein, 11 aa, Influenza virus
YFHKGLLIKEE

SEQ ID NO: 543310 - protein, 11 aa, Influenza virus
YFHKGLVIKEE

SEQ ID NO: 543311 - protein, 11 aa, Influenza virus
YFHKGLVVKEE

SEQ ID NO: 543312 - protein, 11 aa, Influenza virus
YFQLFLVCVSL

SEQ ID NO: 543313 - protein, 11 aa, Influenza virus
YFTAEISHCRA

SEQ ID NO: 543314 - protein, 11 aa, Influenza virus
YFTAEVSHCRA

SEQ ID NO: 543315 - protein, 11 aa, Influenza virus
YFTAEVSYCRA

SEQ ID NO: 543316 - protein, 11 aa, Influenza virus
YFTEEVSHCRA

SEQ ID NO: 543317 - protein, 11 aa, Influenza virus
YFTTEVSHCRA

SEQ ID NO: 543318 - protein, 11 aa, Influenza virus
YFVKEGKIVHI

SEQ ID NO: 543319 - protein, 11 aa, Influenza virus
YGAGNKLITVG

SEQ ID NO: 543320 - protein, 11 aa, Influenza virus
YGAGSWPDGAN

SEQ ID NO: 543321 - protein, 11 aa, Influenza virus
YGAIEECLIND

SEQ ID NO: 543322 - protein, 11 aa, Influenza virus
YGAQSLSISVG

SEQ ID NO: 543323 - protein, 11 aa, Influenza virus
YGDGVWIGRTK

SEQ ID NO: 543324 - protein, 11 aa, Influenza virus
YGFHHSNAEGT

SEQ ID NO: 543325 - protein, 11 aa, Influenza virus
YGFHHSNSEGT

SEQ ID NO: 543326 - protein, 11 aa, Influenza virus
YGFIIKGRSHL

SEQ ID NO: 543327 - protein, 11 aa, Influenza virus
YGFIVKGRSHL

SEQ ID NO: 543328 - protein, 11 aa, Influenza virus
YGFKHQNAQGE

SEQ ID NO: 543329 - protein, 11 aa, Influenza virus
YGFKISKRGGS

SEQ ID NO: 543330 - protein, 11 aa, Influenza virus
YGFKISKRGNS

SEQ ID NO: 543331 - protein, 11 aa, Influenza virus
YGFKISKRGSS

SEQ ID NO: 543332 - protein, 11 aa, Influenza virus
YGFKISRRGNS

SEQ ID NO: 543333 - protein, 11 aa, Influenza virus
YGFQHQNAEGI

SEQ ID NO: 543334 - protein, 11 aa, Influenza virus
YGFQHQNAEGT

SEQ ID NO: 543335 - protein, 11 aa, Influenza virus
YGFQHQNEQGM

SEQ ID NO: 543336 - protein, 11 aa, Influenza virus
YGFQHQNEQGT

SEQ ID NO: 543337 - protein, 11 aa, Influenza virus
YGFQHQNEQGV

SEQ ID NO: 543338 - protein, 11 aa, Influenza virus
YGFQHQNSEGT

SEQ ID NO: 543339 - protein, 11 aa, Influenza virus
YGFQHRNDEGT

SEQ ID NO: 543340 - protein, 11 aa, Influenza virus
YGFQHRNEEGT

SEQ ID NO: 543341 - protein, 11 aa, Influenza virus
YGFRHQKAQGE

SEQ ID NO: 543342 - protein, 11 aa, Influenza virus
YGFRHQNAEGT

SEQ ID NO: 543343 - protein, 11 aa, Influenza virus
YGFRHQNAQGE

SEQ ID NO: 543344 - protein, 11 aa, Influenza virus
YGFRHQNAQGI

SEQ ID NO: 543345 - protein, 11 aa, Influenza virus
YGFRHQNAQGQ

SEQ ID NO: 543346 - protein, 11 aa, Influenza virus
YGFRHQNAQGT

SEQ ID NO: 543347 - protein, 11 aa, Influenza virus
YGFRHQNSEGT

SEQ ID NO: 543348 - protein, 11 aa, Influenza virus
YGFRHQNSQGE

SEQ ID NO: 543349 - protein, 11 aa, Influenza virus
YGFRHQNTQGE

SEQ ID NO: 543350 - protein, 11 aa, Influenza virus
YGFRISKRGSS

SEQ ID NO: 543351 - protein, 11 aa, Influenza virus
YGFVANFSMEL

SEQ ID NO: 543352 - protein, 11 aa, Influenza virus
YGGIPTDVVRS

SEQ ID NO: 543353 - protein, 11 aa, Influenza virus
YGGLNKSKPYY

SEQ ID NO: 543354 - protein, 11 aa, Influenza virus
YGGMPTDVVRS

SEQ ID NO: 543355 - protein, 11 aa, Influenza virus
YGGVPTDVIRS

SEQ ID NO: 543356 - protein, 11 aa, Influenza virus
YGGVPTDVMRS

SEQ ID NO: 543357 - protein, 11 aa, Influenza virus
YGGVPTDVVRS

SEQ ID NO: 543358 - protein, 11 aa, Influenza virus
YGHLITGKSHG

SEQ ID NO: 543359 - protein, 11 aa, Influenza virus
YGHLTTGKSHG

SEQ ID NO: 543360 - protein, 11 aa, Influenza virus
YGHLVTGKSHG

SEQ ID NO: 543361 - protein, 11 aa, Influenza virus
YGKDNAIRIGE

SEQ ID NO: 543362 - protein, 11 aa, Influenza virus
YGKDNAVRIGE

SEQ ID NO: 543363 - protein, 11 aa, Influenza virus
YGKGRIFQSHI

SEQ ID NO: 543364 - protein, 11 aa, Influenza virus
YGKGRIFQSPI

SEQ ID NO: 543365 - protein, 11 aa, Influenza virus
YGKGRIFQSRI

SEQ ID NO: 543366 - protein, 11 aa, Influenza virus
YGNCDAKCQTP

SEQ ID NO: 543367 - protein, 11 aa, Influenza virus
YGNCDTKCQTP

SEQ ID NO: 543368 - protein, 11 aa, Influenza virus
YGNCNAKCQTP

SEQ ID NO: 543369 - protein, 11 aa, Influenza virus
YGNCNTKCQTP

SEQ ID NO: 543370 - protein, 11 aa, Influenza virus
YGNDVWMGRTI

SEQ ID NO: 543371 - protein, 11 aa, Influenza virus
YGNGAWIGRTK

SEQ ID NO: 543372 - protein, 11 aa, Influenza virus
YGNGVWIGRTK

SEQ ID NO: 543373 - protein, 11 aa, Influenza virus
YGNGVWMGRTK

SEQ ID NO: 543374 - protein, 11 aa, Influenza virus
YGNPKCDIHLK

SEQ ID NO: 543375 - protein, 11 aa, Influenza virus
YGNPKCDIHLR

SEQ ID NO: 543376 - protein, 11 aa, Influenza virus
YGNPKCDTHLK

SEQ ID NO: 543377 - protein, 11 aa, Influenza virus
YGNPKCDVHLK

SEQ ID NO: 543378 - protein, 11 aa, Influenza virus
YGPALSINELG

SEQ ID NO: 543379 - protein, 11 aa, Influenza virus
YGPALSINELS

SEQ ID NO: 543380 - protein, 11 aa, Influenza virus
YGPALSISELS

SEQ ID NO: 543381 - protein, 11 aa, Influenza virus
YGPINVTKENT

SEQ ID NO: 543382 - protein, 11 aa, Influenza virus
YGRGRIFQSRI

SEQ ID NO: 543383 - protein, 11 aa, Influenza virus
YGRIIQNEDIP

SEQ ID NO: 543384 - protein, 11 aa, Influenza virus
YGSDVWMGRTI

SEQ ID NO: 543385 - protein, 11 aa, Influenza virus
YGSGRIFQSGV

SEQ ID NO: 543386 - protein, 11 aa, Influenza virus
YGSGSWPDGAD

SEQ ID NO: 543387 - protein, 11 aa, Influenza virus
YGTGNKLITVG

SEQ ID NO: 543388 - protein, 11 aa, Influenza virus
YGTGRIFQSGI

SEQ ID NO: 543389 - protein, 11 aa, Influenza virus
YGTGRIFQSGV

SEQ ID NO: 543390 - protein, 11 aa, Influenza virus
YGTGRIFQSRI

SEQ ID NO: 543391 - protein, 11 aa, Influenza virus
YGTGSWADGAN

SEQ ID NO: 543392 - protein, 11 aa, Influenza virus
YGTGSWPDGAD

SEQ ID NO: 543393 - protein, 11 aa, Influenza virus
YGTGSWPDGAE

SEQ ID NO: 543394 - protein, 11 aa, Influenza virus
YGTGSWPDGAN

SEQ ID NO: 543395 - protein, 11 aa, Influenza virus
YGTQPLSISVG

SEQ ID NO: 543396 - protein, 11 aa, Influenza virus
YGTQSLSISIG

SEQ ID NO: 543397 - protein, 11 aa, Influenza virus
YGTQSLSISVE

SEQ ID NO: 543398 - protein, 11 aa, Influenza virus
YGTQSLSISVG

SEQ ID NO: 543399 - protein, 11 aa, Influenza virus
YGVKGFGFRQG

SEQ ID NO: 543400 - protein, 11 aa, Influenza virus
YGVKGFSFRYG

SEQ ID NO: 543401 - protein, 11 aa, Influenza virus
YGYEMLKVPNA

SEQ ID NO: 543402 - protein, 11 aa, Influenza virus
YGYHHENSQGS

SEQ ID NO: 543403 - protein, 11 aa, Influenza virus
YGYHHQNAQGS

SEQ ID NO: 543404 - protein, 11 aa, Influenza virus
YGYHHQNEQGS

SEQ ID NO: 543405 - protein, 11 aa, Influenza virus
YGYHHQNGQGS

SEQ ID NO: 543406 - protein, 11 aa, Influenza virus
YGYHHSNDQGA

SEQ ID NO: 543407 - protein, 11 aa, Influenza virus
YGYHHSNDQGS

SEQ ID NO: 543408 - protein, 11 aa, Influenza virus
YGYIIEEYGKG

SEQ ID NO: 543409 - protein, 11 aa, Influenza virus
YGYIIEEYGRG

SEQ ID NO: 543410 - protein, 11 aa, Influenza virus
YGYIIEKYGSG

SEQ ID NO: 543411 - protein, 11 aa, Influenza virus
YGYIIEKYGTG

SEQ ID NO: 543412 - protein, 11 aa, Influenza virus
YGYKHQNAQGE

SEQ ID NO: 543413 - protein, 11 aa, Influenza virus
YGYLITGKSHG

SEQ ID NO: 543414 - protein, 11 aa, Influenza virus
YGYRHQNAQGE

SEQ ID NO: 543415 - protein, 11 aa, Influenza virus
YHANNSKKQID

SEQ ID NO: 543416 - protein, 11 aa, Influenza virus
YHANNSTDTID

SEQ ID NO: 543417 - protein, 11 aa, Influenza virus
YHANNSTDTVD

SEQ ID NO: 543418 - protein, 11 aa, Influenza virus
YHANNSTEQVD

SEQ ID NO: 543419 - protein, 11 aa, Influenza virus
YHANNSTETVD

SEQ ID NO: 543420 - protein, 11 aa, Influenza virus
YHANNSTKQID

SEQ ID NO: 543421 - protein, 11 aa, Influenza virus
YHANNSTKQVD

SEQ ID NO: 543422 - protein, 11 aa, Influenza virus
YHANNSTTKVD

SEQ ID NO: 543423 - protein, 11 aa, Influenza virus
YHANNSTTQID

SEQ ID NO: 543424 - protein, 11 aa, Influenza virus
YHANNSTTQVD

SEQ ID NO: 543425 - protein, 11 aa, Influenza virus
YHANNSTTQVN

SEQ ID NO: 543426 - protein, 11 aa, Influenza virus
YHFEECSCYPS

SEQ ID NO: 543427 - protein, 11 aa, Influenza virus
YHHENSQGSGY

SEQ ID NO: 543428 - protein, 11 aa, Influenza virus
YHHQNAQGSGY

SEQ ID NO: 543429 - protein, 11 aa, Influenza virus
YHHQNEQGSGY

SEQ ID NO: 543430 - protein, 11 aa, Influenza virus
YHHQNGQGSGY

SEQ ID NO: 543431 - protein, 11 aa, Influenza virus
YHHSNDQGAGY

SEQ ID NO: 543432 - protein, 11 aa, Influenza virus
YHHSNDQGSGY

SEQ ID NO: 543433 - protein, 11 aa, Influenza virus
YHKCDDECMDS

SEQ ID NO: 543434 - protein, 11 aa, Influenza virus
YHKCDDECMNS

SEQ ID NO: 543435 - protein, 11 aa, Influenza virus
YHKCDDECMSS

SEQ ID NO: 543436 - protein, 11 aa, Influenza virus
YHKCDNECMDS

SEQ ID NO: 543437 - protein, 11 aa, Influenza virus
YHKCNDECMNS

SEQ ID NO: 543438 - protein, 11 aa, Influenza virus
YHNSFVPVVGA

SEQ ID NO: 543439 - protein, 11 aa, Influenza virus
YHQIEKEFEQV

SEQ ID NO: 543440 - protein, 11 aa, Influenza virus
YHQIEKEFGQV

SEQ ID NO: 543441 - protein, 11 aa, Influenza virus
YHTGRSSFFRN

SEQ ID NO: 543442 - protein, 11 aa, Influenza virus
YHWNLALDIVD

SEQ ID NO: 543443 - protein, 11 aa, Influenza virus
YHYEECSCYPD

SEQ ID NO: 543444 - protein, 11 aa, Influenza virus
YHYEECSCYPN

SEQ ID NO: 543445 - protein, 11 aa, Influenza virus
YICSGFFGDNP

SEQ ID NO: 543446 - protein, 11 aa, Influenza virus
YICSGIFGDNP

SEQ ID NO: 543447 - protein, 11 aa, Influenza virus
YICSGLVGDTP

SEQ ID NO: 543448 - protein, 11 aa, Influenza virus
YICSGVFGDNP

SEQ ID NO: 543449 - protein, 11 aa, Influenza virus
YICSGVFGDSP

SEQ ID NO: 543450 - protein, 11 aa, Influenza virus
YICSGVFGDTP

SEQ ID NO: 543451 - protein, 11 aa, Influenza virus
YICSGVLGDNP

SEQ ID NO: 543452 - protein, 11 aa, Influenza virus
YICSKFHSDTP

SEQ ID NO: 543453 - protein, 11 aa, Influenza virus
YICSPVLTDNP

SEQ ID NO: 543454 - protein, 11 aa, Influenza virus
YICTGILTDTS

SEQ ID NO: 543455 - protein, 11 aa, Influenza virus
YICTGVLTDTS

SEQ ID NO: 543456 - protein, 11 aa, Influenza virus
YIEGKLSQMSK

SEQ ID NO: 543457 - protein, 11 aa, Influenza virus
YIEGKLSQMSR

SEQ ID NO: 543458 - protein, 11 aa, Influenza virus
YIEVLHLTQGA

SEQ ID NO: 543459 - protein, 11 aa, Influenza virus
YIEVLHLTQGT

SEQ ID NO: 543460 - protein, 11 aa, Influenza virus
YIGKCPKYIPS

SEQ ID NO: 543461 - protein, 11 aa, Influenza virus
YIGKCPKYISS

SEQ ID NO: 543462 - protein, 11 aa, Influenza virus
YIGKCPRYIPS

SEQ ID NO: 543463 - protein, 11 aa, Influenza virus
YIGNPVICMGH

SEQ ID NO: 543464 - protein, 11 aa, Influenza virus
YIIEEYGKGRI

SEQ ID NO: 543465 - protein, 11 aa, Influenza virus
YIIEEYGRGRI

SEQ ID NO: 543466 - protein, 11 aa, Influenza virus
YIIEKYGSGRI

SEQ ID NO: 543467 - protein, 11 aa, Influenza virus
YIIEKYGTGRI

SEQ ID NO: 543468 - protein, 11 aa, Influenza virus
YIIRALTLNTM

SEQ ID NO: 543469 - protein, 11 aa, Influenza virus
YIKQGSLKLAT

SEQ ID NO: 543470 - protein, 11 aa, Influenza virus
YIKQNTLKLAT

SEQ ID NO: 543471 - protein, 11 aa, Influenza virus
YIKSDQLKLAT

SEQ ID NO: 543472 - protein, 11 aa, Influenza virus
YIKSGQLKLAT

SEQ ID NO: 543473 - protein, 11 aa, Influenza virus
YILDEESRARI

SEQ ID NO: 543474 - protein, 11 aa, Influenza virus
YINKTGTFEFT

SEQ ID NO: 543475 - protein, 11 aa, Influenza virus
YINRTGTFEFT

SEQ ID NO: 543476 - protein, 11 aa, Influenza virus
YINTALLNASC

SEQ ID NO: 543477 - protein, 11 aa, Influenza virus
YINTALLNSSC

SEQ ID NO: 543478 - protein, 11 aa, Influenza virus
YINTAMLNASC

SEQ ID NO: 543479 - protein, 11 aa, Influenza virus
YIPSGSLKLAI

SEQ ID NO: 543480 - protein, 11 aa, Influenza virus
YIPSNSLKLAI

SEQ ID NO: 543481 - protein, 11 aa, Influenza virus
YIPSRSLKLAI

SEQ ID NO: 543482 - protein, 11 aa, Influenza virus
YIQMCTELKLN

SEQ ID NO: 543483 - protein, 11 aa, Influenza virus
YIQMCTELKLS

SEQ ID NO: 543484 - protein, 11 aa, Influenza virus
YIQMCTELQLS

SEQ ID NO: 543485 - protein, 11 aa, Influenza virus
YIRTNGTSKIK

SEQ ID NO: 543486 - protein, 11 aa, Influenza virus
YISSGSLKLAI

SEQ ID NO: 543487 - protein, 11 aa, Influenza virus
YIVERPKEIEG

SEQ ID NO: 543488 - protein, 11 aa, Influenza virus
YIVERPKEMEG

SEQ ID NO: 543489 - protein, 11 aa, Influenza virus
YIVERPSAPEG

SEQ ID NO: 543490 - protein, 11 aa, Influenza virus
YIVERTKEMEG

SEQ ID NO: 543491 - protein, 11 aa, Influenza virus
YIWGVHHPSTD

SEQ ID NO: 543492 - protein, 11 aa, Influenza virus
YIWTYQAELLV

SEQ ID NO: 543493 - protein, 11 aa, Influenza virus
YKALSIYSCIA

SEQ ID NO: 543494 - protein, 11 aa, Influenza virus
YKDIILWFSFG

SEQ ID NO: 543495 - protein, 11 aa, Influenza virus
YKDIILWISFS

SEQ ID NO: 543496 - protein, 11 aa, Influenza virus
YKDIILWVSFS

SEQ ID NO: 543497 - protein, 11 aa, Influenza virus
YKDVILWFSFG

SEQ ID NO: 543498 - protein, 11 aa, Influenza virus
YKDVILWFSLG

SEQ ID NO: 543499 - protein, 11 aa, Influenza virus
YKDVILWISFS

SEQ ID NO: 543500 - protein, 11 aa, Influenza virus
YKDWFLWISFA

SEQ ID NO: 543501 - protein, 11 aa, Influenza virus
YKDWILWISFA

SEQ ID NO: 543502 - protein, 11 aa, Influenza virus
YKDWVLWISFA

SEQ ID NO: 543503 - protein, 11 aa, Influenza virus
YKEESQLKRQE

SEQ ID NO: 543504 - protein, 11 aa, Influenza virus
YKEIILWFSFG

SEQ ID NO: 543505 - protein, 11 aa, Influenza virus
YKEVILWFSFG

SEQ ID NO: 543506 - protein, 11 aa, Influenza virus
YKGRLCNPLNP

SEQ ID NO: 543507 - protein, 11 aa, Influenza virus
YKILKIKKGKI

SEQ ID NO: 543508 - protein, 11 aa, Influenza virus
YKILKIKKGKL

SEQ ID NO: 543509 - protein, 11 aa, Influenza virus
YKILKIRKGKI

SEQ ID NO: 543510 - protein, 11 aa, Influenza virus
YKILSIYSCIA

SEQ ID NO: 543511 - protein, 11 aa, Influenza virus
YKILSIYSCVA

SEQ ID NO: 543512 - protein, 11 aa, Influenza virus
YKILSIYSSVA

SEQ ID NO: 543513 - protein, 11 aa, Influenza virus
YKILSIYSTVA

SEQ ID NO: 543514 - protein, 11 aa, Influenza virus
YKILTIYSTAA

SEQ ID NO: 543515 - protein, 11 aa, Influenza virus
YKILTIYSTVA

SEQ ID NO: 543516 - protein, 11 aa, Influenza virus
YKISKSTKSTV

SEQ ID NO: 543517 - protein, 11 aa, Influenza virus
YKKLKREITFH

SEQ ID NO: 543518 - protein, 11 aa, Influenza virus
YKKLKREMTFH

SEQ ID NO: 543519 - protein, 11 aa, Influenza virus
YKMNIQILILA

SEQ ID NO: 543520 - protein, 11 aa, Influenza virus
YKMNNQILILA

SEQ ID NO: 543521 - protein, 11 aa, Influenza virus
YKMNTKILVLA

SEQ ID NO: 543522 - protein, 11 aa, Influenza virus
YKMNTQILIFA

SEQ ID NO: 543523 - protein, 11 aa, Influenza virus
YKMNTQILIFT

SEQ ID NO: 543524 - protein, 11 aa, Influenza virus
YKMNTQILILA

SEQ ID NO: 543525 - protein, 11 aa, Influenza virus
YKMNTQILVFA

SEQ ID NO: 543526 - protein, 11 aa, Influenza virus
YKMNTRILILT

SEQ ID NO: 543527 - protein, 11 aa, Influenza virus
YKNANTLSSVN

SEQ ID NO: 543528 - protein, 11 aa, Influenza virus
YKNANTLSSVT

SEQ ID NO: 543529 - protein, 11 aa, Influenza virus
YKNANTLTSVT

SEQ ID NO: 543530 - protein, 11 aa, Influenza virus
YKNNTWVNQTY

SEQ ID NO: 543531 - protein, 11 aa, Influenza virus
YKNTNTLSSVT

SEQ ID NO: 543532 - protein, 11 aa, Influenza virus
YKNWILWISFA

SEQ ID NO: 543533 - protein, 11 aa, Influenza virus
YKRIRLFDYSG

SEQ ID NO: 543534 - protein, 11 aa, Influenza virus
YKRIRLFDYSK

SEQ ID NO: 543535 - protein, 11 aa, Influenza virus
YKRIRLFDYSR

SEQ ID NO: 543536 - protein, 11 aa, Influenza virus
YKRVRLFDYSR

SEQ ID NO: 543537 - protein, 11 aa, Influenza virus
YKSTPSAIDQI

SEQ ID NO: 543538 - protein, 11 aa, Influenza virus
YKSTQAAIDQI

SEQ ID NO: 543539 - protein, 11 aa, Influenza virus
YKSTQAAVDQI

SEQ ID NO: 543540 - protein, 11 aa, Influenza virus
YKSTQATIDQI

SEQ ID NO: 543541 - protein, 11 aa, Influenza virus
YKSTQKTIDQV

SEQ ID NO: 543542 - protein, 11 aa, Influenza virus
YKSTQSAIDQI

SEQ ID NO: 543543 - protein, 11 aa, Influenza virus
YKSTQSAIDQV

SEQ ID NO: 543544 - protein, 11 aa, Influenza virus
YKSTQSAINQI

SEQ ID NO: 543545 - protein, 11 aa, Influenza virus
YKSTQSAVDQI

SEQ ID NO: 543546 - protein, 11 aa, Influenza virus
YKSTQSAVNQI

SEQ ID NO: 543547 - protein, 11 aa, Influenza virus
YKSWSKPQCQI

SEQ ID NO: 543548 - protein, 11 aa, Influenza virus
YKVATGRVTVS

SEQ ID NO: 543549 - protein, 11 aa, Influenza virus
YKVGYLCAGIP

SEQ ID NO: 543550 - protein, 11 aa, Influenza virus
YKVLAIYSCIA

SEQ ID NO: 543551 - protein, 11 aa, Influenza virus
YKVLSIYSCIA

SEQ ID NO: 543552 - protein, 11 aa, Influenza virus
YKYGNGVWIGR

SEQ ID NO: 543553 - protein, 11 aa, Influenza virus
YKYKIFKNGKK

SEQ ID NO: 543554 - protein, 11 aa, Influenza virus
YLCAGIPSDTP

SEQ ID NO: 543555 - protein, 11 aa, Influenza virus
YLCAGIPTDTP

SEQ ID NO: 543556 - protein, 11 aa, Influenza virus
YLCAGLPSDTP

SEQ ID NO: 543557 - protein, 11 aa, Influenza virus
YLCSGLVADTP

SEQ ID NO: 543558 - protein, 11 aa, Influenza virus
YLCSGLVGDTP

SEQ ID NO: 543559 - protein, 11 aa, Influenza virus
YLCSKILTDTS

SEQ ID NO: 543560 - protein, 11 aa, Influenza virus
YLCSKTLTDTS

SEQ ID NO: 543561 - protein, 11 aa, Influenza virus
YLCSKVLTDTS

SEQ ID NO: 543562 - protein, 11 aa, Influenza virus
YLCSRILTDTS

SEQ ID NO: 543563 - protein, 11 aa, Influenza virus
YLCSRVLTDTS

SEQ ID NO: 543564 - protein, 11 aa, Influenza virus
YLCTGILTDTS

SEQ ID NO: 543565 - protein, 11 aa, Influenza virus
YLCTGVLTDTS

SEQ ID NO: 543566 - protein, 11 aa, Influenza virus
YLEEHPNAGKD

SEQ ID NO: 543567 - protein, 11 aa, Influenza virus
YLEEHPSAGKD

SEQ ID NO: 543568 - protein, 11 aa, Influenza virus
YLEEHPSAGRD

SEQ ID NO: 543569 - protein, 11 aa, Influenza virus
YLEEHPSTGKD

SEQ ID NO: 543570 - protein, 11 aa, Influenza virus
YLEENPSAGKD

SEQ ID NO: 543571 - protein, 11 aa, Influenza virus
YLEKYVEDTKI

SEQ ID NO: 543572 - protein, 11 aa, Influenza virus
YLELIRGRPQE

SEQ ID NO: 543573 - protein, 11 aa, Influenza virus
YLIEDPAAPHG

SEQ ID NO: 543574 - protein, 11 aa, Influenza virus
YLIEDPGAPHG

SEQ ID NO: 543575 - protein, 11 aa, Influenza virus
YLIEDPNAPHK

SEQ ID NO: 543576 - protein, 11 aa, Influenza virus
YLIEDPNAPNK

SEQ ID NO: 543577 - protein, 11 aa, Influenza virus
YLIEDPSAPHG

SEQ ID NO: 543578 - protein, 11 aa, Influenza virus
YLIEDPSAPHR

SEQ ID NO: 543579 - protein, 11 aa, Influenza virus
YLIEDPTAPHG

SEQ ID NO: 543580 - protein, 11 aa, Influenza virus
YLIGKTSWSYI

SEQ ID NO: 543581 - protein, 11 aa, Influenza virus
YLIRALTLNTM

SEQ ID NO: 543582 - protein, 11 aa, Influenza virus
YLIRTLTLNTM

SEQ ID NO: 543583 - protein, 11 aa, Influenza virus
YLITGKSHGRI

SEQ ID NO: 543584 - protein, 11 aa, Influenza virus
YLLFQDILMRM

SEQ ID NO: 543585 - protein, 11 aa, Influenza virus
YLLLNKSLCNV

SEQ ID NO: 543586 - protein, 11 aa, Influenza virus
YLLLNKSLCSV

SEQ ID NO: 543587 - protein, 11 aa, Influenza virus
YLMLNKSLCKI

SEQ ID NO: 543588 - protein, 11 aa, Influenza virus
YLMLNKSLCKV

SEQ ID NO: 543589 - protein, 11 aa, Influenza virus
YLMLSKSLCKV

SEQ ID NO: 543590 - protein, 11 aa, Influenza virus
YLNGREWSYIV

SEQ ID NO: 543591 - protein, 11 aa, Influenza virus
YLSGREWSYIV

SEQ ID NO: 543592 - protein, 11 aa, Influenza virus
YLSNNATDTVD

SEQ ID NO: 543593 - protein, 11 aa, Influenza virus
YLSNNSSDTVD

SEQ ID NO: 543594 - protein, 11 aa, Influenza virus
YLSNNSTDKID

SEQ ID NO: 543595 - protein, 11 aa, Influenza virus
YLSNNSTDKVD

SEQ ID NO: 543596 - protein, 11 aa, Influenza virus
YLSNNSTDTVD

SEQ ID NO: 543597 - protein, 11 aa, Influenza virus
YLSTNSSDKVD

SEQ ID NO: 543598 - protein, 11 aa, Influenza virus
YLSTNSSEKVD

SEQ ID NO: 543599 - protein, 11 aa, Influenza virus
YLSTNSSEKVN

SEQ ID NO: 543600 - protein, 11 aa, Influenza virus
YLSTNSSERVD

SEQ ID NO: 543601 - protein, 11 aa, Influenza virus
YLSTNSTEKVD

SEQ ID NO: 543602 - protein, 11 aa, Influenza virus
YLTGTWDTLIE

SEQ ID NO: 543603 - protein, 11 aa, Influenza virus
YLVLNKSLCKV

SEQ ID NO: 543604 - protein, 11 aa, Influenza virus
YLWGVHHPSSD

SEQ ID NO: 543605 - protein, 11 aa, Influenza virus
YMCSGLVGDTP

SEQ ID NO: 543606 - protein, 11 aa, Influenza virus
YMLERELVRKT

SEQ ID NO: 543607 - protein, 11 aa, Influenza virus
YMNTALLNASC

SEQ ID NO: 543608 - protein, 11 aa, Influenza virus
YNADLLVAMEN

SEQ ID NO: 543609 - protein, 11 aa, Influenza virus
YNADVLVALEN

SEQ ID NO: 543610 - protein, 11 aa, Influenza virus
YNAEFFVLMEN

SEQ ID NO: 543611 - protein, 11 aa, Influenza virus
YNAEFLVALEN

SEQ ID NO: 543612 - protein, 11 aa, Influenza virus
YNAEFLVAMEN

SEQ ID NO: 543613 - protein, 11 aa, Influenza virus
YNAEFLVAVEN

SEQ ID NO: 543614 - protein, 11 aa, Influenza virus
YNAEILVALEN

SEQ ID NO: 543615 - protein, 11 aa, Influenza virus
YNAEILVLMEN

SEQ ID NO: 543616 - protein, 11 aa, Influenza virus
YNAELFVLMEN

SEQ ID NO: 543617 - protein, 11 aa, Influenza virus
YNAELIVLLEN

SEQ ID NO: 543618 - protein, 11 aa, Influenza virus
YNAELLIALEN

SEQ ID NO: 543619 - protein, 11 aa, Influenza virus
YNAELLIAMEN

SEQ ID NO: 543620 - protein, 11 aa, Influenza virus
YNAELLILLEN

SEQ ID NO: 543621 - protein, 11 aa, Influenza virus
YNAELLVALEN

SEQ ID NO: 543622 - protein, 11 aa, Influenza virus
YNAELLVAMEN

SEQ ID NO: 543623 - protein, 11 aa, Influenza virus
YNAELLVLIEN

SEQ ID NO: 543624 - protein, 11 aa, Influenza virus
YNAELLVLLED

SEQ ID NO: 543625 - protein, 11 aa, Influenza virus
YNAELLVLLEN

SEQ ID NO: 543626 - protein, 11 aa, Influenza virus
YNAELLVLLGN

SEQ ID NO: 543627 - protein, 11 aa, Influenza virus
YNAELLVLMEN

SEQ ID NO: 543628 - protein, 11 aa, Influenza virus
YNAEVLVLMEN

SEQ ID NO: 543629 - protein, 11 aa, Influenza virus
YNAGLLVALEN

SEQ ID NO: 543630 - protein, 11 aa, Influenza virus
YNAKLLVLIEN

SEQ ID NO: 543631 - protein, 11 aa, Influenza virus
YNAKLLVLLEN

SEQ ID NO: 543632 - protein, 11 aa, Influenza virus
YNAQLLVLLEN

SEQ ID NO: 543633 - protein, 11 aa, Influenza virus
YNAQLLVWLEN

SEQ ID NO: 543634 - protein, 11 aa, Influenza virus
YNARLLVLLEN

SEQ ID NO: 543635 - protein, 11 aa, Influenza virus
YNETFVNMTNV

SEQ ID NO: 543636 - protein, 11 aa, Influenza virus
YNETFVNVTHV

SEQ ID NO: 543637 - protein, 11 aa, Influenza virus
YNETFVNVTNV

SEQ ID NO: 543638 - protein, 11 aa, Influenza virus
YNFEKEGYSLV

SEQ ID NO: 543639 - protein, 11 aa, Influenza virus
YNGIITDTFKS

SEQ ID NO: 543640 - protein, 11 aa, Influenza virus
YNGIITDTLKS

SEQ ID NO: 543641 - protein, 11 aa, Influenza virus
YNGKSLGIQSD

SEQ ID NO: 543642 - protein, 11 aa, Influenza virus
YNGQKSWMKIY

SEQ ID NO: 543643 - protein, 11 aa, Influenza virus
YNGQKSWTKIY

SEQ ID NO: 543644 - protein, 11 aa, Influenza virus
YNGQRSWMKIY

SEQ ID NO: 543645 - protein, 11 aa, Influenza virus
YNGVITDTLKS

SEQ ID NO: 543646 - protein, 11 aa, Influenza virus
YNHEDYKEESQ

SEQ ID NO: 543647 - protein, 11 aa, Influenza virus
YNHEDYREESQ

SEQ ID NO: 543648 - protein, 11 aa, Influenza virus
YNHKDYEEEAK

SEQ ID NO: 543649 - protein, 11 aa, Influenza virus
YNHKEYEEEAK

SEQ ID NO: 543650 - protein, 11 aa, Influenza virus
YNHTEYRQEAL

SEQ ID NO: 543651 - protein, 11 aa, Influenza virus
YNIRNLHIPEA

SEQ ID NO: 543652 - protein, 11 aa, Influenza virus
YNIRNLHIPEV

SEQ ID NO: 543653 - protein, 11 aa, Influenza virus
YNKIEFEPFQS

SEQ ID NO: 543654 - protein, 11 aa, Influenza virus
YNKLEFEPFQS

SEQ ID NO: 543655 - protein, 11 aa, Influenza virus
YNKMEFEPFQS

SEQ ID NO: 543656 - protein, 11 aa, Influenza virus
YNKTVINNITT

SEQ ID NO: 543657 - protein, 11 aa, Influenza virus
YNKVEFEPFQS

SEQ ID NO: 543658 - protein, 11 aa, Influenza virus
YNKVRMQLRDN

SEQ ID NO: 543659 - protein, 11 aa, Influenza virus
YNNTNGEQILI

SEQ ID NO: 543660 - protein, 11 aa, Influenza virus
YNNTSGEQMLI

SEQ ID NO: 543661 - protein, 11 aa, Influenza virus
YNNTSGEQMLV

SEQ ID NO: 543662 - protein, 11 aa, Influenza virus
YNNTSGEQVLV

SEQ ID NO: 543663 - protein, 11 aa, Influenza virus
YNNTTGRDVLV

SEQ ID NO: 543664 - protein, 11 aa, Influenza virus
YNNTVINNITT

SEQ ID NO: 543665 - protein, 11 aa, Influenza virus
YNNTVVNNITT

SEQ ID NO: 543666 - protein, 11 aa, Influenza virus
YNPCFYVELIR

SEQ ID NO: 543667 - protein, 11 aa, Influenza virus
YNRKEYEEEAK

SEQ ID NO: 543668 - protein, 11 aa, Influenza virus
YNRRLTTTIKP

SEQ ID NO: 543669 - protein, 11 aa, Influenza virus
YNRRLTTTIKT

SEQ ID NO: 543670 - protein, 11 aa, Influenza virus
YNRRPTTTIKT

SEQ ID NO: 543671 - protein, 11 aa, Influenza virus
YNSKFESVAWS

SEQ ID NO: 543672 - protein, 11 aa, Influenza virus
YNSRFESVAWS

SEQ ID NO: 543673 - protein, 11 aa, Influenza virus
YNSTVVNNITT

SEQ ID NO: 543674 - protein, 11 aa, Influenza virus
YNTELLVLMEN

SEQ ID NO: 543675 - protein, 11 aa, Influenza virus
YNVELLVLMEN

SEQ ID NO: 543676 - protein, 11 aa, Influenza virus
YNVGYLCAGIP

SEQ ID NO: 543677 - protein, 11 aa, Influenza virus
YNYPKYEEESR

SEQ ID NO: 543678 - protein, 11 aa, Influenza virus
YPDVRCICRDN

SEQ ID NO: 543679 - protein, 11 aa, Influenza virus
YPDVRCTCRDN

SEQ ID NO: 543680 - protein, 11 aa, Influenza virus
YPDVRCVCRDN

SEQ ID NO: 543681 - protein, 11 aa, Influenza virus
YPFDVPDYQSL

SEQ ID NO: 543682 - protein, 11 aa, Influenza virus
YPGATINEEAL

SEQ ID NO: 543683 - protein, 11 aa, Influenza virus
YPGATVNEEAL

SEQ ID NO: 543684 - protein, 11 aa, Influenza virus
YPGATVNEGAL

SEQ ID NO: 543685 - protein, 11 aa, Influenza virus
YPGELDNNGEL

SEQ ID NO: 543686 - protein, 11 aa, Influenza virus
YPGELNNNGEL

SEQ ID NO: 543687 - protein, 11 aa, Influenza virus
YPGEVDNNGEL

SEQ ID NO: 543688 - protein, 11 aa, Influenza virus
YPGFVENLEEL

SEQ ID NO: 543689 - protein, 11 aa, Influenza virus
YPGKFTNEEAL

SEQ ID NO: 543690 - protein, 11 aa, Influenza virus
YPGNFNDYEEL

SEQ ID NO: 543691 - protein, 11 aa, Influenza virus
YPGNNNGVKGF

SEQ ID NO: 543692 - protein, 11 aa, Influenza virus
YPGNNNKGVKG

SEQ ID NO: 543693 - protein, 11 aa, Influenza virus
YPGNNNNGVKG

SEQ ID NO: 543694 - protein, 11 aa, Influenza virus
YPGRFTNEEAL

SEQ ID NO: 543695 - protein, 11 aa, Influenza virus
YPGSFNDYEEL

SEQ ID NO: 543696 - protein, 11 aa, Influenza virus
YPGSFNNYEEL

SEQ ID NO: 543697 - protein, 11 aa, Influenza virus
YPGSIENLEEL

SEQ ID NO: 543698 - protein, 11 aa, Influenza virus
YPGSIENQEEL

SEQ ID NO: 543699 - protein, 11 aa, Influenza virus
YPGSIKNQEEL

SEQ ID NO: 543700 - protein, 11 aa, Influenza virus
YPGSLNDYEEL

SEQ ID NO: 543701 - protein, 11 aa, Influenza virus
YPGSNNNGVKG

SEQ ID NO: 543702 - protein, 11 aa, Influenza virus
YPGSTVNEEAL

SEQ ID NO: 543703 - protein, 11 aa, Influenza virus
YPGSVENLEEL

SEQ ID NO: 543704 - protein, 11 aa, Influenza virus
YPGSVENQEEL

SEQ ID NO: 543705 - protein, 11 aa, Influenza virus
YPGTTVNEEAL

SEQ ID NO: 543706 - protein, 11 aa, Influenza virus
YPGVRCICRDN

SEQ ID NO: 543707 - protein, 11 aa, Influenza virus
YPKYEEESKLK

SEQ ID NO: 543708 - protein, 11 aa, Influenza virus
YPKYEEESKLN

SEQ ID NO: 543709 - protein, 11 aa, Influenza virus
YPKYEEESRLN

SEQ ID NO: 543710 - protein, 11 aa, Influenza virus
YPNDGKVECVC

SEQ ID NO: 543711 - protein, 11 aa, Influenza virus
YPNEGKVECIC

SEQ ID NO: 543712 - protein, 11 aa, Influenza virus
YPNEGKVECVC

SEQ ID NO: 543713 - protein, 11 aa, Influenza virus
YPNLCQVECVC

SEQ ID NO: 543714 - protein, 11 aa, Influenza virus
YPNLGKVECVC

SEQ ID NO: 543715 - protein, 11 aa, Influenza virus
YPNLGQVECVC

SEQ ID NO: 543716 - protein, 11 aa, Influenza virus
YPNMGKVECVC

SEQ ID NO: 543717 - protein, 11 aa, Influenza virus
YPNNGKVECIC

SEQ ID NO: 543718 - protein, 11 aa, Influenza virus
YPNSGKVECVC

SEQ ID NO: 543719 - protein, 11 aa, Influenza virus
YPNVRCVCRDN

SEQ ID NO: 543720 - protein, 11 aa, Influenza virus
YPQYPNVRCVC

SEQ ID NO: 543721 - protein, 11 aa, Influenza virus
YPRYPDVRCVC

SEQ ID NO: 543722 - protein, 11 aa, Influenza virus
YPRYPNVRCVC

SEQ ID NO: 543723 - protein, 11 aa, Influenza virus
YQAELLIAMEN

SEQ ID NO: 543724 - protein, 11 aa, Influenza virus
YQAELLVAMEN

SEQ ID NO: 543725 - protein, 11 aa, Influenza virus
YQAKFEAVAWS

SEQ ID NO: 543726 - protein, 11 aa, Influenza virus
YQAKFESVAWS

SEQ ID NO: 543727 - protein, 11 aa, Influenza virus
YQARFEAVAWS

SEQ ID NO: 543728 - protein, 11 aa, Influenza virus
YQARFESVAWS

SEQ ID NO: 543729 - protein, 11 aa, Influenza virus
YQFALGHGTTL

SEQ ID NO: 543730 - protein, 11 aa, Influenza virus
YQFALGQGATL

SEQ ID NO: 543731 - protein, 11 aa, Influenza virus
YQFALGQGTTL

SEQ ID NO: 543732 - protein, 11 aa, Influenza virus
YQGRLCNPLNP

SEQ ID NO: 543733 - protein, 11 aa, Influenza virus
YQGRLCNPMNP

SEQ ID NO: 543734 - protein, 11 aa, Influenza virus
YQIGNVINWTK

SEQ ID NO: 543735 - protein, 11 aa, Influenza virus
YQIGYICSGVF

SEQ ID NO: 543736 - protein, 11 aa, Influenza virus
YQIGYVCSGIF

SEQ ID NO: 543737 - protein, 11 aa, Influenza virus
YQIGYVCSGVF

SEQ ID NO: 543738 - protein, 11 aa, Influenza virus
YQILAIYATVA

SEQ ID NO: 543739 - protein, 11 aa, Influenza virus
YQILAIYSTAA

SEQ ID NO: 543740 - protein, 11 aa, Influenza virus
YQILAIYSTVA

SEQ ID NO: 543741 - protein, 11 aa, Influenza virus
YQILAIYSTVS

SEQ ID NO: 543742 - protein, 11 aa, Influenza virus
YQILSIYSTAA

SEQ ID NO: 543743 - protein, 11 aa, Influenza virus
YQILSIYSTVA

SEQ ID NO: 543744 - protein, 11 aa, Influenza virus
YQILSIYSTVS

SEQ ID NO: 543745 - protein, 11 aa, Influenza virus
YQILSIYSTVT

SEQ ID NO: 543746 - protein, 11 aa, Influenza virus
YQILSIYSTVV

SEQ ID NO: 543747 - protein, 11 aa, Influenza virus
YQKCCNLFEKF

SEQ ID NO: 543748 - protein, 11 aa, Influenza virus
YQKCCSLFEKF

SEQ ID NO: 543749 - protein, 11 aa, Influenza virus
YQKCCTLFEKF

SEQ ID NO: 543750 - protein, 11 aa, Influenza virus
YQKQMTRGLFG

SEQ ID NO: 543751 - protein, 11 aa, Influenza virus
YQKRMGLQMQR

SEQ ID NO: 543752 - protein, 11 aa, Influenza virus
YQKRMGVQIQR

SEQ ID NO: 543753 - protein, 11 aa, Influenza virus
YQKRMGVQLQR

SEQ ID NO: 543754 - protein, 11 aa, Influenza virus
YQKRMGVQMHR

SEQ ID NO: 543755 - protein, 11 aa, Influenza virus
YQKRMGVQMQR

SEQ ID NO: 543756 - protein, 11 aa, Influenza virus
YQKRMTRGLFG

SEQ ID NO: 543757 - protein, 11 aa, Influenza virus
YQNNFVPVVGA

SEQ ID NO: 543758 - protein, 11 aa, Influenza virus
YQNSFVPVVGA

SEQ ID NO: 543759 - protein, 11 aa, Influenza virus
YQQSFSPSPGA

SEQ ID NO: 543760 - protein, 11 aa, Influenza virus
YQQSFSPSPGD

SEQ ID NO: 543761 - protein, 11 aa, Influenza virus
YQRCCNLFEKF

SEQ ID NO: 543762 - protein, 11 aa, Influenza virus
YQRTRALVRSG

SEQ ID NO: 543763 - protein, 11 aa, Influenza virus
YQRTRALVRTG

SEQ ID NO: 543764 - protein, 11 aa, Influenza virus
YQSIRSILANN

SEQ ID NO: 543765 - protein, 11 aa, Influenza virus
YQSLRSILANN

SEQ ID NO: 543766 - protein, 11 aa, Influenza virus
YQSLRSILASS

SEQ ID NO: 543767 - protein, 11 aa, Influenza virus
YQSNNSTDTVD

SEQ ID NO: 543768 - protein, 11 aa, Influenza virus
YQSNNSTDTVN

SEQ ID NO: 543769 - protein, 11 aa, Influenza virus
YQSNNSTNTVN

SEQ ID NO: 543770 - protein, 11 aa, Influenza virus
YQSRFEAVAWS

SEQ ID NO: 543771 - protein, 11 aa, Influenza virus
YQTNNSTDTVN

SEQ ID NO: 543772 - protein, 11 aa, Influenza virus
YQTNNSTETVN

SEQ ID NO: 543773 - protein, 11 aa, Influenza virus
YQVLAIYATVA

SEQ ID NO: 543774 - protein, 11 aa, Influenza virus
YRACFYVELIR

SEQ ID NO: 543775 - protein, 11 aa, Influenza virus
YRALISWEMGQ

SEQ ID NO: 543776 - protein, 11 aa, Influenza virus
YRALISWPLSS

SEQ ID NO: 543777 - protein, 11 aa, Influenza virus
YRALISWPQSS

SEQ ID NO: 543778 - protein, 11 aa, Influenza virus
YRALMSVLLGS

SEQ ID NO: 543779 - protein, 11 aa, Influenza virus
YRALMSVPLGS

SEQ ID NO: 543780 - protein, 11 aa, Influenza virus
YRALSIYSCIA

SEQ ID NO: 543781 - protein, 11 aa, Influenza virus
YRALVSWPLSS

SEQ ID NO: 543782 - protein, 11 aa, Influenza virus
YRDDAINNRFQ

SEQ ID NO: 543783 - protein, 11 aa, Influenza virus
YRDEAINNRFQ

SEQ ID NO: 543784 - protein, 11 aa, Influenza virus
YRDEAINNRIK

SEQ ID NO: 543785 - protein, 11 aa, Influenza virus
YRDEAINSRFQ

SEQ ID NO: 543786 - protein, 11 aa, Influenza virus
YRDEAISNRFQ

SEQ ID NO: 543787 - protein, 11 aa, Influenza virus
YRDEALNNRFQ

SEQ ID NO: 543788 - protein, 11 aa, Influenza virus
YRDEALNNRSQ

SEQ ID NO: 543789 - protein, 11 aa, Influenza virus
YRDEALSNRFQ

SEQ ID NO: 543790 - protein, 11 aa, Influenza virus
YRDEAVNNRFQ

SEQ ID NO: 543791 - protein, 11 aa, Influenza virus
YRDNWKGSNRP

SEQ ID NO: 543792 - protein, 11 aa, Influenza virus
YRDWSKPQCQI

SEQ ID NO: 543793 - protein, 11 aa, Influenza virus
YREEALLNRLN

SEQ ID NO: 543794 - protein, 11 aa, Influenza virus
YREEALLNRLS

SEQ ID NO: 543795 - protein, 11 aa, Influenza virus
YREEALLSRLN

SEQ ID NO: 543796 - protein, 11 aa, Influenza virus
YREEAMQNRIQ

SEQ ID NO: 543797 - protein, 11 aa, Influenza virus
YREESLLNRLS

SEQ ID NO: 543798 - protein, 11 aa, Influenza virus
YREESQLKKQE

SEQ ID NO: 543799 - protein, 11 aa, Influenza virus
YREESQLKRQE

SEQ ID NO: 543800 - protein, 11 aa, Influenza virus
YRGRLCNPLNP

SEQ ID NO: 543801 - protein, 11 aa, Influenza virus
YRICKLVGINM

SEQ ID NO: 543802 - protein, 11 aa, Influenza virus
YRILSIYSTVA

SEQ ID NO: 543803 - protein, 11 aa, Influenza virus
YRIWSKPQCQI

SEQ ID NO: 543804 - protein, 11 aa, Influenza virus
YRKEAMQNRIQ

SEQ ID NO: 543805 - protein, 11 aa, Influenza virus
YRKLKREITFH

SEQ ID NO: 543806 - protein, 11 aa, Influenza virus
YRKRMTRGLFG

SEQ ID NO: 543807 - protein, 11 aa, Influenza virus
YRNEAINNRFQ

SEQ ID NO: 543808 - protein, 11 aa, Influenza virus
YRNEALNNRFQ

SEQ ID NO: 543809 - protein, 11 aa, Influenza virus
YRNMRWLTLKS

SEQ ID NO: 543810 - protein, 11 aa, Influenza virus
YRNNRKEPALI

SEQ ID NO: 543811 - protein, 11 aa, Influenza virus
YRNTRKEPALI

SEQ ID NO: 543812 - protein, 11 aa, Influenza virus
YRNWSKPQCQI

SEQ ID NO: 543813 - protein, 11 aa, Influenza virus
YRQEALQNRIM

SEQ ID NO: 543814 - protein, 11 aa, Influenza virus
YRQSFSPSPGA

SEQ ID NO: 543815 - protein, 11 aa, Influenza virus
YRRPIGISSMV

SEQ ID NO: 543816 - protein, 11 aa, Influenza virus
YRRPVGISSMG

SEQ ID NO: 543817 - protein, 11 aa, Influenza virus
YRRPVGISSMM

SEQ ID NO: 543818 - protein, 11 aa, Influenza virus
YRRPVGISSMV

SEQ ID NO: 543819 - protein, 11 aa, Influenza virus
YRSINWLTKKE

SEQ ID NO: 543820 - protein, 11 aa, Influenza virus
YRSINWLTKKK

SEQ ID NO: 543821 - protein, 11 aa, Influenza virus
YRSIRWLTLKS

SEQ ID NO: 543822 - protein, 11 aa, Influenza virus
YRSLIQFPIGT

SEQ ID NO: 543823 - protein, 11 aa, Influenza virus
YRSLIQFPMGT

SEQ ID NO: 543824 - protein, 11 aa, Influenza virus
YRSLIRFPIGT

SEQ ID NO: 543825 - protein, 11 aa, Influenza virus
YRSLIRFPIGV

SEQ ID NO: 543826 - protein, 11 aa, Influenza virus
YRSLIRFPVGT

SEQ ID NO: 543827 - protein, 11 aa, Influenza virus
YRSLISWPLSS

SEQ ID NO: 543828 - protein, 11 aa, Influenza virus
YRSMKWLTLKS

SEQ ID NO: 543829 - protein, 11 aa, Influenza virus
YRSMRWLTLKL

SEQ ID NO: 543830 - protein, 11 aa, Influenza virus
YRSMRWLTLKS

SEQ ID NO: 543831 - protein, 11 aa, Influenza virus
YRSWSKPQCQI

SEQ ID NO: 543832 - protein, 11 aa, Influenza virus
YRTCKLLGINM

SEQ ID NO: 543833 - protein, 11 aa, Influenza virus
YRTCKLVGINM

SEQ ID NO: 543834 - protein, 11 aa, Influenza virus
YRTESLQNRIQ

SEQ ID NO: 543835 - protein, 11 aa, Influenza virus
YRTLLMNELGI

SEQ ID NO: 543836 - protein, 11 aa, Influenza virus
YRTLLMNELGV

SEQ ID NO: 543837 - protein, 11 aa, Influenza virus
YRTLLMSELGV

SEQ ID NO: 543838 - protein, 11 aa, Influenza virus
YRYGFVANFSM

SEQ ID NO: 543839 - protein, 11 aa, Influenza virus
YRYTYRCHKGD

SEQ ID NO: 543840 - protein, 11 aa, Influenza virus
YRYTYRCHRGD

SEQ ID NO: 543841 - protein, 11 aa, Influenza virus
YSAGALASCMG

SEQ ID NO: 543842 - protein, 11 aa, Influenza virus
YSCIASSIVLV

SEQ ID NO: 543843 - protein, 11 aa, Influenza virus
YSCIASSIVMV

SEQ ID NO: 543844 - protein, 11 aa, Influenza virus
YSCIASSLILA

SEQ ID NO: 543845 - protein, 11 aa, Influenza virus
YSCIASSLVLA

SEQ ID NO: 543846 - protein, 11 aa, Influenza virus
YSCIASSTVLV

SEQ ID NO: 543847 - protein, 11 aa, Influenza virus
YSCIASSTVMV

SEQ ID NO: 543848 - protein, 11 aa, Influenza virus
YSCIASSVVLV

SEQ ID NO: 543849 - protein, 11 aa, Influenza virus
YSCVASSLVLA

SEQ ID NO: 543850 - protein, 11 aa, Influenza virus
YSEMKWLLSSK

SEQ ID NO: 543851 - protein, 11 aa, Influenza virus
YSEMKWLSSSG

SEQ ID NO: 543852 - protein, 11 aa, Influenza virus
YSEMKWLSSSM

SEQ ID NO: 543853 - protein, 11 aa, Influenza virus
YSGFVRTLFQQ

SEQ ID NO: 543854 - protein, 11 aa, Influenza virus
YSGGTINSPLP

SEQ ID NO: 543855 - protein, 11 aa, Influenza virus
YSGIKTDGATS

SEQ ID NO: 543856 - protein, 11 aa, Influenza virus
YSGIRTDGATS

SEQ ID NO: 543857 - protein, 11 aa, Influenza virus
YSGSFIDYWAE

SEQ ID NO: 543858 - protein, 11 aa, Influenza virus
YSGSFIDYWAK

SEQ ID NO: 543859 - protein, 11 aa, Influenza virus
YSGSFIDYWDD

SEQ ID NO: 543860 - protein, 11 aa, Influenza virus
YSGSFIDYWDE

SEQ ID NO: 543861 - protein, 11 aa, Influenza virus
YSGSFIDYWND

SEQ ID NO: 543862 - protein, 11 aa, Influenza virus
YSGSFIQHPEL

SEQ ID NO: 543863 - protein, 11 aa, Influenza virus
YSGSFMDYWAE

SEQ ID NO: 543864 - protein, 11 aa, Influenza virus
YSGSFSIRGET

SEQ ID NO: 543865 - protein, 11 aa, Influenza virus
YSGSFSIRWET

SEQ ID NO: 543866 - protein, 11 aa, Influenza virus
YSGSFTLPIEL

SEQ ID NO: 543867 - protein, 11 aa, Influenza virus
YSGSFTLPVEL

SEQ ID NO: 543868 - protein, 11 aa, Influenza virus
YSGSFTLPVEM

SEQ ID NO: 543869 - protein, 11 aa, Influenza virus
YSGSFTLPVGL

SEQ ID NO: 543870 - protein, 11 aa, Influenza virus
YSGSFVDYWAE

SEQ ID NO: 543871 - protein, 11 aa, Influenza virus
YSGSFVQHPEL

SEQ ID NO: 543872 - protein, 11 aa, Influenza virus
YSGSFVQHPEM

SEQ ID NO: 543873 - protein, 11 aa, Influenza virus
YSHGTGTGYTM

SEQ ID NO: 543874 - protein, 11 aa, Influenza virus
YSIADKICIGY

SEQ ID NO: 543875 - protein, 11 aa, Influenza virus
YSIDSGYVCSG

SEQ ID NO: 543876 - protein, 11 aa, Influenza virus
YSIDSNYVCSG

SEQ ID NO: 543877 - protein, 11 aa, Influenza virus
YSIDSSYICSG

SEQ ID NO: 543878 - protein, 11 aa, Influenza virus
YSIDSSYVCSG

SEQ ID NO: 543879 - protein, 11 aa, Influenza virus
YSKADKICIGY

SEQ ID NO: 543880 - protein, 11 aa, Influenza virus
YSKDNGIRIGS

SEQ ID NO: 543881 - protein, 11 aa, Influenza virus
YSKDNSIRIGS

SEQ ID NO: 543882 - protein, 11 aa, Influenza virus
YSKYEEESKLN

SEQ ID NO: 543883 - protein, 11 aa, Influenza virus
YSLVGIDPFKL

SEQ ID NO: 543884 - protein, 11 aa, Influenza virus
YSLVGIDPFRL

SEQ ID NO: 543885 - protein, 11 aa, Influenza virus
YSLVGVDPFKL

SEQ ID NO: 543886 - protein, 11 aa, Influenza virus
YSLVGVDPFRL

SEQ ID NO: 543887 - protein, 11 aa, Influenza virus
YSQITNGTTGN

SEQ ID NO: 543888 - protein, 11 aa, Influenza virus
YSRADKICIGY

SEQ ID NO: 543889 - protein, 11 aa, Influenza virus
YSSPMMWEING

SEQ ID NO: 543890 - protein, 11 aa, Influenza virus
YSSPQLEGFSA

SEQ ID NO: 543891 - protein, 11 aa, Influenza virus
YSSSLMWEING

SEQ ID NO: 543892 - protein, 11 aa, Influenza virus
YSSSMMWEING

SEQ ID NO: 543893 - protein, 11 aa, Influenza virus
YSSSMMWEVNG

SEQ ID NO: 543894 - protein, 11 aa, Influenza virus
YSSVASSLVLL

SEQ ID NO: 543895 - protein, 11 aa, Influenza virus
YSTAASSLALA

SEQ ID NO: 543896 - protein, 11 aa, Influenza virus
YSTGALASCMG

SEQ ID NO: 543897 - protein, 11 aa, Influenza virus
YSTISSSLVLM

SEQ ID NO: 543898 - protein, 11 aa, Influenza virus
YSTVAASLCLA

SEQ ID NO: 543899 - protein, 11 aa, Influenza virus
YSTVASSLALA

SEQ ID NO: 543900 - protein, 11 aa, Influenza virus
YSTVASSLTLA

SEQ ID NO: 543901 - protein, 11 aa, Influenza virus
YSTVASSLVLA

SEQ ID NO: 543902 - protein, 11 aa, Influenza virus
YSTVSSGLVLV

SEQ ID NO: 543903 - protein, 11 aa, Influenza virus
YSTVSSSLVLA

SEQ ID NO: 543904 - protein, 11 aa, Influenza virus
YSTVSSSLVLV

SEQ ID NO: 543905 - protein, 11 aa, Influenza virus
YSTVVSSLALA

SEQ ID NO: 543906 - protein, 11 aa, Influenza virus
YTENPVICLGH

SEQ ID NO: 543907 - protein, 11 aa, Influenza virus
YTGDPPYSHGT

SEQ ID NO: 543908 - protein, 11 aa, Influenza virus
YTGNPVICLGH

SEQ ID NO: 543909 - protein, 11 aa, Influenza virus
YTGNPVICMGH

SEQ ID NO: 543910 - protein, 11 aa, Influenza virus
YTGSFCSIDGK

SEQ ID NO: 543911 - protein, 11 aa, Influenza virus
YTIDEESRARI

SEQ ID NO: 543912 - protein, 11 aa, Influenza virus
YTLDEESRARI

SEQ ID NO: 543913 - protein, 11 aa, Influenza virus
YTLITDGPSDA

SEQ ID NO: 543914 - protein, 11 aa, Influenza virus
YTLITDGPSNA

SEQ ID NO: 543915 - protein, 11 aa, Influenza virus
YTLMTDGPSDA

SEQ ID NO: 543916 - protein, 11 aa, Influenza virus
YTLVSTKEWSK

SEQ ID NO: 543917 - protein, 11 aa, Influenza virus
YTLVSTKEWSR

SEQ ID NO: 543918 - protein, 11 aa, Influenza virus
YTLVTDGPSDA

SEQ ID NO: 543919 - protein, 11 aa, Influenza virus
YTMDTVNRTHQ

SEQ ID NO: 543920 - protein, 11 aa, Influenza virus
YTMDTVSRTHQ

SEQ ID NO: 543921 - protein, 11 aa, Influenza virus
YTRLYIWGVHH

SEQ ID NO: 543922 - protein, 11 aa, Influenza virus
YTSARQEKNPA

SEQ ID NO: 543923 - protein, 11 aa, Influenza virus
YTSGRQEKNPA

SEQ ID NO: 543924 - protein, 11 aa, Influenza virus
YTSGRQEKNPS

SEQ ID NO: 543925 - protein, 11 aa, Influenza virus
YTYRCHKGDTQ

SEQ ID NO: 543926 - protein, 11 aa, Influenza virus
YTYRCHRGDAQ

SEQ ID NO: 543927 - protein, 11 aa, Influenza virus
YTYRCHRGDMQ

SEQ ID NO: 543928 - protein, 11 aa, Influenza virus
YTYRCHRGDTH

SEQ ID NO: 543929 - protein, 11 aa, Influenza virus
YTYRCHRGDTQ

SEQ ID NO: 543930 - protein, 11 aa, Influenza virus
YVCSGIFGDNP

SEQ ID NO: 543931 - protein, 11 aa, Influenza virus
YVCSGIFGDSP

SEQ ID NO: 543932 - protein, 11 aa, Influenza virus
YVCSGLVGDTP

SEQ ID NO: 543933 - protein, 11 aa, Influenza virus
YVCSGVFGDNP

SEQ ID NO: 543934 - protein, 11 aa, Influenza virus
YVCSKFHSDTP

SEQ ID NO: 543935 - protein, 11 aa, Influenza virus
YVCTGILTDTS

SEQ ID NO: 543936 - protein, 11 aa, Influenza virus
YVCTGVLTDTS

SEQ ID NO: 543937 - protein, 11 aa, Influenza virus
YVDGFEPNGCI

SEQ ID NO: 543938 - protein, 11 aa, Influenza virus
YVDGFEPNGSI

SEQ ID NO: 543939 - protein, 11 aa, Influenza virus
YVDGFEPNGYI

SEQ ID NO: 543940 - protein, 11 aa, Influenza virus
YVDGFKPNGCI

SEQ ID NO: 543941 - protein, 11 aa, Influenza virus
YVEDTKIDLWS

SEQ ID NO: 543942 - protein, 11 aa, Influenza virus
YVEDTKVDLWS

SEQ ID NO: 543943 - protein, 11 aa, Influenza virus
YVELIRGMPKE

SEQ ID NO: 543944 - protein, 11 aa, Influenza virus
YVELIRGMPQE

SEQ ID NO: 543945 - protein, 11 aa, Influenza virus
YVELIRGRKQE

SEQ ID NO: 543946 - protein, 11 aa, Influenza virus
YVELIRGRPEE

SEQ ID NO: 543947 - protein, 11 aa, Influenza virus
YVELIRGRPKE

SEQ ID NO: 543948 - protein, 11 aa, Influenza virus
YVELIRGRPQE

SEQ ID NO: 543949 - protein, 11 aa, Influenza virus
YVELIRGRPRE

SEQ ID NO: 543950 - protein, 11 aa, Influenza virus
YVELIRGRQQE

SEQ ID NO: 543951 - protein, 11 aa, Influenza virus
YVELIRGRRQE

SEQ ID NO: 543952 - protein, 11 aa, Influenza virus
YVELIRGRSQE

SEQ ID NO: 543953 - protein, 11 aa, Influenza virus
YVEVLHLTQGT

SEQ ID NO: 543954 - protein, 11 aa, Influenza virus
YVEWTSNSLIA

SEQ ID NO: 543955 - protein, 11 aa, Influenza virus
YVKQGSLKLAT

SEQ ID NO: 543956 - protein, 11 aa, Influenza virus
YVKQGSLMLAT

SEQ ID NO: 543957 - protein, 11 aa, Influenza virus
YVKQGSLRLAT

SEQ ID NO: 543958 - protein, 11 aa, Influenza virus
YVKQKTLKLAT

SEQ ID NO: 543959 - protein, 11 aa, Influenza virus
YVKQNTLKLAT

SEQ ID NO: 543960 - protein, 11 aa, Influenza virus
YVKQSSLPLAL

SEQ ID NO: 543961 - protein, 11 aa, Influenza virus
YVKQSTLKLAT

SEQ ID NO: 543962 - protein, 11 aa, Influenza virus
YVKSDRLVLAT

SEQ ID NO: 543963 - protein, 11 aa, Influenza virus
YVKSEKLVLAT

SEQ ID NO: 543964 - protein, 11 aa, Influenza virus
YVKSERLVLAT

SEQ ID NO: 543965 - protein, 11 aa, Influenza virus
YVKSKRLVLAT

SEQ ID NO: 543966 - protein, 11 aa, Influenza virus
YVLSIIPSGPL

SEQ ID NO: 543967 - protein, 11 aa, Influenza virus
YVLSIVPSGPL

SEQ ID NO: 543968 - protein, 11 aa, Influenza virus
YVLSVIPSGPL

SEQ ID NO: 543969 - protein, 11 aa, Influenza virus
YVNKNPYTLVS

SEQ ID NO: 543970 - protein, 11 aa, Influenza virus
YVNTALLNASC

SEQ ID NO: 543971 - protein, 11 aa, Influenza virus
YVQMCTELKLN

SEQ ID NO: 543972 - protein, 11 aa, Influenza virus
YVQMCTELKLS

SEQ ID NO: 543973 - protein, 11 aa, Influenza virus
YVRLYLWGVHH

SEQ ID NO: 543974 - protein, 11 aa, Influenza virus
YVRQNTLKLAT

SEQ ID NO: 543975 - protein, 11 aa, Influenza virus
YVRSEKLVLAT

SEQ ID NO: 543976 - protein, 11 aa, Influenza virus
YVRTNGTSKIK

SEQ ID NO: 543977 - protein, 11 aa, Influenza virus
YVRTNGTSKVK

SEQ ID NO: 543978 - protein, 11 aa, Influenza virus
YVSCDPDECRF

SEQ ID NO: 543979 - protein, 11 aa, Influenza virus
YVSCDPDGCRF

SEQ ID NO: 543980 - protein, 11 aa, Influenza virus
YVSCDPLGCKM

SEQ ID NO: 543981 - protein, 11 aa, Influenza virus
YVSCDPLGCKT

SEQ ID NO: 543982 - protein, 11 aa, Influenza virus
YVSCDPLGCRM

SEQ ID NO: 543983 - protein, 11 aa, Influenza virus
YVSCDPNECRF

SEQ ID NO: 543984 - protein, 11 aa, Influenza virus
YVSCDPSGCKM

SEQ ID NO: 543985 - protein, 11 aa, Influenza virus
YVSCDPTGCKM

SEQ ID NO: 543986 - protein, 11 aa, Influenza virus
YVSCEPDECRF

SEQ ID NO: 543987 - protein, 11 aa, Influenza virus
YVSMEFSLTDP

SEQ ID NO: 543988 - protein, 11 aa, Influenza virus
YVWWASNSLIA

SEQ ID NO: 543989 - protein, 11 aa, Influenza virus
YVWWTSNSLIA

SEQ ID NO: 543990 - protein, 11 aa, Influenza virus
YVWWTSNSLVA

SEQ ID NO: 543991 - protein, 11 aa, Influenza virus
YWAEGDCYRAC

SEQ ID NO: 543992 - protein, 11 aa, Influenza virus
YWAEGECYRAC

SEQ ID NO: 543993 - protein, 11 aa, Influenza virus
YWAILKPGQTV

SEQ ID NO: 543994 - protein, 11 aa, Influenza virus
YWAIRTRSGGN

SEQ ID NO: 543995 - protein, 11 aa, Influenza virus
YWAKEECYRAC

SEQ ID NO: 543996 - protein, 11 aa, Influenza virus
YWAKGDCYRAC

SEQ ID NO: 543997 - protein, 11 aa, Influenza virus
YWAKGECYRAC

SEQ ID NO: 543998 - protein, 11 aa, Influenza virus
YWAVLKPGQTV

SEQ ID NO: 543999 - protein, 11 aa, Influenza virus
YWGILKRGETL

SEQ ID NO: 544000 - protein, 11 aa, Influenza virus
YWHLMHPGERI

SEQ ID NO: 544001 - protein, 11 aa, Influenza virus
YWHLMRPGERI

SEQ ID NO: 544002 - protein, 11 aa, Influenza virus
YWHLMRPGERT

SEQ ID NO: 544003 - protein, 11 aa, Influenza virus
YWHLMSPGERI

SEQ ID NO: 544004 - protein, 11 aa, Influenza virus
YWTLVNPGDSI

SEQ ID NO: 544005 - protein, 11 aa, Influenza virus
YWVMTDGPANK

SEQ ID NO: 544006 - protein, 11 aa, Influenza virus
YWVMTDGPANN

SEQ ID NO: 544007 - protein, 11 aa, Influenza virus
YWVMTDGPANS

SEQ ID NO: 544008 - protein, 11 aa, Influenza virus
YWVMTDGPASN

SEQ ID NO: 544009 - protein, 11 aa, Influenza virus
YWWDGLQSSDD

SEQ ID NO: 544010 - protein, 11 aa, Influenza virus
YYDRRLTTTIK

SEQ ID NO: 544011 - protein, 11 aa, Influenza virus
YYEECSCYPDA

SEQ ID NO: 544012 - protein, 11 aa, Influenza virus
YYFVKEGKIVH

SEQ ID NO: 544013 - protein, 11 aa, Influenza virus
YYLEKANKIKS

SEQ ID NO: 544014 - protein, 11 aa, Influenza virus
YYLEKANKIKT

SEQ ID NO: 544015 - protein, 11 aa, Influenza virus
YYLEKASKIKS

SEQ ID NO: 544016 - protein, 11 aa, Influenza virus
YYMEKANKIKS

SEQ ID NO: 544017 - protein, 11 aa, Influenza virus
YYNETFVNITN

SEQ ID NO: 544018 - protein, 11 aa, Influenza virus
YYNETFVNVTH

SEQ ID NO: 544019 - protein, 11 aa, Influenza virus
YYNETFVNVTN

SEQ ID NO: 544020 - protein, 11 aa, Influenza virus
YYNGRLTTTIK

SEQ ID NO: 544021 - protein, 11 aa, Influenza virus
YYNGRSSFFRN

SEQ ID NO: 544022 - protein, 11 aa, Influenza virus
YYNRRLTTTIK

SEQ ID NO: 544023 - protein, 11 aa, Influenza virus
YYNRRPTTTIK

SEQ ID NO: 544024 - protein, 11 aa, Influenza virus
YYPKYEEESKL

SEQ ID NO: 544025 - protein, 11 aa, Influenza virus
YYWAILKPGQT

SEQ ID NO: 544026 - protein, 11 aa, Influenza virus
YYWAVLKPGQT

SEQ ID NO: 544027 - protein, 11 aa, Influenza virus
YYWGILKRGET

SEQ ID NO: 544028 - protein, 11 aa, Influenza virus
YYYEECSCYPD

SEQ ID NO: 544029 - protein, 11 aa, Influenza virus
YYYPKYEEESK

SEQ ID NO: 544030 - protein, 5 aa, Artificial Sequence
  Description of Artificial Sequence: Synthetic peptide
GGGGS
